United States Patent 7,365,185 (GENOMIC PLANT SEQUENCES AND USES THEREOF) - sequence listing, part 75

SEQ ID NO: 75509 - DNA, 66379 bp, Oryza sativa
attgtgaaacggaggaagtaataatttgctgactttataagtttctgagcctacaaaacaaagaaggcttattcttctagatcaagtatatgacttacgatccatgctatccatacattgtatttagttttagcttaaacatggacttaagatttaactattcaaagacaatattttgtttagttaatcatgtcagtcagaaagcgtgttatgctcttttgcttatgtgtattgctacagtaaaaattctgtttaaaacatgttctatattgtgaaaagtcggaaatgcaacataggcatacgagccatgcatgatactcttatgactatttatttctttgtccacgaaaccaacttcaacgagaattacgggtaaacaagatatacaagccatacatgatacacatctaaccaactctaactacatgcatgtcaagagttctagttgagtctcaaaagtaccaagattcaactcagattccccactacaactagaacaaaaactttacattgcatgcgtagggaaaatgatcatacatttgagattgagtgatttgcacatggttcaaatcaagccaatagtacgacgtctatctagcaacccggatgcaccaaactccaatatcaggaaaagacaaaaaaaaacattcttagctacattatacctttgccttgctctatccaactcggggtcaaatgttgagcttggatcaacagttgtgaccatctgatcggaccatatttacgccaaggtcctaaccaacctttgtcaagtctttacaagcttgaactcatccttgtcaacatgatgttcatgtcttgatgaccatcaacacatggtgtcatccattagtctcatcacgacaatacataactcaaaggaaaacattagtcctgacaaatcagttgtatccttccatagatgactaatcggttgcatatgaaatatatgaatacaatagttgagtactcatcaagaccacaagtgccaaatacttgcatgtaagcttaagtgcaaagatccaatataaactagataataccccgcacgttgcagcgggacatagtgcataccaacgaaagagggaaaattcaatgagaacatttgatccatcacaatacatgtaacaaaattctatgagaatatttgatctatcacatttaacaaataagtgaaattgcgttcttgcccctctttttagggtttttgattttatctcatttgatcaactatagaaaaaggaattacgcaacaacaaatgttccctcttttttaggattttttattttatcttatttgatcaactataggaaaaagaatttcatgacaacaaattttggaaataataactcaataagtagaaattcactgagagatcatgaaagttttgagtattactgtcggatataaaaggtctaaaaatgtgtaatgatcataaacctgtttgttgcaccttgctataaatgaccacctgtaatattcttttcatcttgatatatatggttgattgatagagatgggttacattatttgactgaaataaattatactgcaataagaaagaaactaagttacgggatacaaccttgaaatttctaaaataatcactttaattgaagaggaaaactgaattctcttctgaatcataacataagtgaaatatgaaggtacatattagtgatcagatttacattcccaattggtgaagcatataatgtattggcacgcttaatatgatctactccaatatgaaaggagggggaatgtaacataaaatttcataaaggataaaataagtgatacatggtgtcaccaatggacaggcagacggaaagcacacccagtgaactcaacaaaaaaaaaacttttgttttaatttggtaagccaattaactcaacatgaaagaatgagggaagagaagaatgtaccttatccaacttgaagattgatgaggacagaaaacgaaaagttgagaccgtgcagaaacacaaaaacaaatctcagctggtgtttgtaatggaacaatgtcgctgaaggacatcatggttgattcgtagtagttcaattactacgaatctcagctggtgtttgatgggttacactatgatttaaaggtgggtgtcatgacagccatgaaacgtagatgagggtttcctagttttgccatacatgaaaaaggcatgaaggcatcacgccgtggaatctcaatgatttgggggagcgataacgatcgcgacgttttcttttcctgccgttccaattgatgactacgggaaaagaacgatctgttttgcatgatggctggactggtgtggtggacttcaatgggcttcattgtaggcccgtccactagaagcctagggacatgacgtttaacgctgatcaaaccacacaattccaatctaatggtccaaaacaattaagatgatgtggcaaagcgagagagcaggaaaataaaattagtggggatgacttgtataggtatatagcactacatgaattctaggcttctgtgacgattacattatgacgatatcagcctgtttcgtgtcactgcctgccagcagtgatgaaatggctgtcatcacaaaaggtgggtcactaaccagcttctgtgaccaccaaaggacatcgtcattgatacaatgacgatagttctcctgtcattgatgaatgacgagacaaattcgtcataacaaattgaaccgaataacaccacgtgtatgatgacatgtgatacagatgacaaggcaggtgatgtagcaaatgacatggcaattcacattcggcccatatacatgggcttttttattctcaattacaattggcccaaatattttttttgacccagctacaaatttgcttttatgggccaatccaattaaaaagcaatcacagaatataaaccacaaccatttgaataattatattataatcacattccagccataattaatttcccagctcatacaaaagcaagttccagcattcagtttgcaacatgttccatacaaaagcacaaaacatgattacaaaatgatccatccaccatccaactacacaagtcccagccgactacaaagttcctataggtagtgccaagttcttgcaccaaaaaattccacctagcagccactacattaacacgagccatcaaattccaagctcagacacctcattcctgccatcaaaaggtgcatgttttcagttgctgatgaataaaaagtccattttgtttggatttggaggcaaacaaatgagcaaacagtgtttagagagtaataatccagcaggtaaattgagtaataacaatatattgatatggctcttttccagcaagtccaaacaaatggctcttttctagtcacaactaaatccaaacaaatggctcttttgcagctaataatccagaaaaaatagagtatctagattaatcaatgaaatggctcttttccagtcacaactaaacaatatctaatttcacagtaacaacaactataaataatccatcaagtaaattgaaataggcaattttgatacacaccatgaacaaaaaattcagccaccaatgaaacagtacaataggcttgatatggatgcaaatgcacaagaaacaagttaaagctatgtacctgagcatacaactagcttagggaggattgatctgaccttgtccaaatgctattatttgtcgaaggaggtcctgatggtgaagtgagggattcccgggcatgcatatcctcctagcaattaaagcaaggtttcagttttgcattattatataaataaaggttcattacgatttatcacatcttattaattaaaaaaaatagcacatcttacctcactacacaactgtgtccttggagattccaaatgtataaaagaaaagacaagttttacagcggatctaggagtagcagaatcaatctagacctttcatattttctcatccgatggactatatctatttatactaccaccttaaccactagcagtagaacttataaatcaatgtcttagatttatactactaaaggagatcactgtaaaagcccttaaaaaaaaggcatctgcttggtcaatcttacatgtttcagatagcataaaaagactccgacatctcgtgcaaaaattgaacttactgtttacacccaaatttggcacctatggacgaaatagaggaaaattgccaaagtttggaaagtaccgggtttccttcacggggccggtcagaccgctggtatatgggcggtctgaccggctagtagggccggtctgaccacaggtatgtgggcggtcagaccagcagggtctgagtccaagtctgttttcgtcgggtctcaggtttccttgctcgggaagacatgttttgtgtttccattggtttctatcccgagttggacatggaggagggcctgtagagggcaaaaccaacccctatttaagggacaaggccggttcattgtaaaacccccaaatagaatttacttgaatcgttcttttactatgtttttctattttaccccagtttagtccatcttcgtcggtttgcgccgtaaaccgtccgccgccactgcgagagtgcgacatctctttgtaggtttgtcctgaaaaccttccgttttgcccacgagacgggtagttatcctcatatcgatctaaatcggcctagaggctgattttgatctctaaatcggctccgctagccggtttagctgtttttcctcaaaacccatcttgatttggccgtttggctagattgagatggttggcgactccatacgaccgcaaggcgtttaggtgttgcgatcgtgcttgtcgacttgtcaaaaaagtcaacacgatttttgacgactccgctggggaacgatgtaaccggccatatcacggccgaattttgtttaatctagtcatctcgtcgaatagtttgtttcggccaaacggccgaaattaatctataccttaattagtcgctgcactgttcttatcgctggattaatctattcggcggcgaagctatttggtcgtcatcaaattcatataagcacttgccgtgtgtatcgaaaatcattatcaggaagcagcagacggcttagcaacgtttccttattgtttcacacggcaacagagaaaagatcaggctactagagccgatctaccgggtcacaagcagcagaagcaacatcaatctgttagcacatacattagcacatctactgaagagaattaaaaaaaaatcaaagccgattcatattgtttcggctgttattgtgagatcgaatttctgaatttttgcttacacacgaggagacagaagcaattctattttagttgcacacacgcttgttatattcaaaggaaaaatcaacaccgtatattaatttatttagtcaaatatttcggctatgagctatatggccgaaattaatcaaggaatttcttcatcaaccatgatgagcgagaacgagatcatgccgatcacattggatgatttcgaaggagaagaccgcaagtccatggaggagtacatcaaggagatcacacaggaggcgttgatgagggcgtgcactaggactcgtcaaggcgtgatgaccaagcccgggccacgtcctaagttcgcttccgattttgtaagcaatgaagaggtaacacaatctatccaacaagtagcatctacaatagattcatctatgactgtttttaaagataggttagatgcaacttttgagggtaaatttgatgagtttttaagatttaaagtcggccctctcttggccgattttatggtaaaagataaagcctctaccactgctagccaagctcctatagatcaaacaagtagtggaaccaatggagtggcgcatatagccggtctgaccgggcctgatggccggtcaaaccgcgacttcaccgtcggtccgaccagccaaacggccggtccgaccgggtattatcccggcagtcagaccgggactcaggccggtctgaccgcgcctctggatgtcgctcagaccgggccctagaccggtcagaccgacgcaatcataccgattcaggggatagatccaatgaccaattctagttatttgtatcatcttagaacatttaatcctcctgtatctactgctgcgactaatccccaagttcccccacatgttcctaatgcttataatgatgttgctagggggtatcatcccgatactaggcaaggccaatataatcatattgcgccgcaaacacaacctattaggccaccaaatccaccaccaaatcaacataggcctgataatatggaggaaataactagtgggattattagggataaattcgggattgaaactaggaattgtgctaaggtttaccaaaagccgtatcctgactattatgataatgtgccatttcctcgtaattatagagttcccgaatttaccaagtttagtggtgaagatagtaggaccacatgggagcatgtaggtcaatttttagcgcaatgtggtgaggctaatagtgatacttttaaattgcgcttgttttctttatctttgtccggtaccgcatttacatggtttacttctttaccggcaaattatatttatacttgggctcaattagaacaaaaaattcatgatcatttttgcactggtaaaactgagcttaggttgtctgatttaacatcggttaggcaaaaataaaatgaatctgtcattgattatattgaaaggtttagagatattaaaagccgatgttttagtttgaaaataactgacaagatttggccaacattgcatatgatggattgcttgattctattaaagagaggttgaatggccaaatatttcttaatgttgatcatgtgttatgtgttgcatgaagcactggctcaggaaagccgggtggatgataatagcttaaatgctagtttagatgatagtgcaatatcatgtgtagccgaaccaagcgacggttcgaattgtgttaataatttttgcaatgatgccatagcgattatagccgaaccaaatgttggttcggattgtcttactagcttggatgataatgcaacaaccattatagccgaaccaagtgttggttcagattgtgttactaaattagacaataatggaatagccgaaccaagtgatggttcggattgtgttgctagtttagacaatgacatcattgaaaatatagccgaaccaagtgacggtttggattatatcacaagcgaaagtgaaatagcattgtcacctaagaccgaatcacaaatcagtcatgtggatgttggaaaagataatgataatgtcttgcgggatagtagtgagatagaatctaaaatagttatgcatgtatcttgaacatgtagattcggtcccatatccgtaaggatttgaggtgcccaacttcatgaaattcacaggtgagaatgctatgactacaatggagcatatcggccaatttattgatcaatgtggtaaggtcggtagtaatgatttgcttaagttaaaattgtttcctctttctttgtcaaactttgcatctacatggtatagtttacttgctcctaattcaatttctacatggtcataaatggagcatgagtttcatgattattttaaagatgcaagcttgatggagcaaagaccgattgatacttcatcggtcacttgtgaaactatttcggttacatctatgcctaagaccggaattgttagtgatcctctccctgttagttttattgatgttggcaaaaagaaagggaaaagtgttattattggggatcctcggcccaagaataggataaaaaatgcgaaggccgaagatcataaagttgcaaagggtgagtcatctagttcccaaaagaccaaaaagccgaagctcacttttgagatgcttatggctaagtacaataaaggattagccggtcaatgatttgataatcaaactagtgattcaaaaagaccaagatcatcttgtagaaaaagatttggtcaaacaccaaagcaatcggagccatcaactataccaactccatacaaacctccggtagtgatgccatggtatccatatccaatgtcaccatttggttatccttttatgtattatatgctgtggatgcatcaaccacctatgccgtattatcaagagtggaaggaatcacctaggtcagtaccaactcattcatttaactctagtcaagaccgtttcccacaaaagaatcggtccggtggatcaaaggtgaaaaaggtaaagaaggtgtgggtgagaaaagaagccaaagctccggaggtcgtcactattaaggaggaatctcaagatgttcaagtacctactggcacagttattaagaccggaccggaccggtggtcagaccggaaaaaaccggaaccagagcccccgccggtccggtccaggtaaaagatgttcaagtacctactggcacagttattaagaccggaccggaccggtggtcggaccggaaaaaaccggaaccagagcccccgccggtccggtccaggtaaaagaccggtatgcaattgagccggctatgaaccggctagaccgcccggtttcggagaaaaaccgctattaaaccgggaataaaaaccgctttgaaccgggctcttgacggctggcgacgaagcgcgtgcatggccgcatgggcacgcgctggtgggggagaaaaatgagtgaaaatacgcgctagggtgaattagaacccaggaccacatgggaggaagctaactcaccgaaccaccacgctaccaagcgccttgtgtttggacagaatgattaatatatttaacacgtattgaaccggattagaccaacggcctaaccggttgaaccagtgaaccattgaaccgagagcctcaccggttcaattaccggtccggtcttaataactatgcctactcgagatgcggcgaaaactatacaagcggagaagattgaagccgataccgttactgtccacatcggcggtctgaccgaggcgtctggccggtctgatcgccagactacggccggtctgaccaaccctcctggccggtctaaccgacggcttgcagccggtctgaccgggcccagaggccgatcagaccgaggggcattaaaggtgagcgggaaaattgagagcaacacaggagcttctacttcgcccaaaactattaagaatcattgtttagctcctggaaaacaaccacagccgaagtggataccttctggcttatctcgctctcaaaagaggaggctacagcgtcttcgagccataggtcaaaaagaaaaagacgccgaagatgtagagaataaaacatgtaataatttagagcctcgaacgacacctaagcgagtgtggagacctaaagaagtaaaagttaaaagatcggtgatttcatggagtagtgatggattcaatttgatgagagaagaatcatcggtcattaaaaaaagggtttgttggaaccatgccaccctaattttgcaaaatttgagatatgccacccgtatctcaatgacatgtaggacccacatgagtcaatgacatgtgggtcaggatggcatattacaaattttgcaaaatttgtgtggcatggttcaaattttcccttaaaaaataagtctccttcacatgatgctgtggatgttggtgcggtgttcgtcttgcctttgaaatcgtgcagtcgagaaagccgattttgcttggggggcaagacattattatgcttatgaaggaaccaagagaggatgaacggcgatagatacaacatcacatctttgagctgtcgtttgttggatgctaaggcaatgtatgggtttattgtgttcatcatcatattatatgcctatgccatgttagaacattgcttactatctagcacatgtgtgtttttgcttatcaaattgatattatacatacatgttgcaaataccagttctaattagtggaattggtaagttggcatataatttgtttgaatgtatgatttggctcatgagtctttgatatttatttgaagccaaattatggatgtttttatggatcgccatataatatatagatttcatatttattgcaccatgaaaattttgcttagtaattccgctaatgtcaatggtgaatatgatgatttgctctagagtggttttctttaggaacattgggattattaatattttgcatacatgctcaagccgattacttacatttgtagtttattcgaatctatgcatgtgacacatatgattttggtgattcattattgatcatacttcaattggctaagtgttttgatgccatgatgattattgtttcaaaagccatttgaattagtattcatctagacatgttagttggatgttatagtttttcatatgtctagagagaaggaattttggtccaataatttgatacaccaagcatctggctattatgtgaaaaaaaattatatactaaaggccgatgcttgatttcaaaagtttggacgaaattagcaaagtcatagaccaggggcggtctgaccggcattgcacggccggtctgaccggtggtaccggcggtctgaccagctctgcatgaccggtctgaccgggtagatagggcggtctgaccggtattgtgtggccggtctgaccgatcccggacaggggctggggggcacgttacaattgattaaaaggccgaattaattgtgaattcggacatttgtgcccatgagttagaaatagcttggagaattcctttgaatagaatatttgaaagatcctagtcttaaggttgatcaaaaattcagcggcaagagttcaaatacactttgcttgatggagagttatatcgccgaaatatagatggagtgctattaaagtgattggataatgatcaatctagagttgctatgggagaagttcacgtagggatttgtggaattcatcaatcggcccataggataaattggttgcttaggagagtggggtttcattggccgaaaataattgatgattgtttcaaatgctatagagggagtgaagcttgttaacggatcggcaatgttcaattagcgcctaccgctgtgttgaatcctatcattaaactatggccgttccgaggttgggctttagatttcattggtcaagtttatccttcgtcatcaaaagggcattggttcgtgctagttgcaatgggttacttcactaagtgggccgaagctgtgccgctcgagaatattacttacacggaggtaattgactttatttttaaagcatattgttcatagattcggtattccttaaactttgatcgaagatcttcttttatgtccaaggaggtgagaagttttgccgaattttatgattttaagttgttgagttcttctctttactacgctcaggctaatggataagccgagtcgggtaataaaatattgttgaaattagtcgaaaggaaaattgaagaacactcaaagaagtgatatgaggtgctttcagaggcattatgggttcatgggatatttaaacatgatgctactaaagtcactccttttgagttggtttatagacaaaaagctgttttgtcggttgaggtaaatcttggctttcttcagtatttcaagcaagacgacttgttgattgaagattacaatacctttgatagaaggcaattttgaagacgtcatcaacaagcgtttgaagactttgaggagatgaagatacttcaagacggtgttttcagagagcaatcaatgggaaatacttgaagaaatacttcccgagcatttggcaagatgcttaggaagtcctatggccggtaattagattatcgccctgagataacatgttctatgcttttaggttcacgtatgttcaccaaaaagacgggggtatgtgtttacacccaaatttggcacctatggacgaaatagaggaaaattgccaaagtttggaaagtaccggttttccttcacagggccggtcagaccgcaggtgtatgggcgatctgactgcaggtatgtgggtggtcagaccggcagggtccgagtccgagtctgttttcgtcgggtctcgggtttccttgctcgggaaggcatgtttcgtgtttccattggtttctatcccgagttggacatagaggagggcctgtagagggcaagaccaacccctatttaacggacaatgccggttcattgtaaaacccctgaatagaatttacttgaattgttttttttactatgtttttctattttaccccagtttagtccatctttgtcggtttgcgccgtaaaccatccaccgccgctgcgagagtgcgacacctctttgtaggtttgtcctgaaaaccttccgttttgcccacgagacgggtagttatcctcatatcgatctaaatcggcctagaggctgattttgatctctaaatcggctccgctagccggtttagctgtttttcctcaaaacccatcttgatttggccgtttggctagattgaggtggttggcgactccataccaccgcaaggcatttaggtgttgcgatcgtgcttgtcgacttgtcaaaaaagttgccaacacttaccaatgtggtgaaaacaactggaagaaaaaaaaacaatgcagagcatccagctaagatcgatgtataaagcaaaatatatcattagtcccttatgttctactactccatttcagaacattagccagctttattggtaagttcaatttcagaacataaagtcgacagatagcatcgagagtatcatcacatttttacctatgagctcatcctatatacaagatgctattataaaagtcggtgcactgtgttagcttactagattccaatataacatagaacaataaaatcaacggaggaaagaaaggcaagcagtgagacacaatacttgtgcagacgaaaacagccagccacaataaaacagtccatggcatattcatattataaattatagtattatactagcaggaatcagctggaagctatgaaaataggagctgctacataaaacaggactagcttggtccccggacaaatttaggaattagctttagctcttactgaaaaggtaacagcatgaatgaatgaatgaatgagttctagggggctagactgctagggttacacacacagttcaaattacagctaaacagaggcaggaattttggcacgaagcagttcatagccagaaacacttcgatcaatttcatccgtaaaggaacaccagaaacacgaattcatcgtagtgttcgatcgtatctgcgagacgcgactagaccacacactaatctaagcttcccacgcggaggaatcgccaactacacgagctctcacacgagtaaaacaaataaaatcaaaccccccagatctagcaactccgctccggagaccagggttttgacctcacttacgtcgcgggggttgggggagattgagatttaagagtgagggagatgaagtgaagggacttgtctagtgtactgactggggtggcgggagcggagagccctgtcatggtcggtgctccattgcatggtggacgccgccgccaccggtaactttttcgccggagggcgccgcggggggggggggggggggggctcgaacttgcgctccttcttgtcgccgtcgccgccagacttgcgctcaccgggggtgccaccctgcttgcccatgcctccgggagtgccctgccccatgctcctcgctggatctggccggcgggaggccagatctggtggccctgaggccggcctgccgccgcctacgggatgtaggtgagtggcttcccgcccgtggtgcgggacgaggcgacgagcaccccgtacccataggccgccgacctccgggggacgctgaggtaggggaatagggaggagagaccgccgcggcggatgagccgttggaggaggagtcgcggcggcagtggtagtcgccgtcggaaaagaagggaaaaaaagaggaaagaaaaaaatgacgcgcatggcgtcggcagcgcggcgttggcctcggcggcggcggaagacgcgcgcggcggcggaggaggaggcagatgcgcgggaggcagacgcgcgtggcggctgagtcgacctcggcggcccggcggcggcggggaggcaaacgcgagcggtggcggagtcgaacgcgcgggagtcgacctcggctgtgtcggagtcggcctcggcggcgagccggcgacggattcggcctcaacggcgacggcagagtcctcggcggcggcggcggcgaaggggagtagacacgggcggcggcggagtcggccgcggcgtcgtcggagacttcggcggcggcggcggaggcctcgggcggcggcggggaggcagatcgcacggcggcggaggagtcctcggcggcggcggtggaggggaggtagacgcgggcggcggagtcggccgcggcgtcgtcggagacatcggcggcggcggcggaggcctcgggcggcggcggggaggcagatcgcacggcggcggaggagtcctcggcggcggcggtggaggggaggtagacgcgggcggcggcggagtcggcggcggcggcggtatcggcctcgggcatcggcggagtcggcctcgatggtgaggaggagcgacgacggagtcggctgtggcgtcgtcggagtcctcggcggtggcggcgtcggcctcgggcgaggaggagcggcagcgacggcgaagtgaggaggagggagaaggatgggagagaaaagaagcgaaccgttttttttaatggtataggtgggtaattttttttccccaaaagcaggtgaaagcaggggtagaggtgcttttgagttgtactacaccaaaagctggcttttggcaaaagtagctgtggcttttgagccctttggttggcttttagcttttgcaaaagcaaaagcaggttgaaaagctcaaccaaacacacccttaacagtatttaccaaattgtatggataaaacgaacatttcaccttaaattttatttttggcatgaccgccaagattggcgcctaaaaatttggttccagccacaccaaaattttggcgcctctccagcattaacttttttttcaaaaaaaaatacaaataatatcttgtactttttaattttaatttatgagaactttaaatttaattttagactgatttttatgtttcaaatgcaaaaatcataaacaacaaaattgtagaactcatcgagatctacaactattgtattggtcctttttacaaataagttcatttgaacaattcaaattttaaattttcaaaatttaacaacttcaaacaaaaattgggtttaataaataattttaaatggaaaagtcaccaaaaccaaagttgtagaacttatcgagatgcaaaatttttattttggtcatttctccatctgactctatttgaataatttgaaatttgaaaaattcaaagtttgagaacttcaaatataattttttattagtgaacgacttcaaataaaaaagtcatcaaaaacaaagttataacatcaatatctataacttttattttggttttttcttcatccgataaagtgatagtaacattgttcacaaaatttatatatctctcttatagtttataaactatataagagatgtgtaaattttgtgaacaatgttaccatcactttatcggatgaagaaatgaccaaaataaaagttatagatattgatgatttatacaactttgttgttgatgattttttcagttgaaatcatttagtatttcaaaaatgttgtttgaagttgtcataatttgaaattcaaattcaaattattgaaacaaagccatatagcaaaatgaccaaaacaaaagttgtagatattgatgacttatacaactttgttgttgatgactttttcagttgaaattatttagtatttgaaaatgttgtttgaagttatcataatttgaaattcaaattcaaattattgaaccaaagtcatatagcaaaatgaccaaaacaaaagttgtagatcttaataagttatacaacttttttgttgacaattttttcaattgaaatcatttactaccgaaaaattatttgaattgagaggagggaggaaaatagacttccttgcaagggaggagcaaaaggactgggccggtggcctgaagagggaggaagagagagaggggctgcaggctgagggagggtgagagtaatacttgggccgaaaatggcccaagtacatagagaggaattttaatttgttttccatttattataataggttaaaatgaactttgtggtatgaaaattagttattgagctccgaaaattcacaaaaaaatttcagagaataatttagaccacgtagaatattacaaatatatttccagccatgatttttaaagcaaaatttttcgtcactaagcctccccatctcatactaattaatcgtcataaaatggaatgtgctaatgacgaatagctccgatgttacgagaaattcgtcatagaaggtcatatttcttgtagtaatgtaggttcaaaccaacttatagccattttaaagttttttcattcaatcataaaatgaaacgccataattctgatttttttattcataaaataagactagcgatgacttcaatcctaaaatactaaaatgagagacaagaagagtccacctaggacaaacgatttgtgatctagcagcaatgtagtataacaagattttttttgttttttaaaaatataatagttctatattttatgacgatccactattgtcatcgtgctatcttcacagagcccatgcaaagtatactatgatgatgattatgacaaatacacagtttggtcataaacagttatcatcctatgaacagtcgtcataaacagcctctctgtttatgacatatatgtgttctgtcattaggtaatcgtcacagaagcccagatttgttgtagtgtaggataataggtgaacaacatggatctagaacatgcacgatatatgtataagatatgctcccccaaatatatgcatataatggaatatataatggagacaaatatatgcataattagagaaaaaccaatggggtttgttccctacacatggagaacgcatgtagcaataataaagacacataaatacaaaccttcattatgttgatgttctcaatgtaaagaagactaaataagataaagttcaagtaaacattggtctcactcatatatactccctccttccaaaagtctcagtcgtattacgttttgctccaagaccaaggaactctccgacgcatttaaccatcgctacatctgcatggatttagaggaagcgacgcttcggttgatgcacgatacgcgtgtgtgcaacaccgcaaccgtccgcgcccaccgctcgcgaataggcaacggatggatttgcatgcatgcaaaagaatactgttcggttgctgagaggaattaaatccatgcatgtttaacgaagagaccagctacacatttaaagcctgcatgcatgcatgcagagtggaatgcgcccatctcatctggaaaaacaagaaaaccaaatacgactgagacttttggaaggagggagtattgactaggtgattccccgtgctttgctgtgggatttacgaaggaattctcaaaaaaaatggcaatcaagttagaagtaaaaagaaaaaaaataataaaacatcaggtttatcagtcaaatcatacccatgctttggtcaagcattgactaaaaacacacgatattatggattacaaagattgtatggataatcaatatcaaaggtatggcatataacaaagtaggacattcacatataaatagcatgcaaactttatttaaatcaaaataagttcgcaataggtccaatatgctcaaagattagtgatgacttgccttgctcactgtcttgctgtccttgttttgcagtcaactcaaccactccctcggaatctatatgtacgtgcgaaagattcgatttgaattcaattagaattcaaattaaatcaccaaaattcaacagtacaaaaataaatagcaaaagtgattccatcagctatatcttgattttagatgaatttaggttcaagtttcatttaaatccgagctaaaatgagtgagctatgcttgtttaaagattcaaatttgaattaattcaaacagttgtgaaatggcactgtgcagccgagaggggcatgattacagtggctgacatgtagggtcaccccatttctttttcctttgtttttattttcccatagaaaatgcagagagtcattgacaagtgggaccggccctatttgacctgggtccaaaccagccctttaatcccggtgggtcccgcatgccattgacagtaacttcataatcaatttttctttgatttttctaatcatccaatcccacgtgtaatagattaatttgcattggattaataggtgattactgtgcactaatctctatgtggggcccacagcttctctctctctcttcctttctttctctccctcggtcgtcttcctcctcccgacgcgcagggcagcggcgcgggcgcacggctaatgcgaccagcccgagccgggacggctcggccgtggtgagggaagcggcggcgcaccaccggagacccaccgccggcagcaacgaggcgcggcggctacaaggggcatgacgcgacggacgggtggcacggagctcacggcgagctcggccatggcgcgggagaggacgaattaaacctaaccgagcctaaattcaccatctagggtctctagtgaactaattcatgcaataatatggcctaggttagtttggaactagtgccgtccacggtgagctcaacggtggcgcaatggcggcccgtcggcaggctagcagcggcacacacacctcaaatcgagggggccaaatgtttctaggtcagtagagggtgctaagagcgcaagtatttaccgtgcggtggagcaacggcataggtcggtgatgcgcggcacggtgcgggtgaagcaggggcgaatcgacgtcggcagcgcacgcaggtgttcgacgcactctccccgacgtccagcggctcccggcgttgatgcaaggcagcagaagaagtagaggcggcccgagccacagctcccgcggtcagctacgccggcttcggctccaaccagtgatgatgaagcatgctcacaaggtgttcgatgaaatgtattcgaggaaaaggcagatagggatggagtttttatgggggggattggcttggggataagccaggatggcgtggaggataggatcggcagctggtgcactcaatggctgtctatacggcctagattagggaggttgacgcggctatgtttcctcctccttttccattaaagttctgtagcagatcattgcatctatgacccctatactgtgtgttctagccctagctagagaggaaggctccgttttacccgctggttacaatggaggagggacccggcatccgcattcggataaggtggcggacgtggcgacggcgatgcgcgcacatggcgatggcagagcggcggcttggtgagggcgggttttcgggtgtagggcggttggatagggtttaggggtggtgtgggggtgacgtcgcggccgttacccctcggctccgagacgatgggcgacgcgacgttgctgatgcgcgctcccgtggcggcgcggctttggcgcgggttttcggtggctcggtcggcggcgggcccacgcggtgtggcgcacgggcacgcccaatgcggcgcacgagcagagaaggcgcgtgcgcgtgcacggggaggcggatgctgcgctgggtgtttggccgggttagaaccgagtcgaacacctggcgcacaatgaacagagccaggctgtaaatttagggtttttgattgattttataaattgaggaaaaaggtctatttcaatttatattttcaccaatgcattttaacgacaatatgaagtattcaaatgtgaattttgttcaaaattaatattgtccaaatttttaaattgtactataccttttatgatttcctatacttttgggattttggtatttattcgttttcaccatgtgttggtttaacataattatcctatataacttgtaggcttggacaattattaattataatatactaatatcaccatattaatacaatggcacattggtcgagtttatttgtattaacaatgtatttacacacggataggtttaatctatttatttcacaaaagaaattgagacttggcacaatattgatctaaatatttaattatatactcccatcattcaatctctatatataaagatcaatttattttatgtgatcaattattttatatgagtggatgccatgacacagtcacaatattaatatttgacctataaattaaattagtaattaaccttctctttatatggctttgttgtgttgtgcgtaaatatctatagggttcataataaatatcttatttttataattgttacgtagttgtatagctttagcttaatcttcaatcgtgacaatttatagtttggcaagcaatagcaaccataacatccaacatgatgcaaaagttttaaaaagttcaaaattttagtgatttttattgtcaggaattttcaggatgttacaatgcattgccagcaatgttaggttcgacaacactaccattgttctggtcataatttgtaattcacaacatagattttgggaggcaaaatgtttgcatgatgggcttttctgcagtttcgtggatcattaatattgatccctacagtgttcaattctggtattgtttggcaatccaggacgaaatatgtagtgatgtcagatgttccttttttccagttaataatttcagatgttcttttcacagcacctaaagctttgcggtgatagtagagtcgccaaccacctcaatctagtcaaagctaaatcaagatgggttttgataactaaaccggcttgcggagccaattctagatagaacgatagacaactacccatctcgtgggaaaaacggaaggttttcaggacaaacttaaaaagaggtgtcgcactttcgcagcggctgcggacgatttacagcgcaaatcgacaaagatggacaaactaagcaaaaaactaaaagcaatatgaaaaacgattcgattgattgtttgtagattgattagttacattgatgcaaaagtttggcaagcaatagcaaccataacatccaacatgatgcaaaagttttaaaaaattcaaaattttagtgacttttattgtcaggatttttcaggatgttacaatgcattgccggcaatgtcaggttcgacaacactaccattgttctggtcataatttgtaattcacaacatagattttgggaggcaaaatgtttgcatgatgggcttttctgcagtttcgtggatcattaatattgatccctacagtgttcaattctggtattgtttggcaatccaggacgaaatatgtagtgatgtcagatgttccttttttccagttaataatttcagtatgttccttctttttcagatttcagatgaagaatcatcgacaactaaaatgaattttctggagaaatggacaacaagattttcgctatagtgtactccctccgtactcgtaaaggtactcgtaaagaaaatcgttttggacagcgacacggtctccaaaatacaaccttgacttcttgtttctctaaaaatatttattgaaaagtgatatatgtatacttttatgaaagagtgaactgcatgttggactatattttcttacccttgtttcacaatgatctaggtgttatcaaacatttttattttcaaccagctatagttacttgagcatgcaatttggactagacgctcacatgtcaaccagaccaggtgtgtctctccctcttccccttctctcttcctcctccagaaaagtcatccccatccccactatcgctccctccacttacctttccagtctgcctatagtagtctcgctgcccatctgttgtttccgtcgagcttgagcatctagattaggagcttgatgactagatcaagcactaaaccagatcctgctgccgctaccgttgcaagagcaatcagcagaacacatgggagaaaaaagagtagcttcagggcagggcagttgaggcgccacagcggtgcaagtggagctcgagcacgtggcatgttaggcggaggtcgagctcaagcacgcagctggcaaaggtggccacagatggagctcgagctcgagatcaggggcaatgtagacaaagctcctctcttcaaggccattaattccccgcagctctcaatacctcaggctggtggtgttgtgctcacctgccggcttgacccaatgtcactgccaaagttacaaacgattggcagccagcagcatcttgatgtaggagcaagcagtggctgagtggaaacaggggatgtggaaatggatagggtggtctaatgtgcaacccaaggtaaaagactctggtctaaactaaaaatgttggatgtgccatggtccaaagtgaaactttggtcataataactagcccaatatgcaattcactctttatgaaattatttttcaagacaaatttattcatataatttttacaattacaaactcaacaacttaagagttattcatgatttatattccaaaggtttgacttaaacagttgtcctaaacgagtacggagggagtactaaatttttggatcacttttattttttttttggccctactcatacacttgaaattttatggttagccctactcatacacttgaaagtaacaacatgtatgtatatacaggcatacaacacatgtaagcatggcctatagcggaggagaggaaaattaatcagcaaaaacatggctgcttaatatttgtagagacgtgtggtgcacgtgcatacttactggtaagtactacctccaattataatcacataagtcgtttgactttttcctaatcaattttttaaaagtttgatcaagttaatagaaaaatataacaatactttcaatacaatacaacatattatcaaaatatatattcaatgttgtatttaatgagacttatttagtgttgtaaatattgctaaatttatctataaacttagacaaaaaacttagccaaagctaaagaaatttgagtaagaaaaaaactaaaaacggcttatgatatgaaatagaggaaatataatatattaaaacaattattgaagccaaatctagccgtaatatttctaaaagttgaatctaaatattcaaagagatattagtggtcaaagtttaacatcttgactgcatgcatcataaaaacatcacttatttgtgacggttggtaagaaacacattccaggagtttaatctagtaaagttgaccaggtcaccttcatcgagatagatgcaagctcacccaatatttgttgactggaacatccatggttgattgctttgaaagaacaatagcgttcaacataatggttagagcctttttggcctaccttcaacttcaaatgcatccaagtgtccaaggatacagcaaccacatatcttcttaagccacatgactcaccaatagggccattgaagagttgaatttctttccatacatcactaacaaaacacaaggaactgagatataaattgaaaccactttgcacatctgatatgataacttgtatggtggcctctacggcccagtaaacacgtgctaaagtgatatcaactgcaccacaatcaccattaatgcgttttgtgaatggaaacgttgctgtaattagcccgatataatctattgctccatcaattaactgtaggtcatctttttcttgctctcctttttttatcctcatgtcaaactccaatagaacagagcaacacattgatatgcctcgcttggggccagtcatttcaatcagatctccctaaaacatcattaaaattatttaatagcatctcatagtaaactgaatgcaaagcttgatttcttttctagcaaagcataggcagatctcaaataacagtaacataaattataggcaaatttggccatgtgacaagatagtttgtactttgtagcatgtgctgtaggacactaaaatcattggcgcagctatggctatgccgcataattttgcaactatctgtggccactattatacatcttaccaaaacaggatagagaatctaaacaagaggtaaatttacccttgatttgagtgtttttctctacgttacctagaacagaccatgtgcgcctcatctttcctaactaaactactgtatggcctaaccagtgttcataacagtccgagacaattcaacagttcagttgacaatgaaagaagtcatacttttgatccgcaaatggatggatccagaactggtcaggcttaagtcatccatttggtctagcaaacaaattaaggtcaaaagtttctttcggtttatctctggtttaagtcacacatgcatattacgataattgccagcgtgtgttatccaaatagccacaaaactagagcgccccttggttgagccacaatttttttcttgaaagcacacgagagcattgcaccacattttattgtctcacaacaaaagatgcaaaatataggcacttttgcctaattcgaaactaatatataatttctccaataaacataagttgtccacaaagtaaattttaaagggttatgaaacccaacaaaatttatcatgcaaacaaaaaaccatcaatatgcggatcgcatataaaatcatggcatgagtgaatattttttttccagagtacaaataaaaatgaaagcataatttgcagatcctctaaggctcatgtattcacgaaacaatccaggtaagattttgaaggtggagaagatttgcgaacttaaatatttattggaaacaagaagtcgaaagggtatttatgtagtttaatgtctaagaaaattataattgtcattcaccatagcagtagacttgtctaatatcataatgacttcaaatcgaaagttcccatgtcctacttttggatatatttaatcacctccaagcatattttagaagccatatcaacagaacatgaacaaaatgtgtacctgccgcataatgatgggattatccctgctatagttgacaacataattaagcaatttatccaaatcatcccgcactgctatgtatccatataattgtatgcagtcattgtcaataggaattttagccaactttagtgagaaaatttgcatcatggcacatgctgaatgcatactgcaagtttcccaactaggtcggcaatctgttggctccgagaacatcattggctccaaccgagcttcaccaaaagatatcaactcacaaattataacaatagacaatgcttattacaaagtgataattatgctttccctattatgtgctaagtaccgaattttgtgtggaaaatatttaaagggacattgaagttgaccaaattgtcttttgttagagcatgctaaacttccatattgccaataagtagatcgtttcccatgtctgcagcataggtcaagcataggttttttctgggactattctaataaaataacatgagttcttaagtaagtacgcagaattaagagaataataagtccggcaccaccaaatacactctctaggtctaatagccacattggttaggacaagaatatgtaggcttttcttattacactttatggctacttatacatatgtggtaatgctgggaacatttcatggccataaatatttaggcatgtgtgttatttgtgaaattttagaaaaacaatgcatgtttgcatatgagtacgtaggtagagctttctaacataatcatgtatatgtgttttatgattgagaacaactaattagctattacattttaattttatatttgtaaggtgttttgtcggatcagtataatttttggagagatatgaatgatgctttagtgctttatgctgcagtacagctaaggttttgaaaactggtattcacaaaaatattggtctcctaacctccaaaaatttaaacttttgattggtaaatttaagaattgaaattttaatttacattaatatcctgccgaccagtaactggtacctaaatgacccgtcttaggcagttacataatagatggtatgtttgaaccatagatatatacataatgagcagcaggatcggctagaattacaacaatatttggatttcacctaagtggattgattgcacatacgaatgaaaacaatagtaggaaagaagaaaatataaagaaatcatattgtagttagagtaacaaatttacttggcattttggttaccagaatccatattatatttattagtactaaaacaaatcatatcaaattagaaaaagaaggagaaggttttgatcacttactctcatcgcggttagtgatacagaaatgtccttcaaaggccttatttctatatatagaaccatcacggtgtcttgaattctcaatgattgtcatcgagaacatgtcaacagcggaatggctaacaacgagcccattaattccccctctcttctctgctcgatacatctcttcagtgacagctcagtggtcgccttgggcagtgttgtacaaagatgcattggcatgaggggggaagcatctgctccgaaatggcttgccccatttgttctcccctttccctccaatgctggttgttgttgatccatacgaaaacctagtaccaaggagcacaaatgactagtgtatgggtcaaataagatactaccatatatcatcatctgctatgtggggaattcccttggaacgtcgcaggaatgcgagagaccagtaagtgcgcatggtgcgccacagcggtgttctcgccatcatgtgttgctcgcattagataagaattatccttaatgtttgaggtttgtttcagttagttcctattcattagcagattgtaatcacctatagaaggccagttcgtgatggaataaatcaagaaaaaattaatctacaaacttccttcctttcttacaccacggctccggggagggcgaggcctccccgtcgagcaccgctacaaccttcgcagcagtaatctctttctactctacaaatgaagcctgctaaataaataattgtaaacctaaataagctgatgtatcagattgagaacttaatttcttcgaatatatatcaatttcaatttttcttccggttagatttaatgtggaattaagaaaactttgtccgaatttgattttaaacactctagattcatagttcgcccaatccagattcaaaagaaaaaaaatcagcagaacgagctacagaagtagggaaacggaagaactcaccgggaagcccgttgtagatgccgccatgagtggagcatctcgctgatagggatatatagagggggaagagaagccacagcacaaggcgaaggaagatcggagaggcccggcgtcggattagggtgagagcgtccacagagacagggactccgaggagctacggctctggatccgccgcgctggtcgacctggattggatggggcttctggttaggctgcgggaatcgctccagaatcaagagctagcgcgttcctgtaggccttttgggaagaaaattttgtgagacatagggtttgttcatttacgagtaaattgcattgatagtactgtttagagcatcatcaacagattatctataattttctcctaaaaatttatttttggtttcctaaactgaaaataagaagtgaaaaaactcctctcttcaagagatagcctaaattcaatcttcaaaacttaaaagtgggcccttacgttaaactaccaagagaaaattccgttttttttctttcacgcgcagaaagatcgctatctcccacgcgtgggaacgaaggagagaggcgggattgcgtgattgggagcgactttcgcgcccgcatataaacggagcgaggaaccgggggaagggaactccaaaactcgggtagaagcgtaggagatctgttggagctgacttttggactaaaatctctcaaaattagttttgggaatcatataggtagactgttggtgatgctcggtgtaacttactgtataaacttgtgaaatgatagttttgatacatgaatttatctagttcgtgcgaacaaggaccaaaatagcttgacaatgttaattttatgaactgatattgattaggatgtgacgtgcatacgtgtagcgagtatactaagatatgtaatatttataaatttggtctctactttaattatcctttatcatggaagtgatgaattttatatatttctaacccttatatcattgctcggtttttttatctttttctacgaacactatatccattctatttttattcctagtttgcgtgcgtgcgttcatacaggtgagtgtacgtgcgttgtaagtgtttgtgtcgtactagtaattttaaaaaaatatatattttatctaaataaaaatgattcatacaattaatattatcagcaaaaccagatcaatagatttgtcaagctataaataaatgaatagtaaattgcatcgctggtacacgaggtgcaatctagttgacgaatttgtaaaatgctcgttttggtgcatgaacttatctggtgcgtgtggaggaaggaaaaaggacaccacatggctaatcttattaatgtaggggcttattaggatactatataaacatatatctaagaaggtttgctattagacatacacgggtccagatatccttagatacccggcctgatgggcacgggcatgggtgtaatttttttcccgtgagcatgcccgtccgagactcgagaacatagcgggagtagccgggtattgttttttgccagcagataatccatgcccgacccgatacatatgtatttgctaattttggtccatctcttattcctcatactataacatcccgggttttagctgtagtcctggtcacgctaatgacttggtcacactagttgagagcggtgtcgatggagccacgatgctggctaggacctataaatatgttgattgttgttctattatggatcaaataattttttgatcgtttccttgtcatttatttatcaagtcgtccatatccatatggatcattgatttatttatagttagagtaaacctggtgaggagtgggataatttagttttgtagcgtagattagttgtcacgaggtacacatgtgcacagtagaaatcacaattctttatttacaatttaccacgacaggtctgcatacatatatgcatataattgtacaatagaaatcttatacagcatgcatcacatatattgtgcatatacatggtgcttatagattatcataaactgaatcatctcagtcaaagattcaataattatttatttttcagaaaaactcttaagctctagggcaattgcatatcagtccctaaatttgtagtaatttacaattttaccatacttgagggattcaagtgcaaaagatcaaacacatcagactaccaattctccaataattagggaaattaacaaataggtctggttattccaccgaacaagctgtttacacctaaatttgatacctaggattaaaatagaaaatattaccaaaatttgaaagtctaccggtttcctccgaagtgggccggtctaaccgctgtgtgttgggcggtcagaccgccggttgagggccggtcagaccggcggtgtgtggccggtctgaccggcaggtccgagtccgactctgtttcgtcgggtctcgaagtttccttgctcgggaaggcatgtttcgggtttcctttggtttctaccccgagttggacgtggaggagggcctgtagagggcaagaccaacccctatataagggacatggccggttcattgtaaaaatcaatctactatcaatcaatcgaatcgtttttcatattgcttttagtttttctcttagtttgtccatctttacaaaacccatctaggtttagctctttgctagatcgaggtggttggcgactctaggatcaccgcaaggcttaaagtgctgcgatcgtgcttgtcaacttgtcaaaaaagttgccaacacaagccatgttgaggtgtcacaggtacagaatgggaatagccatgcaagcaggtgaatcaccagtacaagatccaccagggataaaataatttgtgtgaatcatttccaacccaagtctcgttttggtcgtgcaaaacaacacaagcagcagctgcggcagtagtagttacaaccatagaaccaagctataggaaaatcagctagagtgttagctccacccagagagaaatagctcaactgaagtccagctcaaaccaatacatgaaccaacagtagtagtaaccatggccaagcaatcagagagcggtgaaccaaatctaaaggaaaagtagaggtgttcagttcttggatgaactccaactataggaggagatgaaacttaggtcaagaagcaagatggagcgaaaaatcaagcaagaggatcagtctcaagaggaggaagagaatcaccagtagcagatcaagaaagatgtcaggaagtagtcaagcattaccagtagggtaagagccaaggaggagaattacctgagttccaagtagagtagggggttcagttcaagaaggggaacaatcaaccaagctcaaggtggagaagctcagttctagcaaaatcaccttagatctaaaagagcagcagtagaagagaagacttggatttctgaaggaggagctgaaccacacatttttcaatcactgtagaatcatcagaggtaaccaaaaactaaaataggggaggagagtagatcctgcatttatagtaacagcatttgttagagctagagtttcatgcagatatataccatccatcctgacctaaaaccttagcaattctaaatgaataaaagtaacaaaagttgatgataaagttaaagataagttcatgtctttaaatcctgacatatataaattatcatagaagaaatctgaatagtaacaataagcgtctgtagctataattttttaataaaatcaactagtgttcatgacataaattatttaggaatagagcatatatagaagaaccaaatcatgcatgtaacttataagctttcagattctagtcatctaaacagggcataacattgacatgtgcatatttaattagaattagttataacctaaacaaatcagactctagttccaataatactttagagaaataagtagtttatattagtatccagtagaacatgtagcagcatgttcagtacaagaattattctgaatatatggtataataacagagtaggtatatttacttataacagggtagttagagtaaatgatatttagactagggcatgcatctattagctttcatcagtgtagttttgtacaaattttatcccacagtgaactgaaactgtttcaaaaatcaaccaatgtatttagttcttcatataagtaataccgaatctgcagaattaatatggatagcaagtgtaaacgtacatatttagtttaggtgcagatacatatgcaggaatctacgagtctttatcacaagtcctagaagaacatatatcagttttagaacgatggtaggtgatcaacataaccttgctaagaccaataccatagaacacaattaattacaagttacttaagtaatcagtacattttgatatcaaaatcaagattcataatttttttttgtcatttgatcactttagttatattactatgatgcatttggtatacaggaattcatattaattatctgaattactactcagcacaaggacataaggatctgattctctagtgcagtagcatgtaaaaaaaattcaatatcttgataaccattgcataagtatataaaaggatcaatcctgttattatgatattaatatctgtactaaaaaaaataaatacacatccttgattcatttgagcatgcatccatgtattcatccatggcatatagtcatcatccaactatagtaaatcaattgatttagaaccctagagccagcagtataatcctgagtataacactatctagttggtcattaggactagttcaagaataaaaattcacagcatgttaccacacagaagaacaccattcaaatcacattacagaagtaggtagagaaggggatcagagaggaggagcttggggagacacagctggtgcgagccatgcttcactcaagggcgctggggttggggaattcccaacctgggattttcggttggcgtcgtcgtcgttgggagcagcagccgacgacggcatcgatgggagaggagctaggactgcaaacattggggcttcgctgttttgacactccgagtggatgataaatgggtccatctgtgtctataaaaatgtgggtccagtgtcattatagcaaaagttaatgtttgcagtgtcataattgtaaatcccccccgatgaataaggttgggcatggatgaccaaggagagaagctgtatagagagatttggacggggaatcaggggaagagaggaaagaaggtgtttacccccaaatttggcaccaagggataaaatagggaaaattaccagtttggaagtctgccggtttttctctggttgggccggtttgaccgccatgtataggccggtcagaccggcagtgtgtggccggtctgaccggcagagtctgagtctgggactgtttcatcgggtctcgaggtttccttactcgggaaggcatgtttcgggtttcctttggattctatccctagttggacgtggaggagggcctgtagagggcaagaccaacccctatataagggacatggccggttcattctacaaacaatcaatcgaatcgtttttcatattgcttttagttttttgcttagtttgtccatctttgtcgatttgcgctgtaaatcgtccgccgccgctgcgaaagtgcgacacctctttttaagtttgtcctgaaaaccttccgtttttcccacgagatgggtagttatctatcgttctatttagaattggctctgcaagccggtttagttatcaaaacccatcttgatttagctttgactagattgaggtggttggcgactctactatcaccgcaaagctttaggtgctgtgatcatgtttgtcaacttgtcacaaaaagttgccaacacgattttttgtgactccactggggaaatctgctcaacgtcatctcagctttgacgtcgccataacaaagcctccatcaactaaggcggaggtggaaccatccaatgtcataccaatcacattgaaggagcttgatgagggagcactcaaggccatggaggaacatctcaaggcgtatacccaggaaatgttgatgaagacgtgcactaggacccgtcaaggtgtggttctcaagccgggatggttgcctaaacctaatttcgatgtggtaagtactgaagaggtatcaacttctatccaacaacaaatagcgagtacaatagattcatccattgctactttaaatactaaattagatgcatctattgaatctcgttttgatgattatataaggaacaaactcggttctgtcatagccgattttgtattcaaagataaagcctctaccagtactagcaagcctcctgtagatcaaatatatagtaaaaccgatggagcgaatatgcaaacaacctgcgaagggtgggctacgcacacagccgattcaaccgggccaacggctggtcagaccgggttttatcctggcggtcagaccagtctgaccgcgcctctggacgccggtcagactgggtcctagaccggtcagaccggcgcaattattcctatacagggggtagatccaatgacaaacaatgggtttttataccatattccagcacctaatccccccgtatctactgttagtccccaaattcccccacatatccctaatgcttacaacgatcctactaggggatgtcctcccgatactagatatagctaatataattatattgcgccgcaaacacaacctattagaccaccaaacccaccaccaaaccagcataggcttgagaatatagaggaattaattagtggtatcattagggataaattcgggattgaagctgggaatcctgctaaggtttaccaaaagcctcctcctgattactatgacaatatcctatatcctcatgggtatagagttcccaaatttaccaaatttagtggtgaggatagtaggaccacgtgggagcatgtaggtcaattcttagcgcaatgtggagaggctagtagttccgatactttttaattgcgcttgttttctttttctttgtccggtactgcttttacatggtttagttctttaccggtaaattctattcatacttggcctcaattagagcaaagattttatgattatttctataagggtgaaactgaacttaggctaagtgatttgacatcggttaggcaaaaatacaatgaatctgtcattgattatggtaagggatttagggatgttagaaaccgatgttatagcttgaatataactgatagagatttggctgatcttgcttttaatggtttaattgctcctattaaggaaagattagttggccaacaatttcttgatgttagtcaactcatggaaaaagctccggctcaggaaagccgaattaaagatagtaagaaatttgttagatcatatgttaatttgattgattaccctgaagctagtgattctaataatgagggtgatcatgatatgtatgttgccgagtggtcatgaactaataaaaataagccttttgtttgttctaatttaatgccgactccttgtaaagatcgacaaagtgagattaagtatagctttgatgtggccaaatgtgataagatttttgattatcttttacaagaaaaacaaattgattctcgttctcattctacaatgattgctatgtgtttcgacgataggttcaatcggccatagatgaagaacgattgaaattttccgatggttccaagatgaagcttgatcatgatgcttttccggcgaatacaattaatttcaatgataagaaggtgttgatttggccgaagcaagccgaatctactaaggggaaaggaatggtcagtgaagagcctaggccaaagatgattgtgccaaagaatccagaagttggtgtttggaaggagaataggagtgaggcttcaagttccaaagctcctaagaagactaagatgaccttcattatgcttttgaacaagtatgagaagcaaggtggtgagaaaactcgcaataaaggaaagagaccaagatcatctcctagggagcgatttggtcattcaccaagacgttcggaatcacctacatatcatcgttctcaagacatgtcatgggggccttatccaatgccgccgccgggttatccttttccttactacgtgccatggggggcaataccgccaatgttcaatcatatgcctccaatgtaatacaaccaaggatggggaggaccaaggaggccagctcgtgagcgtttatcttcaccaaataatggttagttttatgctaaaaatcaggtcaatgaaggaaagagggaaggaaagcgcatcaaggtggagacaaggacttcagaagtgattactatcaaagtggggtctcatgatgtgctaataccttctggacatgaggttggagagtcttcaagcaacaaattcgaagccagaaccaactcatcgcagtcagccggtctgaccaacctcttaggccggtctgactgggccttcaggccggtctgaccgcctgtcgcaggccggtctgaccgggccttctggccggtctgaccgggcttcagcgccggtttgatgggagaatttcaaagggtagttcgggggtttcatcgtcttcgagtaaaatcaaaagtgggcattatttaccttctggaacagagccgaaactaaggtggatgcctaaggatttgacagctgctcaaaagaggaggttgcaacgtcttcaggcccaagaattaagagagagagagagaggccgaagagcaaagagatagaaggttcaatgagttgcgaccaccgcctacaaagatgtggaggcgtaagtccatagatattgaagaattggttgttgtgcaaaaggaggaggaagaacaatcggttgatgaatcatatccaaaggaagacatggatgtcaacatgatgtgtatgttgcctatggatttttgtgctatggatgaagccgaagttgctcaattttcactaggtcctaaagatgcggtttttgagaagcccgatgagtcaaactgtcatatgaagcctatttatctcaaaggtcatattgatgggaagccggtctctaggatgttggtggatggaggtgccgccgtgaatttgatgccgtactcgttgttcaagaagttggggcgtggagatgatgagctaaagaagaccaacggaggcgaaaaggtatcttttcggtggagcttatcgtgggaaacaagacgtccaaccgctttcttcatcgtctatgtgcaaggtaactacaatgttattttgggtcgttgttggatccatgccaattattgtgcgccttctaccttggatcaatgtttaattcaatgggacgacgatgatgttgagattgttcaagcggatacatcggccgaggttgcaatggccgatgcaacatttgagtggcgtcacggtaatattcaatgcttatcggggatggatctttctagctatgatttcattagtgtttctgatggcaaatttgtacctatttctgtaaagccggctaacatagcacgacaaggccatatcactttatgtaatgagtaaagaagctaatttagagtggttgcaaaaaagggtgcaagaatatcgatctacaaagaacgatattggtgaaactattgaagattttgacgaagtagaaaaggttggtcaagggtttacatcggccgatccattggaggaaatagacataggtgatggaactaagccaaggccgacttttgtaaacaaaaacatgacagccgattataaggttaaaataatcgagctacttaaggagtatgttgattgcttcgaatgagagtatcatgagatgccaggtcttagccgtggtcttgtcgaacatcagcttccaattaaaccgggttttaggccttataaacaagcaccttatcgtttcaatcctttgttatatgaccgggtcaaggaggagatttatcggttattgaaagcggggtttattaggccatgtcgttatgcggagtgggtatctagtatagtcccggtggagaagaaagggagtggtaagattagagtttgcatagactttagagatttaaataaagctactccaaaagatgaatatcctatgcctatagctgacataatgattaatgatacctcgggtcatcaggtgattagctttttggatggtaatgccggctacaatcaaatctttatggcgtaggaggatatgtacaagacggcttttaggtgcccgggatttgttggtttatttcagtgggtggttatgacttttggattaaagaacgcctgtgcaacatatcaaagggtaatgaatttgattttccatgattttctaggtatcatcttagaagtctatattgatgatattgttgtcaaatcggatggtatggagggacatatagccgatttgaagttagcttttgaaaggatgcgccggtatggtttgaacgtgaacctactcatgtgtgcttttggtatgtcggcagggaggatcttaaggtttatggtgcatgagagaggagttgagattgatcctaagaagatagaaaagattcgtgatttcaaagcgccgacatgcaagaaagaggtgcaaaagttactaggtaaggtgaattatttgaggagatttatatctaacctagctggtaaaatcgatgcttttgtccctatacttcgcttgaaaaaagaagccaattttacttgggggcaaaacaacaagaggcgtttgaggaattgaaaaggtatttgtctactccacccgtggtgcgggcgcctaaagccggaataccgtttcggttatatattgcctccgaagacaaagtcattggtgctgttttgacacaagaggaagatggtaaggaatatatcattacatatccgtcttttgggactcggattcggtgacatcgctatggcatggcacagtgtgacattggagcaatctggagcgttgaaatctgatcgaacggtccgctgcgccggcccacctgcagcctccattttcacccccaagcgctccgtttcctgccgcccaatgcccaatcccgcggctcgcccaaatcccacacgcgcgctccagtcctgccgtcccgcacgcgcccggtcctgcggaggtcccaatcccgcaccggagcagggctgccggcagagttccaatcccgcgaaggtcccaatcccgcttggagcagggttgccggcgccggggaagtgcagcacgccaaccagccgaggccggggccagagcgcctgccccgccgtcgccaccggataggtgggaggcaggcgtgcccctcgccgtgattggggaggtaggccggccgccgtgaggccgggggccgaggcccctgccctgccgccaagatttcggggaggagggctgccagagtgagccaagcatctgcagaggaggattgcaagtgagtgttgtcacatttgacacaacttttggcacaaacaaagaatataggccattcggtgtttttcttgggctcaatcagtttagagaaaccactatttttggtgctgcacttctatttgatgaaacagaagcatcatttacatggttgtttgagacttttctacctgcacataatggaaagcaacctaaaacaatttacacggatcaagatgcagcaataggaaaagccataaagatagtattcacagaatcatatcatggtctctgcacctttcacataatgcagaatgctgtgaagcatttatctccagtgaagggtaaagaggaagatgaaggtgaagaggaagacgaaggtgaagaggaatcgcatgttctctctgattttagtgcttgtatgtttggccatgaagatgaggcatcatttgaagaggcatttcagattatgagatccaaagttcataagcaaacatggttagatagcatttacaaggtgaaagagaaatgggctgaatgttatatgagagatgtcttaatgctatctgtgatgtctgaatgctccaagtttctatatggctgtttatcaacttctatatggctgtttatctctttctgtgttgtctcaatccatccaccaattatggggacatgctgtcaaatttttcagaaaataacatcacacaagttactgatttattcatccattgattcattcaaattacagcataggtcatacaaccaaaccaatctctcaattttcccaggtgttgctgctcacaaaaaaattacagaatcattctcccagcagcaatgacaacttccttatcaaccacaatggttaacacagtgcaacctcaacaaattattgtttcaggacaatgcacagcctaaggtaatcaggttcaggtacaccatgaagcagaaggacaaacagctaaactactgctgctgcaatcttggagatagagaacaaacacctaaacaacaattttggaaaacaaatagctaaacagcatgaaatcccatcgcctccatcggcaccccgacggccggctgcctccatcgccaaggatgacggtggcagggcagggccccggccctggcctcgcacggctgccgcctggtcccctccccacttgcggcggagcggcgccttgccggctcccatctagttcgcggcggcggccaaacgcgggcgagggaggcgaagcgacgacacggtcacccggtcccctccccactcgcggcggcacgacagcctggcgtctctccggcctggcgcggtggcgggctgacgtgggcacgggagacgaagtgacaaggcggctgccttgctctccgctggtcgccgtctgggacctctacgccggcagccctgctcccagctcgcgcggcggtggccgcctccctattcgcggcgacggcccggcgtccggtgcgggcgcgtgcggggcggcgggagtggagcgtgtggattgaggcgagccgcgggattggggcgtcgggcggcaggaacggagatcttgggttgaaaacggaggctgcaggtgggctggcgcagcggaccgttcgatcagatttcaacgctccagatttctccaatgtcacaccgtgccatgccatagcgatgttactgaatccgagtcccgtcttttggatgctgaaatgtggtatgtctttatagagagactttgtttatgtctatactatgcttgtaccaaattgcggcactatttgttatctagtatatgcatagttgcttgtcaagccgatgttattagacatatgttgcaaaggccaattctaagtgggtgaattggcaagtgggcatatgttttgattgaatatgatttggcttatgaaccgttgaaatctatgaaaggccaaattgtagtacattttatagtagaccatcatgtcgatattgcttatgatgaagagatttgcttagttgaagttataccttggaagatttattttgatggttcttcttgcaaatagggtcaagttataggtgtagttttattttcacctaatggcatgtgttatgaggcatcggttcgtttgaaatattattatacaaataatcaagctgagtatgatgctttattattcggcttacaagtgatggagatgattggagccaaacacatagaagcatttggtgattcggaattggtggtgcaacaagttgccggggcttacaaatgcttgtacggatcattaaataggtatcttgatcaatgcttggatattattgccaatttatataattttgctattagacatgttgctaggcgtgataattctagagcaaatgatttagtgatgaactctgagctccactcgagacactcaaggctgttgttggcccgatctttcggtgagttgtagataactacgatttgagagaaacgttgacgacctgactacaaccgtacacaacgttgttgtgttgtgccttagcgatcgatacacctctccgtgggttgttgatcttgccggtgcagatcaaccttattcctgcaaggaaatcgaataaacaagcaagaacaagataaaagcaatctgaattgcagataggaattgaatacaaatgataagttgggattccgtaacaggcaaaccagcgatctaaccgatcacgggattacacggcaaagtatcaaagctaaactttaatctaaacaaaacccaagaaatcttgaaggggtacctagctatttatggaggtgggaggatgaccaaggggaccctagggtcgtgctccaactgattggggcgcaccccacatgggccccacttaggccgggtcccaaacgaagttacaagcaatttggcccattataggtgacgtagcaccttatttctgcaatagcagcccactgagaaggaatttggcaatgaggttggatccgttggaaagatgactacgtgagctttccatcaagtactcatggacccaaaacggagctcgtatgcacatttggcggccatttgaattcaatacagtagcaggtggctgaattggattccaataattggaggacttgatcttgttatcatcttgttcatccatgatgtgagcaatggttgtatcaatggtagccatggtcacatcatcctccccttctccttcaaatcatcgagctcacaaaaatcatcaaactgaacatagcccgaattatttaaagaagatgtcaattctcgttcctctatttcattagcaatgtgaacgacatgcttaaaatcggcacacaaagaaacactagaaacaacatgtaagtgaagcattatcacacgactcttctttatcacaaggaacaacaagtaaatcaacttgtgacaaaggcatctcagcaattggttccactaatggctgctctactatagcatgaaaaatagacatgtgtagcttagcttgagaatactcacatttatttatctcagtaccatttaatttaccttgcaaactttcttcagacaccacaggtgcttcatcctctttcttctcaagtacaccattctccctcttttgttgaatgtgatgaattacctgcaaaatgttagtaacaggagagacaaaagattgctcctccaatgtttgcacatcatcattgcatcaggatataggagattcagaaataggagataaatcacattgttcatactttctcgcatttgatatgatctgactctcaatgctacgagcaaacatgaataggtgtccaatatgattatatttcacattagcaagcataacctgaacttcagaactaagccctttgaaaaatctacgcattgtgttttcattgcattcttttagaccactgtagataatgcaaactttgaattcatgaatgtactctcaccttgtgtttcagatgttctaatttctcatgaagaagacatttgtaataagaacttacaaaatgttttcttatcaaggttttgcattcatcccaagtttcaggtttgttactcacataactccaccaaaagagagcaggagaggtaaacttattactagcagccttaatcatttgagcatcagaaaaatcatatttatcaaattcattgtctactgctagctcccaatcaatataagcaacataatcgtatttaccattgtagaatggtaacttagattcaactcatgcaaaattatagtcaggtacctcatatgcatcttgtcgagaagttggcatctctcgtcgatggtgaagaagccgatgttgagcatgaccatctcgtatccccttgcgcaatcctggcatggttaatagcaaacaagaaacatacacaagaatatgcacgctcctatcaactactaggtagtggaagctccgatatcacacacactcaagctttttaccaagttcttaccaaagcaagcggaatggtgacgtacaccaactcggccaagcatcccaatggagtttggatgtatcgataccttggcaaacacttgctatacggctgcaatcaaatatgtggagctctgggtaggcttaaaatgtagcaaaggaatagcaaatgctcaaatcagataatacaaaattgaataatcattcaaagtcagtaccgtactggtcctaggctagaacgtactagagacgcgatcctagacacagacgataccacaagatagctccagaaacaactcaagcacactctgatatactaaagcaaactcaaatataagagctcatttttctcttttccatctttcttctttcttttttttcttttatttttcttttcttttatggtgcggcttttcatttctttttttatgcaccttcctgccttttttttctttctttttttgattttttttaccaaaaacagactcaaggacctcaatgtgatgttacagggactcaaacgtaaatataaaaatttacaaggactcaaatgcaaaagtccgaacccaaaattaaaattatacaaaaatggaatgctgaatttatactggttccatttttttcaaacggatctccaatccgacaatcgaaaacttgtcaccaagctctctagcaactcacggtgtagattgaaatcgagaggagagtggggagtcactcggcttgtagaggtggtgtgaagccgcacgcgagggggtgggaatcggctataaatttggaaatcacgcatggaaggaaacaaagtccagaaaccgatctgctatcctttctttctccttaaccgcacgcaacagcgatatgctatccttcctttctccttaaccgcgcgcaacagatcctcttccttgtgtgaacagaacaagcacaggcgaatgcagacggcaaaccccagatgcaactcagcaactctaagaccgactgataaaaacttctgaaaactagaaaaatagaaccctggcagcatggcggttccattttcgtaggtcccaacgataacaagtacacgacgacgacgacgacagtggtacaaaacgtgaccagaacctgaaactctaaacgaactaaacgctaagaccagcaacatgactcgacaatgcaacgcaaaactcaacaaagcaaaaactgaatgaacaatgcaatggcacaaatatggctaggtataggatgcaatttttttgtatggctattttctggtagtagtgttaacgaccaaatttgagaacactgagcaaaaaaaagctctgataccacctgatgaaccctgagctccactcgagagactcaaggctgttgttggcccgatctttcggtgagttgtagataactacgatttgagagaaacgttgacgacccaactacaaccgtactagacgttgttgtgttgcgccttagcgatcgatacacctatctgtgggttgttgatcttgccagtgcagatcaaccttattcctacaagcaaatcaaagaaacaagcaagaataagataaaagcaatctgaattgcatataggaattgaatacaaatgataagttgggattccgtaacgggcaaactggcgatctaaccgatcacgggattacacggcaaagtagcgaagctaaactttaatctaaacaaaacctaagaaacccagaatgggtacctagctatttatggaggtaggaggacaaccaaggggaccctagggtcatgctccacctggttggggcacaccccacatgggccccacttggcccattataggtgacgcaacaccttgtttctgcaattgcagcccactaagaaggaatttggcaatgagggtagatccgttggaaagacgactccgtgagctttctatcaagtactcatggacccaaaacggagctcgtatgcacatttggcggccatttgaattcagcacagtagcaggtggccgaattggattccaataattggaggacttgatcttgttatcatcttgtttatccatgatgtgagcaatggttttatcaatgatagccatggtcacatcatttagcatggcaagcatatggttataatgtgaagaagggagtattttttatattagaagaaccggtgcttgatttcaaacctttgggtgaaattggcaaaaatgcagaccgggggcggtctaacctgcgttgcacggctggtctgaccggtgactaggggtggtctgaccggccgtatgccgccggtctgaccggccaacccgggcggtctgaccggccgtatgccgccggtctgaccgattctagacagaaggttggggggcacgtcccgattgattcaaaggccgaactaattgtaatttcggacatttgtgcccaggatacagaagaggattggagaattcctttgattaaatatttgaaagaccctacacttaaggttgatcggaagatttggcggcaaatgtttaaatatacattgcttgatgaggatttatatcgccgaaatatagatggggtgcagttgaagtgcttagataatgatcaatctaaagtggctatgggagaggtgcatgaaggaatttatggaactcatcaatcggcccataagatgaattggttgcttagaagagcggggttctattggccgaggatgattgaagattgtttcaaatattataggggatgtgaggcttgtcaacggttcggcaatgttcaattggtgcctgccgccgtgtgaatcctactatcaaaccatggccgttccgaggttgggctatggatttcattggtcaaatttatccttcgtcatcaaaggggcataggttcgttgtagttgcaacggattacttcaccaagtgggcccaagccgtgccgctcaagaatatgattcatacggaggtaattgtctttattttgaagcttattatccatagattcggtatcccgcaaacattgactacgaatcaaggagcttcttttatgtctaaggaagtgaagagttttgccgaattttatggtataacattgttgagttcttctccttactacgctcaggctaatggacaagccgagtcgagtaacaagacgttgtcgaagatagtcaaaaagaagattgaggaacacccaaagaagtggcatgaagtgctttctgaagcattgtgggcgcataggatatctaaacatggtgccactaaagtcactccttttgaattggtttatagtcaagaagctgttttgccggttaaggtaaatcttggctctcttcggtatatcaagcaagatgatttatcaagtgaagattacaagaatttgatgggagacaatcttgatgaagtcatcgacaagcgtttgaaggctttggaagagatagagaaagagaagaagaggatggccaaggcatacaacaaaagggtgaaagcaaagttgtttcaagttggagaattggtttggaagacaattttgcctttgggtactcgatccagggagtttggtaagtggtctcctagttgggagggtccttttcgagtatgcgacattgttcgagggaacacatatttttagagacacttcaagcagagcgttttcagcgagcaatcaacagaaaatacttgaagaaatacttcccgagtgtttggcaagacacttaggaggttctatggccagtaattggattatcaccctaagaccaaaacatgttctatggttttagattcacgccattcaccaaaacatgttctatggttttagattcacacccaaattcggcacccagggataaaatatggaaaattgccaaagtttggatgtctgacggttttcctctagttggaccggtctgactgcggtgtataggccggtctgaccgccgaaagtgggccggtcagaccggcggtgtgtggccagtctgacctgtagagtccgagtccgggactgtttcatcgggtctcaaggtttgtgggcccccggctttacacaccagaaaccccatgtgtcttacaataccatttcctagatcagtagatggtacacatatggcacagttgtatatcacaagctgacatcgttatatagtttgaactatacattaatagtacaagggtagcccaaatgggatccaaatagaccgagcatggtcatgtactttgcaaaataccaaaagaagtagatgagatagcggaagcgaagcagcggcggtccaacgtactccacaagcatcgactggtgaacctaggtcccgactccaccggcttcgatatctcttcatcaacattgttcccgtatggtcgactccaactcctttctaaaagatttagttaagcaagggtgagtaccaaccgtactcagcaagccaccactacagaatgcatttagtgcacacagaggttcaaggatggcttggtttatttgcataaagcaagatttcataaatcatttcacaaacctatgactgagcagttttaactgaaaacaacgataagttgaagttatcattaatccgcaagggttcatccaccttccccaagcctcgtttggtccggtttaccctcgcatctagttttccatattcccaacatcatcatcatgaccttcctgcccatcgggcaagatcacaccacttaatctaagcaagattaaaatctatgagactagtcaagtgtagtacaagtcccggcgctcaataaccgcgagcacggctattcgaatatatttgatttactcacactgcagtggatgtacgcttttaatcccacactccgcgacttgcccaacacatgagcctagtcccaacacatgagactttccacgatccggtatttcagtcaccctcgcgtttcggcacccgctccaaggactatgtacctccattgcacccttggcacaacacaccacctcaagccggcggtgaggagagtcctggcgcccctgggatcacaatgggttatattacatataggttaggtccattttagatttctgatgtcataaaccaatccacatcccttcaccttatctcacatcacacttcagaaccaccatgacaggggtgccgtgctatagctgccttcatagctaagtcttcaccagttattatgtttgtgggctctacaccttccatagcctctagaaatgcttgaaacaaccatacaaaggtttctgtcttttcattccttagaaatccacaacccagctaaatatccaaaaaaaaaatacacataaggaagtcatcatagtttggaagtaagttactacaatttgcatagtctgtacagtttgtttttgctggaagtaaatcagtacaattttgaactatagaacagacactaaaagatgtaacttgtaaacttagttacttttttttcttttttttagaaaaaaatgtaacttcacatgctactggaagtaacttttatcaggacttgatgtaactcaatgaatccaacaactaacttaaggtgtactataatgtacaaagttattacagattttttagatttactttttttgcaaaacaaggagtacctgaattgattgcccatgtctgtttatcccaatgaatggtgcacaaggcatgttatacatgttcgtcatgtatgtgcagtcaaacgagatgcaatctttgtagtctttgtaggcatttcttgctgctccatcaacccaaaatatgttctgcaccctgtcttccttattaagttgaatcttgtagaagaaatttgggtcatcctttttgatttcctcgaagtgagcaattgtttgaggcatatctctacacctatacttgctccccatctttgacttgaaattgcttatgtcttttctagtgtagggtacattcctagcccctccatacaattctgacatcaattgcataattctaccagttgagagattaactccgtgcaacattgtgatgaaatctttttcctttttcggtattgctctatgtgaccttagaaatttcttaagtgaaaactttctaaccagaggatgtgtgtgttcttcaacaaactgaattacttcccacctagttcctttcctcttcactgtcatccttactttgcaggcagcctgtcttgttttacttcttttccttttctttggagggcacgcttgtcacgcccgaaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagcgaagctccggctccactcccacaggcagctcaactggggtataagccaaacgtcttctccttctggattctttttctttaactgaggttgattgattagtgcaagaatgagcatatgacatactcaacaagccacacagcaaatatgcaagtgcacgaggataccaaaggatggcataatataggctcatttgcaaaagcagcatttagcaaaacatttaagagaagtaaaacagtggagtaattaatcagaaattttaatcaacactgaacagcacacccatgctgcacaggcccaaccatcctgaacaaccatacccggctgtacagatctaatctccaaaccaggagctaagcaaattattaccaggtataacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaagtaccaccacggcactgcaaagggggaaatcgtgacaataccctttgcacaacacaactcaaaacagtgcaccgttcctggatcataatcaccccctcaaaaaccagaggcatggactccccagcgacccccgtgggcttatctccgccacttctcagtctggtgctccgcaatgaatcatgctatacaaaagataaagccgttgcccacgctggcttgtggttggcacggttaaagtttcacaacagtagctcgcgaaccggtccttaattttcatgagcacgactctcaaaaccatgtgctcacaacccaccattatcaagttttagttggcaagtaattaattaaccaatcacgattaaccatcgtgaactatcattaagccatcattaaataataatgcgtcataagttatcccaatagtgtgctaatgtttctaagcatggctaagcaatcacatctaatatctagctgaaccaatatgtaaagctcaactagtcaagttataaaaacccaaggtatcaaggaataaagtaatcaatgcaaacagcccataacaaaggaatagattcactccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccgacgcactcgcgaaccttcgcaacgacggaaacgacaagctaacacgcaaaacaaggaaaagactaataaaaaccaaataaacaatacataaaaagtaaacaaacatgtagatcataattttagatgaattatgagtcttgaacggcctcattctgacttcaaatgaatttattatgaattttacaagattaaatctatttaaagcccatttaaaaagaattaaataaatttaattcaatttatggacaattttaaaatgtagatctttattttatataacttttgcaacttgaaccacattaaactgagttacaatgaattagttatgtatttttaaagattaaaccggattaaagcatttatatggattttaattgaattatgacgcaataatgaattatttttgaaaagaaaaagaggattattgcgtcagcggctagggtttgcggtggaccgggtgcacggcggcggttcacgagaacggacggccgagatcgatccatccaaaacggacggccgagatcgatcggtccacgaccgggccaccgggaacggcaacgatgacgtcagcaccggcggcggctcggcaacgcatgctcgccggcgaacgacggcgcggcgacgcgaacggagggcaccaggacgatgcgggcattgcggcaaactcaccggtgaccaatgaagcggcggaggagcaacggacggcgccggcgacgaggaagaaacggcggcggtcttcgggtcgacggtgacggcggtgctccggcggtcttcggcggcggcgaagcggcggacgaggacggcgacgacttggcgaccacgatggcgacctccccgagcgacgacgacgaccggaacggcggcggcgcacggctggagcgacggcgacgacggcggcacaagatctcacggcgctagggcgcttccgacggcgagagacgaaggcgagggtggcgacgggtagaggagacacaggggatccttttataggggcaaggaggcggcggcgaaggcccacggctgccggcgacgagaaggaaaggtcggggtttggaggaaagagaccgatccgaatcgacctcgaatccacgaatttccaaacgattttagccggtgattccaaaagagaaaaggtggaggagatcgagaagatcatttcccctctatcaatttcaccggagaaggaaaggatcgagcggattggaaagcggcagcagcgcgactcggctagggttccgggcagcggcggcggcgcgaggaagacgaacctgacaggtgggacccacctgtcagcgacagagagagagaggagagcggcagctcggcggactgggccgacttgggccgagggagagagagaagagaggttttgggccgactttcggcccaaagccaaaagaagacttttaaaaacctttttcaatttacattattcatgaaatgcaattccatttattaaaaatacttccttggctcaaataaatcccagaaaaatctaggaattatagaattaagcaaagtatttaacaaaattttatctagcccaattttatattgagatttaacaaattaaaattagatcttctcttttaggcttttaaaatcatttctaataattccttttaaacaaaaatttataatttaaggatttttaaacaagaaaagcacttaacaattataattaatgataaaataattattgaactgttctttgtatcatttaggaattgaggtctgaaaaatccgagaaaattttagagagttgacttaatcatggagaatttaataaaaattaaatccatccatgctttatatttaggaaattttatttcccacatttaacttcacttgtaaattaaagaacatttaatataaattctattaataatttattaaataatttataaatcctgaaacaaaaatcaggatgtgataacgcttcacccgttttttcttctggaccacatttgttgcaaacaaacattactttgtcacgttctccatctttggctgacttccttgaagtgttgattttgattgaaaatccaacgcactttgcatacctgttatagtgagcccttgcttcctcctctgagttgaaagtcaaggtgaggtatggcacttgtgtgctgcacaaaaaatcctgtgatggcgctgactgtgcttctgaatcatctgtgccagagtgttcacttgaaattgtgttggcagtagcagttgttgcgccagttgcaacactagtatgcattgtgtctgcatgatctgacatttcttcaaatagttgcatctcatcattggcttcaaatacttgcatctgatcattggttgcaaatacctgcatctcatcattggcttcaaatacttgcatctgatcattggttgcaaatacttgcatctcatcattggctacattgtgtgctcgtaaacttccagcatcatcagcagtatacatagtttcaaagtcaaaagtgttgtccaaatttatagtaggaatctccatgctagtgtcagttggatttacagggaattatgtttcacttctgtcttcatcatcaattagtaaatgatgtagtggatgttcattttcaccagaaactaattccgggatactgttgaggtcaaaatccatttttgctgcatgtgtttcagactattagtaagtttatacagagcattcattgaggtaattcagtaattggggggagaagtaacttgcacatcacatgaaagtaaagcttttatttttttcagaggagtaattttgtcagacaattacatctgtggtatagaaaattacttgcatgttttagagggagtaacatttatatgttttgaagtaagccagtacagtttggaagtaagttacatgcaacaggatagcaactcttataactggactcgatgtaattaaataacctatacaaacatttctgtcttttttagatgctttctaggaagcaattttgtcaaattgagaccagtggctatactaattgaaagtgcatctaggcccctaatgattttgatgattgattacaatgcgattagagaggactaacatttttattcaagcaaatgtgaaggttgttaagtcctcaacatgttgtaatacaatgcatatcccgtgaatgcgacatcgcgatgcaatgcggcaatgatcaaatggtatattgtatctttttcctcgcattgtgtcgtaggaaagccgtactattaagggggatgatgcatagacatataaggagtgatgcgtgtgctcaaaatcaatttttcttcgaagcatttctcttttggagtgttctggaaatttttggaaggtccgaaaatagttttcggaagttccgaaaatagttttcggaagttccgaaaatacacagaattgtgtttgagtgttctagaaattttcagaagtttcgaaaatagttttcggaagttccgaaaatacacagaaccgtgtttgagcgttctggaaattttcggaagttccaaaaatcattttcggaagttccgaaaatacacagaaccgtttgagagctttctggaaattttcagaagttccgaaaatgatttttggaagtttcgaaaatacacagaagcgttctggaaattttcggaagtactttcggaagtattttcggaagttccgaaaatgggcgttgacttcgatttttctcagatctggaattttcggaagttccgaaaattgtttcggaagttccgaaaatcccttttattgcactccaacgggcagatcttgtgagggctgctggttccattccaattatttgtgcccttggcttgctctctctctctctctctcattcatttgagccttgcttcctcgattcatctctccacccgtgtttgatttggatttggtgtgtgtgtgagagtgtggattcgagcttgtgtgggtgcttcttgtggtctttgtgaagatttgtgagcacttgcatcatctccgggagttctttgcatcatcttttactcttggaggttgaggactcctagacggctaggtgtcactcccgagccatcgatctacttgtggttggccgggagaagtttgtgaaggccggatctcgcctccgcaagagaagagatacctcttagtgaaaggagaagtgcttagtgcaacctcttgaggaaagggttagctaagacccggctcttagtgagctcctcaacggagagtagaatcccctcaaggatttgaactccggggaacaactttgggagctacatcttggtgatatttcttcatccctctcctctagctttgcttgcttgtgctgttattggtctagttgctgattgtgccttgtatttcctgttatagtcttatagatctagagttttcattttttgtgtgcgctgctctgtgcattttcggaagttccgaaaatcatttcggaatttccaaaaattcctagcctagctccgaaaattactgcttccgcatttcttaagttttaaattagcctattcacccccctctaggcctaattgaccctttcaattggtatcagagcctaatctcctaattaggcttaactgcttggagagatcttgtcaggccaagcgggggatgggaacgatggtgataagggagctaagatcccttatgactatccctctacatctacatcttttgtgagtacctatagcggcaaagctccgtacttcaatggtacggactatgccgcttggaaacataagatgaagatgcatttgaagtctattaacccatctatttggagaatagtcgaaaaaggctatgttttgcagaatcccgaagatcccaccaaggaggacgacgagaacgagcacaagaacgttcaagccgctaatgcaatacttagcgccttgagtggaagtgagttcaaccgtgtggatggcattgagagtgccaaagtgatttgggacacgcttcggaacttgcatgaaggcacggatagtgttcgtgagtccaaggtggagatcctcaaggggtaatttgagagatttgtgatgttggatggtgagagcccaagcgacatgtacgaccggttgagcaagatcgtcaatgagatcaagggacttggctccaaggacatgaccgatgaggttgtggtcaagaagatggttcgagcaatcactccaaggaactctaacttggtgaccatcattcgtgagcgtccggactacaagactctcacacctcacgatttgctcggacgcatctttgcccatgacatgctcgtacaagagtccaaggatgtcatccaatacatcaaccaaagctcaaccgcaagcatcaagaaggaagacttggctttgaaggcaaaggaagaagaagaagagaaccgcaagagcaagagcaaggcggagatcgatgatgaagagatggctctcttcgtcaagaaattcggcaagttcatgaggcgaagcggcttcttcaagggaggattttccaagcactactccaacaagtcaagtggaagacactctgcaagagtgtgctacgtgtgcaaagagcccgggcacttcatcgcggattgcccccacctcaaggatggttcccacatcaaggaagataagaagaagagtgagaagaaggatgagaagaaggagaagcacaagcatagcaagagggaacattatggccaatctcaccttgggatgatctttggctccgactccgagtcaagctcaagtgatgaagaaggagtcgccacgttcgccgtcaagccttcatcaccaccgagactctttgactactcaagtgatgaggatgctccggtttgcctcatggcaaaggagcctaaggtaccttctcctcttaagtcatttaatgttgatcttgttagtgatgaggaggatgaggttgaggatgagattatggatgacgaattgttcaagtccataactaaggaatccctaccacacttgagtgagttgcttgggagaattgaggaccaatatgcaattcttgagaggcaagagactttgctcattcgtgagaaagagcggtctcatgaactcaagagtgagcttgttaaggagagagagaaaaatgaggcattggtacggctttacaagcaaaccaaagagtctcatgctaatcttgatgtggcgaacgctcaacttcaagagagagtggatggcttggacaaagcatacctcactcttgaagaaaagttcgaaaccttaaagaatagtgtctctctccctagcgagccatcttgttccaaaattgtcccaagcaatgaaccatgtgtgagatgcaaagatattgatattaacgcttgtgctactaactctattgccttgagtggtttgcaaaagcaaaatgagaagcttacgggactccttcacaatggcctacttaagtgctatatgggtagtaaggccctaaatgtcgcgaccgggaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcataggcgctcaactggggtataagccaggactccacctaagacttcttctccaaagcttctcttactgaagggggggaaaagattgagcaagagtgagtacaaccacagtactcagcaagccacaccggagatgcataattaatgcaagggagtacaaggggataataatataggggttaagttttgcagtaaacagcatttaaaagtcacttacttgcccaaagctattttgtaaacacgatcctagagctatacaatattattaatcaaggccatgaacccacacgaacctgccttaacccaaggcctacgatgattcagaccgaactggcaacccgaccctgggtcccagctcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcccacctacggccggaacccccgggacaggcaggcaggattgagccccctagcagcaggacaccagccctgtgccatgacatctcgactaccgggccgcagctcgtgtagccttcatttgtcctagagatgtccatcgacccccgacttcgtccatctccatccgtgtacttttgtttataaccagtctgagctacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaaccacctaatgttgtcctattaaacagcgaagcatctacctaaattcatactagtggaaccatgaatagagtacccactagttggggttttgtttattctagggtgaacaaggtaataataacaatagcaataataatgtcataacaaaggtaaataggcatggctaaacaaaacagtgataacgcgggaatttaaataaagcggtaatgcattaatttaaatcaaaataattttataaactgagattcaatatgctcaaggatgatgtgacttgccttgctcgctttcccaaacgtcggcttcaacttccacgaagagcggatcttccgaagctgcagcgtctacacgaccaacggaaaagaaacggcttttactctactaaactccatataacaagcagaaacaaagcacaaaaatgggttcttggcttcttaaggaaaaattagagacttgaacggtccaattccgagttcaaatggccaagttatggccatttgaagcttatatgctctttaaatggatatttgcgaatttcttcatttaaattttaatttaaaatcggatttattgcgtcagccgaggggaggggcgcgcggaccgggtccacaggagtggggcccacgcggcagcctcacggtccacggtggaccgggtgcacgcggcttacgccggccggcgccgtgggtcccgcgtgtcagccgtacccgagggcgcgggcggctgacggccgggccccacctggcagccgcggggcgcgcccgaaggcggcctcgccggcacggccgacggggaggcggcgcgctcgcaccccgatggtcgccggcggcgaccaccagcgcggcggagcggcgcccgagagaggggagggaagggggaagcgaaacggcggtccacggctcaccccgggtcgacggcgacaacggaaacggcgaccgaagcggagagaggcggcggcgcggctcgggtcgacgggaacggcggcgttccggcggtcggctggcgaaacggaggggtggacgaggtcggcgaggacgcggcggagccgaaggaggcgacgccgaggcgggagaaagtccgaggcgacgacggcggcggaccggagctcggcggcgacggcggagagagaggacgacggcgcgagctcgattccgacggggagagagagcggcgagtggcggaaacggaggagggaggcacggggaacgtttaaatagtgttgggagggggagagagcggccggatgagggggaatcggccgcggaagatccggccgccattgatgcgccggcgaaggttgcgggagcgtttccaaacgaatccgagggagagagagagggaaaagtggggggaaagagggagggaatcacggggagtgatttccccctctttattgcgcgcggggacggcgggaggcggcgggattcgcggcggctgcggcgctagggcacgggcgaggctgcgggagcggcgggaggatagggatgacaggtgggccccacccgtcagcgagggtggcgggcgggcccgcccgtcagcggcgcgcgcgcggggagaggccgagtgggccgcggggaggagagagagggaaagagatgggccgagccggcccaagagggggagggggggaaaagactttttagggtttttctttttataaaatcattttaactttgtttatttcttaataattattatttgtgctctgaaaattccactaaaatttgagggctccttttagaccaaggagaatttaacaaaaattctccgggtcacatttgaatttttcttgtacgtattttaatgtttgccaatttcttttcgaattttaattaattctattattccttttagagaatgatttttatttcgggatgaatttatcaggacgtgacactaaaggagtacctaggctatcaaagggacaacttcaaccatgagggtcttgggtatgttcctccaccaaaagggaaggtggacaagagtgtgatgatcaagaggccgcaaggtcttagcaattttgttaaggccaaaagtatccttcctaatgattatgcttgacattgttcttttgatgcatcttatattcttaggaagaatgctagtggtcgtgttgttgctaagtatgtaggcccaaggggcaagaatatttctatcaagagagtactttgggtgcctaaggcacttgttactaacatgagaggacccaaacaagtatgggtacctaaaactagaaattgatctcttgtaggaatatgtctccggtggaagaagttgggtgattgatagtggatgcaccaatcacatgaccggagaagaatcaatgttttcatctcttgatccaaatggcacttcacaagataacatagtgttcggggacgatggaaagggaaaggttatgggattgggtaagattgcaatctctaatgatctttccattgccaacgttctcttggtaaaatctctaaactacaatcttttgtccgtttctcaattatgttctatgggttacaattgtctttttaccgatgttgatgtgaccgtctataaaaggaatgattcctcggtagtctttaagggtgttctcaagggaaagctttaccttgtggatttttcctcaagtaaagccaaacatgagacatgcttagtggctaagtccaacacggggtggctttggcatcggaggctagcccatgttggtatgaggaatcttcacaagcttctaaagcacgattacatccttggactaacaaatgttcaatttgagaaagatagggtgtgtagcgcgtgtcaagccggcaaacaaattggagcacatcatcccgtcaagaatgtgatgaccactacaaaaccattggagcttctccagatggacctcttcgggccaattgcttatctaagcattggaggtaacaaatatggtcttgttattgttgatgacttttcacgcttcacgtaggtgttctttttgcatgacaagagtgagacacaagccatcttcaagaagtttgcaagaagagcacaaaacgagttcgacctcaagatcaagaacattcgaagcgacaacggcaaggaattcaagaacacgtgcatcgagagtttccttgatgaagaaggcatcaagcatgagttctcagctccatattcacctcaacaaaatggagtagccgagaggaagaataggactgtcattgagatggcgaggaccatgttagatgagtacaagacatcggaccgtttttgggccgaagccgtcaacaccgcatgccacgccatcaaccgcctttatcttcaccgccttcttaagaagactccctatgagcttcttaccggtaacaaaccaaatgtctcttactttcgtgttttcggtagtaagtgttacattcttaataagaaggctagatcctctaagttcgctcctaaagtggatgagggattcttgcttgggtatgggtcaaatgaatgcgcataccgcgtcttcaacaaaacctccggtattgttgagatcgcgcgtgatgtgacatttgacgaaactaatggctctcaagtagagcaagttgactcacatgtgttaggtgaagaggaggacccgagtgaagcaatcaaaaggttggctcttggggacatacgccctagggagccacaacaaggagcctcttcctcaacataagtggagccacctacatcaactcaagccgacgatccctctacctcaagcttggatcaaggtgaagaaggcgagcaagtaccaccctcaccgatcaatttagctcgcccagaatccaccaaagtatccaaagagatcatcccaccgacaacttaggagacatcaacaagggagtatccactcattctcgtattgcaaatttttgcgagcattactcgtttgtgtcttctcttgaacctctaagggtggaagaagctcttaatgatccggattgggtgatggcgatgcaagaggagttgaacaatttcacccggaatgaagtgtggactttggtggagcgacctcggcaaaatatgattggcacaaagtggatcttccgcaacaagcaagacgaggccggggtcgtaataaggaacaaggccgaggttagtggcgcaagggttcacccaaatcgaaggattagattttggtgaaacttttgcgccggtagctagacttgagtcaattcgcatattgcttgcttttgctactaacctcaattttaagctatatcaaatggatgtcaaaagcgcctttctcaacgggcctatcaacgagttggtatacgtggagcaaccaccgggcttcgaggatccaaaatttcccaaccacgtgtacaagctccataaggcactatatgggcttaagcaagcccctagagcttggtatgagtgtcttcgcaattttcttgtgaaaaacggctttgagatcgggaaagcgattcaactctttttactaaaaggcataataatgatatttttgtgtgccaaatatatgtcgatgacattatatttggttctactaacaagtcttttagtgaagagtttagtaggatgatgaccaagcgttttgagatgtccatgatgggtgaatttaagttctcctccggtcttcaaatcaaccaactcaaggaaggaactttcatttgccaaccaaagtatttgaaggacatgctcaagaagtttgaaatggagaatgcgaagccaatccacactcccatgccatcaaatggccacctcgacctcaacgagcaaggtaaagacgtcgaccaaaaggtataccgttccatcattggctcactcctttatctttgtgcatctaggcccgatattatgcttagtgtgtgcatgtgtgcaagatttcaagccgctccgaaggagtgtcaccttgtggccgtgaagagaattcttagtatttagtgcacactcctaaccttggtctttggtatcctaagggaacgaggtttgatctcattggctatgccgatgcggattatgccgggtgcaaagtgaataggaaaagcacatcgggtacttgccaattcttgggtaggtcccttgtttcttgtcttccaagaagcaaaactccgtcgccctatccaccgccgaagcggaatatgtttcggcggggaattgttgtgctcaacttctttggatgaagcaaaccttgagagactatggcctcaatgtatccaaaatcccactcctatgtgacaatgagagcgccattaagatagccaacaaccccgttcaacactcccgaaccaaacatatcgatattcgccaccatttcttgagagatcattccacaagaggcgacatagacatccaacatgtgagaaccgacaaacaattggtagatatctttaccaagcctctagatgaagctaggttttgtgagttgaggagtgaactaaatattttggattctcggaatgtggcttgatctattgcatgcatgtttgcttggtagaatatgtttgcataccactttgtgacaaaatgatcattcaattcatggatggacactagtcacttttgtggagaacttgaatctatgtgtatggggatctcatttttcaatgaattttggtcctagcacaatttgcaatagattcgcacattccctccttcgagggtgaatcatcttgtctcatggtaattcactctcttttgatctttggatcatccatttgtcttgtggctattgttttgtgtggttgattgcgtgctagccataagctcaaatggggcctaaatgttcgaccattcttttcactccttcttctatccaaagatttgcaaattgctttcatcaaaattcccagtgcgaattctcttgaaaaatgcatttcaaaatgtttgcaaaattgtttttcatcaaaattccggcgcgaatcctttcagaaaggggtttttgttagctttccaggttttttcggagttattccgaaaattatcggataattccgaaaattttcagaaccattgcgtcgcttctgtatattttcggaacttccgaaaatttccagaacagtcaaaatgtttctataaattttcggatctatccgaaaattttcgggacttccgaaaattcttggaggatacttaaacccccgaccgtggacctcttttctttctctcctctttcttctccacggtttcctctttttctccctcccctctccggcgacccaatcctctccggtgattcctcggcgattccccggcactcccctccactccaaccttgtgggagcaaggttgggagtcttcttggcggctacattgttgatcttccccgagttcttcacgttcttcgtgttcttgaggtatccaacttaaaatcgaatccctcgattcctcgagtttaatcttgcgatttccttcggtggagttgttaccctagtgccatagaccctgtagattcaatttcacaagtttttgttggtggatttgtgcaggatctaagttgtagtgctcgggctgaaattttcggaagttccgaaaattttcggaattattttcggaagttccgaaaattcctggctgagccctccaaccttggtttcgcatgattcttgcctccaatcacttgtaaatcttctctttggcttccttatactcattgttactcttgtcttgattgaaggatgcctcattgcaagcaaacttctcgcaagtccaagcgctctagggatcggtctcccactccttccccatcctctcatgaggactcggaccgtgattggtccgggcgagaagaagaggagaccggccctcaggtggccaatgttccccggggctcctctctcccacctcggcgctccactcatggggatgaagggtcctcgcggcagcctcgtgcttcctctggcgagggctcttctcgccaagctcacaccactgcgcctcctccggcgaggcttattggccccctcatgcttcatgctccctcacgccatcctcgccgagctgttcgtgactggcgccaaaagtctgacattgtggctgtggagcggaatcaggatcctcgctccatgccgcgcaccgcctctgatgacaggttctggacctctttccagcaagactacaatgcccatgcaatggatcgattgggaggctttggcgaccttggatgatcctgacctcaatgccgtcattggtgcttgtgagatgggggttcgcaatttcatgacccttcagcaagcttggtgcaaggagatcattgctcaattctatgccacagcctattttaatggtgatcgtgacattcattggatgactcagggctcgtggtattctatctcttatgaccagcttgccaatctgtggggttttaatgagaactggatgcggtacatgacccacttgcataacattgtgattcctcacaatcatgatttgcgccctctgtatcttcctggtggcaagttggggactactgaagggctgaagccttatcatatctatcaaaaccgcatccttaggcggaccttgactccaaaggatggtgatgctagcaacatcaaccatttctcccgctccatgctcctcaggttcaatcccccctgtcgtccctttcatgtctttctatttgtttggtaggaaatccgcatggcttctcttcagtataagagagggcttccctatgctcctcatataatgcggatgattgaacatgtcactcaccttcagtttgtgtgcgaggagccacataccgctctttccttgcgcttgcctaagcgcgggcctgtgcctcaggacatcccctccacatcctctcagtcgccttttgctcctgagtgtccttcctctgtggctcgtcgtgagccgtctcccttatttcgcattttgcggactctttttggcctttgctctacggaggctaaaaagaaccgccgattgcggaatttggcgaagaaaacggctcgtgatgtcaagtacctcaaggggctgcagga

SEQ ID NO: 75510 - DNA, 12060 bp, Oryza sativa
cacctggaacaaaaaccgaattatgaatcaatttactgaactacaaaagcacgcgattaaccctaattctcacttgaaaccgtaccctaaagagaagaattaggttttctgatcagctcctatatatctccctcctatattaagtaaacgagcagcccaacagcagcccggcccattacaaactaaaaccctaaacccaacttttctgttccacgttggtccaacattctctcaacttgatccaaacattaatccactccataataataattattctctaacaggaaaaaaaaacggggtgatggcaagcaggtcgtacggctgcgaagaaggcggtggcgctggcccgcgatacggcattttttttatatataattttctttttatccatgagcagattgttcagtttagtgttaaaatgtaaactagaattcgtatttgaaatgtaatgtatgctgtatgcatcggggactaatattaatttcgggttacctcaattcgggaaggttaatttcaaaggaaaaccaccattccgttccgagaaaacgtacggaaaaacggaaacagagagctatatatattcgcacggcgcacacaacttgattgcttaattcacattcatacgcagacgcgttggccggggagaacggcctcgccgagcgcgatgaggcaggtcatcgtcggtccatgtcgtcgcggcagccaacagcacggcggctctcgcccaatgttcggaaatttcgccccccaccgaaatgctaacatctcatccgaaaattttggttttttgcaattcttttatgaatttggtcaaattttattcaaaatccgtcaaaaattcaaaaaatttccatctatcgctcagctacggcagaaatgttgatttcgaaatttaaaaccctgctctcgccggtgtcaaggtggagaaggggtaggcaagagagggatagagccgtgatgctcctgtcctgtgcgccaaggagggtggcgccgacgatgcgaggaggcaggacgacaagaagaccgagacggagtcgtcggcaaagaatgccgcggcgacggtgtgggcaacttttttaacaagttgacaagtacgatcgtagcaccttaagccttgcggtgatcgtagcacctcgatctagcaaagagctaaacctaaatgggttttgataactaaaccggctagcggagccgatttctagataactacctgtctcgtgggcaaaacggaaggttttcaggacaaacctacaaagaggtgtcgcactcttgcagcggcggcggacggtttacagtgcaaaccgacaaagatggacaaactaagagaaaactaaaagcaaaatgaaaaatgattcgattgattgattatagattggttttttacaatgaaccggccatgtcccttatataggggttagtcatgccctctacaggccctccttcacgtccaactcggggtagaaaccaaagaaaacccgaaacatgccttcccgagcaaggaaacctcgagacccgacgaaacacagtcggactcggacctgtcggtcagaccggcctcataccaccggcctgaccagccctcaaccgacggtctgaccgcccaacacacggcggttagaccggcccactcggaggaaaccggtagacttccaaattttagcaatctttcctactttaatcctaggtgccaaatttgggtgtaaacacatgcccccctgccttttttatgaacaacgtgaatctaaaagcatagaacatgttttggtcttaggacgataatccaattaccggccatatatagtacctcctaagcatcttgccaaacgctcgggaagtatttcttcaagtatttcccgttgattgctcgctgaaaacgctccccttgaagtgtctccaaaaagtatgggttccctcgaacaatgccgcacactcgataaggaccctcccaactaggagaccacttaccgaactccttggatcgagtacccaaaggcaaaattgtcttccaaaccaagtcttcaacttgaaacaactttgctttcaccctcttgttgtatgccttggctaccctcttcttctctttctctatctcttccaatgccttcaagcgcttgtcgatgacttcatcaaggttgtctcccatcaacgtcttgtaatctacaccaacttcaacaatgttttattactcgactcggcttgtccattagcctgagcgtagtaaggagaagaactcaacaatttaataccataagattcggcaaaatttttcacttccttagacataaaagaagcaccttgatccgtagttaatgcttgtcaaataccaaatctatggataatatgcttcaaaataaagtcaattacctccgtatgagtcatattcctcaaaggcacggcttcggcccacttggtgaagtaatccgtagcaactagcacgaacatatgcccttttaatgacgaaggataaatttgaccaatgaaatccaaagcccatcctcggaacggccatggtttgattatggggttcaacacggcggtgggcgccaattgaacattgccgaaccgttgacaagcctcgcatcctctataatatttaaagcaatcatcaatcatcctcggccaatagaaccccgctctcctaagcaaccaattcatcttatgggccgattgatgagttccacaaattccttcatgtacctctcccatagctactttagattgatcttcatctaagcacttcaacaagacaccatctatattccggcgatataaattcccatcaagcaatgtgtatttgaacgcttgccgccgaattttccgatcaaccttaagtgtgggatctttcaaataccgaatcaaaggaattctccaatcttcttctgcttcctgggcacaaatgtccgaatttacagttaactcggcctccaaattgatcgcaacgtgccccctagcatccagcccagaaccggtcagaccggccacacaaggccggtcagaccgctcggggtcaccggtcagaccggcggcatgcagccggtcagaccgcccctggtcaccggtcagaccggccgtgcaatgccggtcagaccacccctggtctccagttttgccaatttcgcacaaagatttaatatcaagcaccggctcttctattattagaaataatcccttcttcacattatagccagatgcttgttgtgccaagtcatttactctagaattatcacgactagcaatatgcctaatagcaaaattatcaaaattggcaataatatccaaaacatgaatcgaggtacctatttagtgatctgtccaagcatttgtagactccgacgacttgttgcaccaccaattccgaatcaccaaaagcctccatgtatttagctccaaccatctccataacttgtaagccgaacaataaagcattgtattcggcttgattatttgtacaataatactcgaaacgaaccgatgcttcataacacatgtcattaggtgaaaacaaaactacccctatgccttgaccttctttgcaagaagaaccatcaaaataaatcttccaaggtataacttcaactaagcaaacctctccctcataagcaatatctatatgatggtccactataaaatcacatacaatttggcctttcatagatttcaatggttcataagccaaatcatattctatcaaagcatatgcccacttgccaattctcccacttagaattggcctttgcaatatgtgtttaacaacatcggcttgacaagcaactatgcatgtactagataacaagtaatgcctcaatttggtactagcatagtataagcataaacaaagtctctctataaagacatacctcgtttcggcatccaaaagacggcggctcaaatatgtaatgatatattccttgccatcttcctcttgcgtcaaaacggcaccaatgactttgttctcggaggcaatatataactgaaaaggctttccggctttaggcgctcgcacaacgggtggagtagacaaatacctcttcaactcttcaaacgcctcttgttgttttgcccctcaagtaaaatcggcttcttttttcaagcgaagtataggaacaaaagcatcgattttacccgctaggttagaaataaaccttctcaaataattcaccttacctagcaacttttgtacttccttcttgcatgtcggcgctttgaaatcacgaatcttttctatcttcttaggatcaatctcaactcctctctcatgcaccatgaatcctaagaactttcccgccgacacaccaaaagcgcatttaagtgggttcatcttcaaaccataccggcgcatcctctcaaaagctaatctcaaatcggctatgtgtccttccataccatccgatttgacaacaatatcattaatatagatctctaagataatacctagcaaatcatggaagatcaaattcattgccctttgatatgttgcaccggcattcttcaacccaaaggtcatgacaacccactcaaataaaccaacaaaccccgggcacctaaaagccgtcttgtacatatcctcttccaccagaaagatttgattgtagccggcattactatctagaaagctaatcaccttatgacccgaggcatcattaatcatcatgtcggctataggcataggatacccatctttggtagtggctttatttaaatctctaaaatctatgcaaactctaatcttaccactccccttcttctccaccgggactatgccagaaacccactccgcataacgacatggcctaataaaccccgccttcaataaccaatcaatctcctctttgactcagtcatatagcaaaggattaaaacgacgaggtggttgcttataaggcctaaaacccagtttaattggaagccgatgctcaacgagctcacggctaagacccggcatctcatggtactcccatgcaaagcaatcaacatactctttaagtagctcgattatcttaaccttataatcggctctcatgtttttgtttacaggtttagttccatcaccaatgtccacttcctccaatggatcggccgatgtaaacccttgtccaagcttctccacttcatcaaaatcttcaatggtttcaccaatatcgttctttgtagaccgatattcttgcacccttttttgtaaccactctaaattagcctctttactcattatacaaatttatatggcttagccgtgctacactagccggctttacagagataggtacaaatttgccatcggatatactaataaaatcatagctagaaagatccctccccgataagcattggatattcccatgacgccactcaaaagtagcatcggccattgcaacctcggccgatgtatccgcttgaacaatttcaacatcatcgcccgtcccattgaattaaacattgatgcaaggtagaaggcacacaacaattggcatgaatctaacaacgacccaaaataacattgtagttaccttgcacatcgacgatgaagaaagcggttggtagcgtcttgtttcccacggtgagctccgccaaaaagatacccttcgcctccgttggttcaccattgaagccattgagaatcatgttggtcttcttcaactcatcatcctcatgccccaacttcttgaacaacgaatatggcatcaagctcacggcggcacctccatccactagcatcctagagaccggcttcccatcaacatggcctttgagatagagaggcttcatgtgacggttcgactcatcaggtatctcaaaaaccgcgtctttaggacctaatgagaattgagcaacctcggcttcatccatagcacaaaactccataggcaacatacataccatgttgatatacatgtcttcttttggagatgattcacttttatgaaccgattgttcttccttttcctctacaccaatcggttttgccttctttatggatttaggcctccataccggtgggggtcgcaactcattgaaccttttatccctttgctcttcgcctttttctctcttagctcttgggcccgaagacgttgcaactttctcttttgagtagccatcaaatccttaggcatccacctaggattcggctctgttccgggaggtagataatgccctctattaaccctgtttgaagacgatgaagccctctcatcgcctttcgcaaccctcctgtcaaaccggcgctggagcccggtcataccggtcgtagaccaccggtcagaccggccagatgcgccggtcagaccgacacttggcgcacggtcagaccagcctgaggtgttggtcggaccactatcgggtcggcggtcagaccggccggtcagaccggcctaatagcccggtcagaccaaatactgacaaatataccaagagtattgaaattataaacttattgctttgtagatgaatatcaagttattagagtacagtatgcgatatgatcgccaaattcagatgaaaatgtgtcattttgttgccacagaaatgcaatccaaataaacccaatgctgggacaatataaaagaaaaattcaagttatcattcttgatgatcggctggcttgactgaaattggtgtaactagagcacacagaggggtggcctttgcaagtgtcaagccaaacttctctgacatatctatcccattcctttctaccttaactggtaggttccatttgaattggtttaacaatgatcccaaaattagatgtaccatcctatttgctagtggcattccagggcatatccgacgacctgcaccaaatggaataagctcaaaatggactcctttgaagtcgatcttacttcccaaaaatctttctggtataaatttttctggttcgggccatatatccttatctctgcccatcgcccatacatttacgaaaatccgtgtccctttgggtattgtataacctgctatcttcattgtcatctcagcttggcgtggtaataataagggagctggaggatggagccgaaatgtttctttcaccacagcttgaaggtaaggcaactgaccaatctctgattccttgatatttcttcctaagccaataacttgtgaaagctcatcacaaactctagacatggactttggattttgcatcaactctgccattgcccattcgacagtgctagagcttgtgtcacttcccgcacaaaacaaatcctaaaacatgaattataattgtcaaattagttacattactagcagttatatcgttatagataagaaaaaatattacaccttacaatttaattgctttttttatggaaaatacttcatccgatccaatttagtcatcactgaactttcaccaatgtccacctcctattccatgctgcatgcacaggccacaggggcaaagctagctaggcatagcgcagttaaagattaagccctaggtttaactcgatccctaatcccatgtaaattccatacagaacaacacgacttaggtatataaagacttgatctgttgggataagtagctatcaattgctgtgtttagttcttttcaacttctatttttccgtcacatcaaatgcttgaacacatgcatggagtattaaatatggataaaagaaaaccaattgtacagtttacatgtaaattacgagatgaatcttttgagcctaattacaccatgatttgataatgtggtgctacagtaaacatttgctaatgacagagtaatattaggcttaatagattcatctcacagtttataggcggaatctgtaatttgttttattattagtctacatttaatacttcaaatgtatatccgtatacgtcaaaattttcttggcaaagtaactaaacacggccaatgtcaaactgcctgttgggacttgggaaacacttctagctaccgacaaagtctgccacaagtgcttgccaggggtctagcagtagagacaaatatttgccgacaaactttctttttgttagcaggagatgtatatatgtaggttgttcaatatttttcatgacagataagataatttctgatggataaatataccccaaccgaccatgtgatagcacctttcacgacagacttagtgacatctattttttccatgaatctattgtctctattttggtgttgtgttgtagtgataacagaaatactacaacatagtataccaactaagatgaaatagtttacactcctcacatcatcatgatacctaagtattagaatgattggtacatacctatgggtatcaatgtatggtactcctataccatatttgataacatatataccacatctagtatctaaggttctgtgttatcaagacatcaaaaagttttactggaccaacggtataacgttctctagctagttcccctcatttcaccggtgatgtggtggtggagtcgtaggtggatgacttcacccaccaagtgctcacaaatattagacatatgtagttgagctttaaataagaatttagtaagattaaggatgtcattgagttatatctctaaggatatgtgtgaggagatgcatttgctcggtgtgagtatggtgttatatgtatagtgatgtatgtgcatacatgtctaacaccatgtgattgaaaaaaaaataaagataccacgtgaatttttaaagtagtgaagacccgattagcagctcatcaacgccctgtgtatgggtttatcctctctctttcccctaagagcagatacaatagcaggctataagccatctataaacatattttaaaaagataaaggaagagagagaagagcagcgggctacagatatgtagccagctgcagcacggactccaagatataatgtgtgtatgacaggcagggtcaggtattaatagtatagtaagcaactattgtataaattggctattacattggctatatatgatttagagatagtagttggctatactattaaacttgctctaatgcggtagggcgtgatggttggttgtggtgcttaattaataagctagtatatagtatattagactagacaacaaccaattgggtgcaagtcaattgatgtggtactatagattagccttgctccctgttcgatatgataatttgggactacagattgtttggtcaagagcatgtacaatagcaggctataaggcagttataaatatattttaagaagataaatgatgagagaggagcagcgggctatagatttgtagccagctgtagcacggactccgagacacagtgtatgtatgacaggtcaaaccatgtattaataatgtagtatgtaactattatataaatgagctattagattaactatagataaattagagctattagttggctatactattaaacttgttctaagtagatcccgtgtgtattttatctcagatctgatgagtttgggtatttttctgatcttcgttagtacagtactattctctattgataatggccagatcgagagagtactagcggagagtaataattaattcattcgacaagtcataggtttggcaatgattattaattatagttctagccccttctagctagttgcactttatttaaaatactttattccagcgttatacttagcttgtatactgtacatataaatgggacaaactatgggcgcctatttccatggtcaatctaccacaccggctactatatccttaccaaaataaatcaatttaagattagatgaaacaatcttctatccaaattcattgtgctttttagggcctcatttaattctaaattgatttattttaatactaagagatacttagctattattaacgccatgcaatgtcctatgtgtcgcaccatatggcacctatttttttagtgatggcctcgatcatatttttaattcaatgtgtgccagcactaacctatatagtatcactattacaaccttaaaacaatccataccatcgttacaatacatatattatatttaggacttaggatatgcattttacaccttaaggagatgtgtcctctcatcaaatacactgggtctctgttcaaaaacaatgtatgcattgactccctccgtttcaggttataagactttctagcattaatttcccacatttatatagatgttaataaatctaggcacatatatatgtctaaatttattaacatatatatgaatacgggcaatggtagaaagtcttataatataaaacggaggaagtattaactaaaaaacttaaggaatgcattgactcacattattacaccttacaatacatatattatatttgaaaacaatgtatgcattaacgcaggattaattaagtattaactaaaaaacttaaaaaaaatttacagaaaattttccatatgaatttttaaagtaattttcgcatagaaaattttttttacagaaaacgtaccatttaacagtttgaaaagcatgtgcataaaaaattgggaaagtgaccaaacgaactcagcataacgtactcgtgaaaaccaaatccgaaaacatttcacgacacactttctcgtgtaaaaaaattgggaaagtgaccaaacgaactcagcctaacgtactcgtgaaaaccaaatccgaaaaaattcacgatacactttcttcatatataccagtataaatattcaagtctaaaaactcaccatagaaagcgagtggaagaaaaaggacaaaatcaaactgtgaacagtgcaagtattgcttacttttccaactatgtgattttgctcttcattttttaactaatacttatgtttgtcctcaatccactaagaggactaacaaattgcgttataattcatgtcaaattaaacaagaacacaaaagttatgtcagttatgcttggcaacatttttttaatcgcataagtgaaaattcatgttaaaacgttttaaaaccataaagggatagaattcatgtcaaagtggttgatgtcaaaatagggaaaaaaatcacaaagtactaaaaaaacagcggcaaacctgcaaggccgggcatacgtacattttaaaactattaagtcctctaaactggggcgtaaggggacaaataagggctaaatcacgaagttaaaaagatagtagtaatgttagtatataattaagggaaaatgaataaattgaaaagattggtgtaacattacaatatttgaagttaaaaaaataaaggtaaagaagaattgtctctaaactttataattgattcttaccctttcaaggtaaagaagtatatatatttacggtgatctctactagcatatttatccaaaatatattctcgcgtggatgtccagatattaaaaaacatcatcaaggaatacatgaaaacagatttgctaaaaaaattgtcgcaattaattatgctattgttacattacattgtaactacagtatacgtaactgcactgtaacacatattacggagtataatttaagaaatcaccgccattccgttcaattaattaaagggattaggggggaaatatagtattaattggattaccgtgaataatgagcggagagtgtcacggtcgagctccgccgcatcatcccgccgcgccgcgatgccgaggagcacgtcaaggaagtcgcccttcctggcctcgccggcgtcgtgctcgcgtagcctggcgtccacctcggcgtcgaacacccggtgaagccgcgcgaagaggcgcgccagccggcggcgccacccctgcaggtcggcggcggcgaggacggggaagaagtcggacacgttgggccgcccgccggcctccatgatcctcgccaccgcctcctggaaccccttggacccgccatggtcgtccaggctcgtcaggtcgcgggagaagatagtccggacagcaggttcaggctcgtcgcgaacgccacgcgccccacgtccaccaccgccggcttgcccccctcgccggccgccagcctcgcgacgtgcgccaccagctcccgcaccttctctcgccggaggcgccgcggcgcggccgcgtccagccggtgcggcgcgaacagctccgtcgc

SEQ ID NO: 75511 - DNA, 8455 bp, Oryza sativa
tcacttttccatgatgttgatttcttgtttatatatcttctcaactcgggaatcatgttttgaatttcccaattgctatgtcaaatctggaaagcagttctaatttgattgcatatgcttgccaataatcgagatgtagtctccccacgccaccacacatttttctatttgtaactctacaatgcttgtgtcaaatcatgcatgtttttaatttactttgttgttttttctgtttaggcctagacttttgtatggatacaatgtattatgtcgaaccacaacctttgtacagcgctgaggtaggcctgctgtgcggtgcttcgcgttgtgaatcgaggtgtagcttacgcgatggtggcggtcgtgagatgacattttattttcctcggtggatctgaatttttgggagtggattggaagttgattatatgttttaactgctggaaataggtaagctctacggactcttaagctactataagttgtttagataaccataacaaatacatgtttcagtacaatatatataaacaaaatatggtagtcaattatctatttctgatacattgaagcatgtctctgacaatttggggcatactgctctcacattcattctcttggtacgtcaacagctctactaaaaaatgcttccttagctcgtattcatcttgtacatgcatttatttatgcaagtgatcaaggttaccactgtatgtgtaaaaaaataatagcatttaaatgataaattctagtgtcatgatactttgcctttgtaattggtaactgcaattcttcatcattccatttgcacatgaagagggacacaagataaccagatagttcgctaagaagattgaattgttaattaattttgtgttaggaaataaaataactggtgctgcgcataccgctccctatctctttgtctttttcatacattgggatccaagagtggggatggtgatgcagacagtgtggcaccaacattaaacatgtgggatggagccggtaatcataaaaagaattatgtactccctctgggttgataatacttgtcgtttggacaagggcacggtctcaaaaaaacaaatttgaccattattttttattataatatgtataaaagtgttaacaaatatatgattttattaaagtactttttaagactaatctatacatgtagtcattatatttaaaagacaaatattttaaaaatgattcataatcaaagattctaaagtttgacttcacccttgtctaaaacgacaagtattatcagccaggagggagtagatgatttcgtacttccatctcaatattataaacatagtccatcttaaattccatcttttttttcatgattgagttagtctttagcactgaatcattaacattgttttgagcactgaaaataacttattttgctgcagcctagttgttaaagacatgtgcaccactgatgatttccgtacttccatctcaatattataaacataaagtccatcttcttaaattccatcttttttttcacgattgagtcagtctttgttgggagtttatgcagggtgcttagaatatttggtactatcctttagaatcattacacaaatgcaacagactattttctgtctttgctgatgattgctaatgcagctcgaacttatgggagtaaaaaagccctgagaatactttgcgtatgcatcttgtttgatcgggcatttttctttgatgcaacttgagtttatgtttgttgatgactgtcgttgatggagctgctcctgccaaggtggcctttttggcgatggagtagaactgtctgaatttttttatcacaccacaagaacggattttgtttgtggtaccattttttgtatatataaaacatattttggttgtatatatatagaataggatgtatctaccgttcttgtggtgttgttcatgtgtttggatgtaatatggggtgtccttgtggtgtttggataaggatctgttggagtgggcctaaatgtgccatgggcctgaacagatctggggagtaaaattgagctacgtgctaggggatctgttggggtgggcctgaatgtaccatgggcctgaacagatctacggacgtgagagggaatcggaaattgtggaccgatctgggagggagcgatctggaaggaattggacagaaataatcgcgtgtgcactcgggaggaaatcggactaaaaaatcgcaatacagggtgtgaattggattgaaaaatcatgcattactgggacgacgtacgaaaaatccctgacaaaaacatcttaaacttttataataggtaaagactagaaaaatacccatgcgttgctacgggaggaaaagaccgtggaagcgggcgtcgttctatggcagagtccgtaatgtcaacgaaggagtaatcgtggcggagctggtggaggtagtgtccagacaccttggtggttgatggcacatcgccgacgaagcttagtgcggccgactacagcaagacggcgtcaggagctcttgccggcatggcaaggaaaagcttgctggcggcagcaagatgacgacgcacggcttgggagggacagagcggcatggaatgaaacaattcacgtccttggtggcatgttttgaaagtgttgcgaattgagtggcacatcctgaaggtggtgcaaatcgaatggcatcttctaaaaattctcctaaaccatttgtaatatgtgataatacaaatgccggcatgtttgcaatggaaaaagatacaattgcgtatgtaaatcgggacatgtttatatgtgtttttaagtgagaccgtcataaattttaatatcgattcgtcagttccaacaaacatattgtcatgggcggatcacccaaaaaattcttagcctaacacataaatatacgtatgtgagcagaaacttttgaaaaaaaagaagaaaaaaagctcgtttttaatatattatgatgcatatttgatccatttatacttttagctttgttatatataagttggatcacccatataaaagttcgagatacgtcattggtatagttaaatctattattaattagtcattttcatttttaagggagtattgtttccagtttataaattaattacatttgaggtcaaatagtagtatttttttgcctcaacaaattgattgagaaatgagaaaaataaaaggaagagaggtctggtaggaaaaaaaataaagaaagaaagcagagcacgagaacagataagtcataagtccccattttcactttctccttcactttccccaaatccatccgctctcatcccgtgtcctttactgctgtctagctgtctcccccgattcaactccccaccaccggtcacctctagcatcgctgtgcttcttccctgtctgctaccccacacaacaatccttgagctccttccctacttgctgcgccccatcttcctctcgtggcggcatccggttatgcatctgggctacagctcagctcaagtagttgacgggggcggagtggcctcggcagcggcgtggagtggattcgacggtgatgatctgcttccgagccaagtctgatgccgtgcacggccgcctcctggttctcttccgcacgcagccaaggccacgacagcgagcctcaaccttgcgtggcccacgagaagcaggcgcaaggccggttcagggtgacggctagggtgcgtgcatggtggtgctaattctgtgctcgcatcacatgatggcggtgatttgccaaattggtaagccatcaatctgatttgcttagggatttacccagaaatttgagttctaaatttgggtattttttcgttttagggttttgaaatcatgcaacgtgcggccgaagatagaaaccggtgagacaatgattctggtggctggagttttgctttatttgggtttgggatctaattcgaggaaaatttggaatttagggtttgtgcaaattgggtattttttctagaaccaatttttgtatttttgtatgttgtatatatgcaagttgtcctagtgtaacacgaaccggtttaaatttagcccaatttatgtaaaatcctgatcggaaccgatttggtgcggacttaggattaccttgactttttttctccatgtcaaattgaattggatctctgattcttttgtgcattggccagcgtatgtgatgaactcatacggatacggacacaatcagggacgacgcacgaaatttgtggcaaaaacatgttaaacttttataataggaaaagaagtagagaagagatagagagaaatagagatgggcacgctataaataaaactataaataagttggtcgaatttccatatccgtgcccgacggaattgcatcctgacgaccaaaaattataatctgatccgatttgtagtgcgtacgtactctgaattctcaaataggcatagtccgtggttaccacgtgaaaattattcccatcttttctcctcgtcaaggaataatacgattttcaacatttgcaggaacaaatcacaaaacatatcctccgcttacattgcccatcgtttcgtttctgcccccgacgaatttgatttctttcctcgatcctcctcctcgattaatctggttcaattcttttcccctcatttggctcgattccaacctggtttgatcagttcttggaacttgaaagacagaaactgaagaggatggggtccaagaagaggatgtcaaggtacgccaagaagcacgaggaggccacgctcaagttcgacgtcgtcgggtacagcctcaacgagggcatggccgccggcgagttcatccggtcgccggccttcgccgtcggggctacgactgggcaatccgcttctaccccaacggcgccacggtgaccatctcaaggctcacctccgtctccctggagctcttgaccaagaattgcaaggtgcaagccgcctatgacctgcgattcgtcagccacgccaccggtcagcgagagtgtttcttcgctatcagagccaagaatgttcagtagcaccagatgccctaagcctcagcgctcaaatccgatgcaaagatatcgtctggagaaggaagaatcaggctacatcaaggacgattgcctgaaaatcgagtgtgtcctgaccgtagtccataaaccgatcgtgtccaacgccaagggacgatccgaaatcgaggtgccgccatccgatttatcggatcatctcggcaaattgctggaggaagaggaaaccgcagacgtggatttcattgttgggggatcgaagattgcggcgcacaagagcgtgctcgcccgtcttcaaggcggagctctatggagggatgaaggagagggaggcccgtagcgtgaccgtggatgacacgcagcctgacgttttcagggctctcccacatttcatgtacaccgactcgttgcccgacatggacggcgttgaagatgccgactatgttgaaatgatcaggcttctactcgtggccgcggatagatatgccatggataggatgaagttgctgtgcgaaagcgtcctcgatgatttacttgatgcggagacagttggaactacgctagctttagctgatcagcatagctgcaacaaccttaaggatgtttgcgttaaatttatggctacttcaaaagggatggatgctgtaatggcaactgaaggctatgataatctcaagagaaattgtccttatgtcttgatagatgtgttggagaaggttagtaataagcttcgtagaaattaagatcaatttgtgaatcccatataggccaagttgattctgtgaatagcctgtctgtttttcaagactagatctgtttagacaacttatacaacaatggtatcacagttatggcattttatggcattagtagtttaatcgatctacaaatcattgcaagcatgcatcttctgttgctttaatttttctttttctgattggttaatccggaacatatgtgctcatgttttactgctacaatggcaattttggataatcctaaaatcagaggattttctagactgtattgcatgctttctgttagtaggttaccctgtaaattcagagtaaaatctagcaaaacatcttttacacccgcaagcactacgtatagatgttctttaccctgttgaactttatggtggtaaaatgtaggcatgattaaccttatgcattgaattttgaagctaaacaggggcaaggcaatacatactacattggccttgcttgttgtaacgaatatattttcttcatcgaacatgtttagcctctttgaacatgaagattaaatgtctttattttggtagaactgaaaattcaaaaaaggtttagtgttcaaacatcattgccctttaacatgaataaatgaaagccaacctgataatttctctgaacttcctaaaagctcattttgaattgcctcctagagatacatactgtcgtctgtcaatattgcatgtggagcttttctattcatgaatttgagaaatagtacgtaggagtacctgttaaaaaaatgacttgcaccctataaaaaaagaaagacttgcagctaatgtttttcatgaaaaaaaggaaagaaagacttggtatgagactgaatagttaaaaagagttctctacctggtttatagacaatattgcagattttcctccgttggctcaaccaaagaagcaaataatcacatgaatatcatagtagtcaaccgatcgatgtagttgtgtccaatacaacagcatcactaaaaatatctcataagaccgcagtaagtactgatgacgcaaacgaccagcaatatattcccaagactgcgtgtactgagatgatgcaattattcgaacaagcaaattcacatctgtctttgttgaagtcatacttgaaacttgtatacttgtgggcaagcagaaattcagatcaactgatgagggctcgctcaaatttgtgcgatagagagagagaggggaaacggaggatgaacctgatggcgtgtaccagcgctggcggccgcgggggactgcctgcgacgaggtaaaaaagcccgcccatatgcaatcgggaaataactacaaagcagacgcccgatttttcccaaaataactcaggcatcatttcacccctcgtaaaacaatgttttagcgcttagtgaaagaatatttcagttcttgaaaatagtgaaacacaatttgatcaccagatgaaataattttcttcaacgtatgaaacaaatgattaaagtcattgaaatatcaacaagatccaagtgaaattgagaaaaaaaatgaaacaccataaaaaaaactccacttaggcattgtttagttcccaaaacaagaacttttcacccatcacatcgaacgttcggacacatgcatgaagtattaaatgtggaaaaaaaacaattacacaatttgcgtataaattgcgagacgaatcttttaagtctaattgcaccatgatttgataatgttgtgttacagcaaatatttgctaatgacggattaattaggcttaataaattcgtctcacagtttgctggcagaatctgtaatttgttttgttattagacaacgtttcatacttcaaatgtgtgtccatatatccgatgtgacaccccaaaacaaaaatttttggtaactaaaccgggccttaatcacttcgatctaactaataaaacatctaaatacatagattggaattatcgaaaaatcacccaaaaaataccagctagatacacttcttccttctctccagtggttagctagatcgtcgtcccgagccgcgtcgcgagggcggcggctgcggctgctacggtggctgtcgggtcaaggctacgtatctggttgttgtcaccgtcgccgcaaccactagtgaacctgttcggtgacatcgccgtacggatgaggagtgagtcgagaagcgcctcgtgtggagagaaacaatgtagagagagaaggggaatggataagattgagagagaaggagagaaaagggcagtgggacgcaaaagcccgatattctctttccactcgaacgcctgatcgagccagagcattttcatatgtaatcgtgttcattcaccctatacgggcctccgcaccgatccaaagtaacagagaaatagggcaaaaaaatcgtgttcataacccgttctcgttaccgattcgacaccgaacaaggaggaggaatttaactatttgccacttttaggtttggcaattatccaaatacccttattaggtttgtactttttttttgcccctcttaagaggtggtcccttaactatttgccacttttgctcacgtagcatgccagcgtagcaaactcgggtgaaaacgttgtggacccacttgttaatctctcactgcccttcatctcccctgcgttcatcgccggctcgccaccgtcacccctcttgtacaccgcgcggccgacc

SEQ ID NO: 75512 - DNA, 7484 bp, Oryza sativa
atttggggatttgaatccgccgggtgtgtattgatctgacgatcaggttgtctcatatatgccccctagagggcctcctgcccaccttatataggatggggggcaggattacaagatagaaaccttaaccaatacggtatcggtttcctaaatcaggactttaggccgttccgtaatatacaaggaaacataacacccaagtcatgatctgttacatattacatagatataagttatcccctataactagtcggataaccatgccgtgtgggtatggggtacccataatctccacagtagcccctgagaccttcacagtcggaaagataaccttctctcgaactagattactccaaagccgagtgcttcaatcatcttcgtcatggtctcccgagtacttttaccaaatctgaagactgtggagggctgaaaaatatagtcaggtgcatcgactagatgcacctaataggtgtaacccccgactatgtggttaatcgaacaaaccaaacatatagtcaaggaataaataatccaaccaaccgagtggttttgataattatagtcaaccaagcgatttaatattaatatgtagcatatgcggtgtgaatccctgaataatatgatccaagtgatataccgactgctttgtaaaatatgatgagtgtaacctaaagttggctacattattgaaaattcacatagcaaaatagctataaagaagcttgtatgttgtgaataaagaaatttccaaagtattgggcatacgccatgcgcacactgctttaacagacgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggcaaaaaaatatgccttcgataccctttaaaggatgacgcatataacatgctcccgagtaacaaatcttccgggtaatatagaccaagcgtagctcatatgaatagcttctgatctgagtggttatcccttatgggatactccaaaatagatgtaacaatcgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagctgactatgatgatgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggatgattaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagaatttgccagtgccgaagataataaagatgaagtcgctccaccatgatgacaaagttgcatcgccgtgatgaagtgaacacaagtcggcggcaacagaagcaaactggtagcgaagacgcgcagttgtgaagataaaagcactagtcggcggcggcataaccagtcggcaacggaagacgatgatgtccatcagtagtggtagctgtataaaccagacgtagaggtgagggcactagtcagcagcagacgagacgaccggcggtgaagaagataaggccaatcaacactggcagaatcatgcagccatggaagtgaagaaaccagtcggcagccatggcaaacgtaggcagcttgtgttgaagatactgatgcctattagtagtgacagcaatgtagccagccgtgaagaaggtagcatcagttggtgttataacaggccagccgtgcaggcagtgacaccagtcagcggcggatgcggcggccggtcggtgaagacgtagacgcccaacaacggcggcataataggccagccgtgcaggcggaaacaccagtcggcagcgggaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcagcataataggccagccgtgcaggcggaaacaccagtcggcggcggtcgaggcggccggtcggtgaagacgtagacgcccaacaacggcagcataataggccagccgtgcaggcggaagcaccagtcggcggcggacgaggcggccggtcggtgaagacatagacgcccaacaacggcggcataaaggccagccgtgcaggcggaaacaccaatcggcggcggtcgaggcgagccggtggtgatgttctgactgatccattcctgtagcgtaagagataagcttaaagccatgaatcccttttatgcatatctggatctggatcctgcagaacaaacatataggatgagtagtatctgatataaatataatactcgagaaaaattcaagcagtttaaaatatgtatttcttctcttgttaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttggcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaatgaaataaatgatgacttagctttgtcgtattccctcgatgacagcagaagtagccgatgtgggaataaagcagtccatcaatggtgacaaaaacaccagtcagcgctagtggaaccaagccagtggtgtagatgatgaagcccattaacagcggcggagtccgccaaccgtataggcaaaaacaccagtcagtggcggcagaggcaggccggcggtgaagtcgtagacgcccaacagcggcggcataataggccagccgtgtaggcggagacaccagtcggcggcgacggaggcaggccggcggtgaagtcgtagacgcccaacagcggcggcataataggccagccgtgtagacggaggcaccactcggcggcgacggaggcaggccggcggtgaagtcgttgttgttatcagcaatggcggtggcgaagacaagccgacagagtggactcgcggccgatcgaccggaaagctgagacgcctcgactccatgaccagcattaatcgcctcaatagtgccgcgtaattatatgcgaacaacaacaaaaaatagcaagagattaatctgagattaaaaatcaatatgataaataatgataaaaatcagattgagtttccccctgactgatttggatcaagtcagagaagaggagcttgaagaagtggtcgacggaaaggaagtgaaaactcccgaagcgaaaacgaagtcggcgactcatgaagttaattccatcgtgctcgttgataggaaactcgacgcaacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgggtgtgtattgatctgacgatcaggttgtctcatatatgccccctagagggcctcctgcccaccttatataggatggggggcaggattacaagatagaaaccttaaccaatacggtatcggtttcctaaatcaggactttaggccgttccgtaatatacaaggaaacataacacccaagtcatgatctgttacatattacatagatataagttatcccctataactagtcggataaccatgccgtgtgggtatggggtacccataatctccacacccccttatcacaagaacaccaaacgttcataaacaagttaaaatctagtacacacttcgttctgcatcatgcatgtattgatcagatcaactgtcctgttggttcagtttatcgcagcagctgcagcacctgctggtggtggaggcggaggcggtggcggaggtggagcctctccgccattgctgccatctctgtgtgcatgctgctgcacatacaatggaatatcacttgtgcccgttccagctttcctcttttcaactgggcaacatatcctatgcacacacctaaccttctgcactcatgcactcggctgttataaaccctccgatcctgatctgacggacacgatgtaggtggggtgttctttttagaaaaacgcccgcatcctctatacagatttccagatgaccccttaccttgtttcctcttctccgtgctccttcctagatcgatccccatccccaaatcttctccctctccattgacgaaccatgcagtgagcagcaggccggccgcatcaccggcgcatgtagtatgttcatcgaatcatgcagctaactagacattaaactgggcggaactcaagcagggtcagagtccggctggcctataggcaacggtggggtagcgctcaggtcaggcccaagctgccttgatgccgtccttcaccaccggcacggccgtactgctgctcactgcctggttcgtcgctagctatagatcgaatccatgttatggtggtcgccgcgatggcaagcctcccgctggccgcattggatgcactcggagcatttctccattcttttcgttcaaaaacttctccattcaagtatttgtgctttgtgttaactgattgcaaaattatccgtgattgcaaaaggcacttaaagttgaataatgagttgtgtccatttcttaatttatctcgttattttcattaattggacatgacctacctagcttattgtaggcatggccgctgtcgtgccatgtttttttcctcaatcaggcactgctgctgcttgcatgccaggctctacgtgccggagaagagagacccgctagccgcgataggaaacggtaggcacgtcagtgggagacgattcttcctgccgcacggagaggttgaaggtttggggatgggtgttaacgccaaaatggtgtaagcccgaaatcatcatcggcttagtcactatcagcttcggcatctcggaatcagccgatgagaattatcaagtcgccaacagtcggattcttggaggattcggttaaggaaacttatctagaagagaccgagttcaaggaggatgtaacatgacaagttatctattaattaggaatagtttgttagtttccttttatctttagaaaagtatgtttagtgtccgataaggactttgtgttttccttttatctttaggaaagtttctttcttgtcctacaaggaagagtatctacccatgggtataaatatgtacacccggggtcattgtaaagtatctctcgatcaatataactactctcggcgcatcaccactctcttttccgaagtttttacttatcaaccggcggaatttggcacctgacgcggggctgcgtcagttcagttcgatctccggcgaaggggtaagtcatacgttccgctggccttggtgaatctatcggctacgttggtgttgttcaaggctgcatcgcttcgatctcttggatcgctctggtttggatgatatatttgcctacctgatttatgaactctatctctaattgcattgtgtttagagacgcatcagtttagttaggactgtcttagttaggtccgatcttctgtcttagccgatatatctctagaatcacaatgttgttctaaatagatttgttatatccatcatattagatagatctatcggctcatcgagtattaaattatcatatacaatttcgtgctgtgtcggttaggttcgaccttctagattgttgttgataatatagatcttgttaagccgataggtttatgctagtgttttatcggggtgttagccgataagttatctggacattgcatcggcttat

SEQ ID NO: 75513 - DNA, 6621 bp, Oryza sativa
ggccacgaggcggcgccggcgtcgatggggcggtcgcagccacgcggtagagagaagaggggcggcggtggcgagccggcgatgaacgcgaggggagatgaagggcagtgagagactaacgagtgggtcccacaacatttttcacccgagtttgccacactggcatgctacgtgggcaaaaatggcaaatagttaagggaccacctcttaagagggggaaaaaattaagtgcaaacctaagaagaatatttggataattgccaaacctaaaagtggtaaatagttaaattccccaacaaagcgatgtgtttttcctagtgtcaaccgaatatgactgggctatctgttcgtttctaatgaaaagagtggatgaaattttggatacttgtagcacgcttttcaaactgttaaacggtgcgtttcatgcgaaaattttctatatgaaagttgttataaaatataacattaatctatttcttaagtttgtaataattaaaactcaattagtcacacgatattaccgtctcgttttacgtgaaacacttaatctttatctacatcttcatcttcaggagattcgggagattaatagtacgggacttggctgagtttggattgaattggaatccaaaaatcattcgatttgtttaatccaaaaatccaagaaaaagttggatttccaattggagggggcaaaatataaaaattcactgcctagggtttaatgtaggagatcgaagaggcgtctcctcctcctcgccgtcgtcgctcaccatcttcccccgcaaccaccgccgcgccgccgccgatcgcctctgctctcaacgcacccaaggttagtatccatcagcttcaccccgcgcttcctcctcctccgccgcctccgcctccgccgccgcaagaagagctagcttgcctctttccccccagatttgatccgatccccccaacctgctctgatcgatcgattcttggaaatttcgcagccggggatggtgtccaagaagaagaatacaacggcgtcgaggcacaccacggagtcagaggaaggcacgcactcgttcgagatcgtcgggtatagcctccagaagggcatcggcgtggacgagttcatcgaatcggccaccttcgccgtcggcggctacgactggtgcatccgcttctacccccacggcaagggcgatggtgccaaggactacatctcggtgtatctcgagctcctgaccaagaactgcgccgtccgggcggcctacgacctgagattggttaaacatgccaccgggttgccaatgagtgtctactctgaaacaactcacagaatgttcaattctgatgacagtagcaaatttgctccgccttatgcgactttcatgaatagaagtaatctggagatggaagcgtcaggctacattaaggacgatcgcctcaccatcgaatgctttcttaccgtcatcgtcaaggaatcgatggcgtctaataccgtgaaggcccatgaattaatcaatgtgccgccgtcagatttatcggaaaattttggcgaattgttggagaagggggaagggtcggatgtgactttcgttgttggaggagagaaaatcgccgctcacaagatcatccttgcagcacggtcatccgtcttcaaggcggagctctatgggcagatgaaggagaagagggcccggcgggtaaccgtggaagacatgcaacctgatgttttcaggggcctcctgcatttcatctacaccgattcgttgccggacatggatgatctcagtgacgacgactactatgagatgatcaggcttttgcttgtggctgctgataggtatgccatggacaggatgaagttgcagtgcgaaagcatccttggcgagcatcttgatgtgcagaccgtcgcaactacattggctttagctgatcagcataactgcaatggccttaaagatgtttgcattgaatttatcaccaatcaaaacaagatggatgatgtggtggcaactgaaggctatgctgatctcaagagaacttgcccttctgtcttagttgatgtattcgagaaggcaagtaagttccgtagaatttaaatgctaatgaaccccttcttcttaggtggtgtctaggagtaggttctagttcttaaattgtataaatagcatgtctgttttgcaagagcagctctgctaacaccgggggttatatgtgctgtgttaagttatgatctccttttggggaaaagtgttagatgaacaatagttggatatcgatgtaaggatctgtcatagcctcaagctctcaagtgctgagtcgaacaacattagaaaaaagttccattccactgagtgtgggaatatagcagcataactagcaacacactgatgctgtcattttaatattctgttatatattgcctgcagagacatggcattttgcggcatgactagcttaattggtctttagtgccggtatgatcgtttaattgatcaatcattgcaataattttgtatagttgaaatttgtttggatgatcgtgttcatgattaatgtttggttatctggttagctgtaaggcttttaagtttcatctggcgttcgagtccaatggctaaacctggttatattgcaccaagtctatattaacgaataattactccatagctttgcgtgctcatgttttactgctacaatgggaactttggatagttcataattatcagaggattttattgactgcattggtgttctattagttatgcagagtaaaaactaattatcttttacaccagcaagcacaatatagagaaattctttaccatgttgaaccttatgaaggtggtaaaatgtaggcctgaacagcagtaaacttgaaattttagagctaaacaggtgctatgtaatgctgttctgcattgccccgattttttaatgaatgccctcttttccatccaacggtgtcaacgaaggttgaagatgatgtttggcctcatagaactgaaaactcaaaaatgttttgtattgaaacattgccctttagcctgaactcgattacttctgatcttgttactgttaaatgttaggatcaggtgtaatctgtagagcataacctgattacttggtaaggcaggttaatatgtgcatagcatttacttaattaggtatatgacatacatcatttaggaacttctgctatttgtttagtggtgattagtgaactctttttttaagggaagattagtgaactcatgagactcgcaaatagatgcttgattagtttgtattgcaaaactgtaagaactcaactttcagaaatattggaagcatttagccaagtccaaatgtgattttcattgtttctcttaactttgaatattcattctacaattatcctggcctgaaagctatcttgtgcaattcaaggtctaacggtcattgaattctcatttgttttacatttttataaatactagaaaaatgcccagcccatgcgttgcaacggggaagactattgtaatcttattattattatatggcttagttaaggtgaaattcattgcgttaaattcacttgatatatattttgttagaaaatcatgtgctacaattaagagtccgatcaacttaaattagcatgcgagttttttaaaagagattttttatatgatttcttctatatatttcaaaaatgaactaacttaaaaactgactcaaatatggatttgtgtttctaaaagcgaacgaacttaaaaaccgacttatatacagatgacgtaccaaaagtacaagcaaaagcatcctcaatttttataatagtagagatggagattatactccctccgtctcataatatacgggattttggatggatatgacacatccgagtacaacaaatatgtcgatgtgtcacatccacccaaaatcacttataaaacaataatttctactctcttcattttatattatcaaacgttttagccctttccatagtagttttactatatttattgaaaaaatagcaatttctacattatcaaattaatgttgaataaaatataattattgctatatttttttataagcttagaatttgactagaaaaaaaaactcagaacatcttactccctccatttcaaaaaataaagcacaatcacccttaacacaaaaattaagaaactattattaccatattttcgtttgaatcattttaataaatataatacatacatccaatagaattagaaaaattgagagtaaataatttaataaataatatttattagaaaataagtgctaatttaattacatgtattaatgcatatgctctgtattataaatatttttcaaaaaagtagttgaaatggagagagtataggtgggagtaattaataaattcaagcacatattaacggtcataattatccttccaaattaagcacacatgcagaaataacgggtgcaataaaaaattgcaactttctaccgaatgttaatatgcacatccatgcatgacattaaatattattttgtttcaaagttctctgaatatttttttaaaaatacagtataaacgcagacactcataatacgcgcacacacacaactagctctatgagcatattcggaagactaaagccgatatatatatcttgacatgacgaactcaccatgaatatcttgctgtagatgggtacgatatatctctaaatattattttgtttggaggttcctcacaaatgaaggtaattatgaattatgaaacgaaaatgcatcacatcaaatttatatatttcaaaatgaataacctctgttttaattcaaaatgtcaaattctgacatttaagataatggttagtaaggaaaattctgacatttaataaaaatgtagtaaggacaattcacaaatttaaggtaatggttagttgcacacagtgccttattccccataaaagagcaattagcagctaactatgatgtacggtgtttgtttttgaaatgaacatattcatgaacttttttggtgagcaccttctggaatcaaatcgacgaagcaaggggtgtaaaagaatgacttctccatgcccctattgtactcatttaagcgattacaacctaagtactgaaccttggagctcctcagatggtaagctaccacctcatctaaatccatcaagtagatgacctccttgtatggatgaaaccccagcaagtcaacgctaccaaatgtccacatgctcatctcctcttctttgttcttgctaaggtctccgataatgttgatgttatcatcatcagagttccattcagcactgtcttggtcttcctcctcatcgtcatcgtcatcagattcatctaggatccacattttgttgatctttgcatgatgccatcagaacaaaccttctattagcttggttaagggacaaaggttcacatcatacttgaccacccactttgtcagctcatgtgattcgtcgagtgcccacacccgaagttgaaaattctgacgttttgcatagtatatcccggtttctgatcttccaagaacatcttatgtgtatccgccaggtccatcaaatcttggtgttttgattacacggtacttagcacccaaaattgacagcctataaaacaccatgagaataattattttgctgtatagggatatgatttcaatgaaaatagctcagtatgaaaaatgttagggtttaaccgtctattccaatgcgatagaagatgatggatcacataatcatacaagaaaagacataatatatcaagtctaagttgagttatatgacaacaaccggtctaatgaaaagcttaaccattaaatggggttaaacggggtggattaattgtcttcatgtactttaaccattaccgacacagattactcagtaaacctcaaaacaactgcaacaacgaaatatagcactgtaactgtaaacctcaaaataacaacgaaactatcttgctagcacaaatataggatgactagcttaaccattctactgatgagtaatagtttactcggtagaaaacaattgtaaacctctcaacgaattaactgtcttgctagcacaaataaaggatgactagcattatacagattcatcattttaacatcatcactgatcactagttcgtgtacaaccaatgatcgattggtttctggttagtgatgagattttctacacatttggcccttttgcatttaagaaatcaagattaattatacctgaatagttggcaaccctttttagttccggttgtgcaaccggaacgtccaatctgggactaaagatgcgcatctagttccggttgaaacaaccgggactaaaatgcataccaagtcaaaaaaatgtgtgggatgtgggattcgagctcaagatctcttacctcagctctcacgcgcgttaccatcccaactaatacacacatctaacttggatagaggtgctttatttttaaactaacattggaggcatctttagttcgagttgatgttaccaaccgggactaaagatcaatttttattccaccaatctcaccaatctggactaaagatacttttagtcccgattggtgttaacaaagatcctccatctttaatccggattggtggga

SEQ ID NO: 75514 - DNA, 55895 bp, Oryza sativa
caggcgctcggcccagcccagcccagcccagcccagcctgaaaagcagcggccgcttgtccagaccgccgacacaagcgctacctgctgctggcgctccgctcctcgggtccccagaaaaaccctaaagcgttcgtccagcatgcatctcaacggaaagcccaagctcgtcgccgccgtcgatccctcctctctcagccgagctatttaaaccggcgaggcgagggcgccaccgtggaaaacctgaagcttctcttctctctctcgatccattcccccaaattcccgcttccgccgccaccgccgccgccgccgccgcagccagtctcgtctcgcgagcgtacggcgccgcctcgacccggccggtaatggttcctcccctcacttcccccctagctccctcttcgttcgtcttcaccggcaccgtcgcaaagctagcttagccaccggcgcgactacaaacggcgccaggcggaaatgggttcctcgacctcgggctggacgcctccatggatcggccaagatttccacccgagctctctcgccggtcgtcgcttcgtcgtctcccgctccggccgccgctgattcgatcttgtggacgtcgacttccgccgccgcctctgctccgtccatcgagccgagccgatcgacgtggaagaggcggcagtactgttcctactagctacttgcattggtcgagccgagccgagccgatgaactgtcacggttagcccgaggctgagccgaaccggttcttatgtgggttcactcaattttaagccggttcagttctggttctcaatagtccaccatattacacccaactcttcacctcaccctgtccatatgtgcaccacagatatcataaaatgatccttaaccttcggttcactagctagcttttctttattaattaattgctgctccattatatatttttcgatatttcttttactgttcgtttgtagtattttcttgttggtttatttgttgttgctttgtgtgttcatgcatgctagatcacaccaacagaaccatccgggcggcaagacatgacctcctccttccactatatcaaacatgcacctacaaaagcctgctatagttattttattttgtacttatttatgaagagtaatctcgtttgattagttaccatctatttatttaatacatgttatgattaattcttctttgataatcgtcaaaccatggttccttgaaaactaggtacatgtttaaattcttgagagaaatgttgtagtggctaatgtaccaaaaatcatctcacacacttggatatacctgccatatctcatgcaaaggcatgtcaagccaatacacattgattagtgggttactcacctagagtgacactgaagattatatatttttatattttttactattcatttgtagtattttctcgtatgtttatttgttgttgtttttgtgtgtttatgctagatcacagcgatagaatcgtcggaggggcaagagctaggtggaccaagaaggctacgctgacgttagcaaattaaagcccttgttctgcaaggcaagtcatgacctactccttgcactatatcaaacacctacaaagctagcctgctatagttattttattttctaattatttctgaagagtattaatcttgttagattaattaccatctatttgtttaatatgttatgattcttctttgataatgtcataggatggttccttgtaaactaggtataggtttaaattcttgagagtaatgttgtagtggctaatataacaaaaatcatcacacacacttggatatatcatatacctgccatcatgcaaaggcatgtcaagccaatacacattgattagtgggttactcacctagagtgacatagaaaattatatatatatatatatttttatttatttatttatttatttatttatatttatatttatatttatatttcttttaccgttcattcgtagtattttcttgtaggtttattattgttgtttttgtgtatttatgttagatcacagcgatagaaccgcagagctgcaagagctaggtggagcaagaacacgacgataacgttagcaaagcccttgatccataaggcaagtcatgatctactctttacaatctattatgctttaattatttatgaagagtattaatcctattaaattaattaccatctagctatttaatatgttatgacttttctttgataatttttgaaccatagtcattccttgtaatctaggtatataggttagattcttcagagtaatgttgtagtggctgataccaaaaatcatcacatgcgtttggatacccgccataatgcaaaggcatgtcgagcgaatatgcattcattagtgggttactcacctagagtggcgtggaagattcaagatccacgcggatggttgttttgcatatatgctatctatgattgcatgtatgggtctatacttgtggtggcatccgtttggagccggttcaagtttcttgtttgattttaatttttaatgtattatggatgcccaaatttttcctagtaaaattaattgtgtgttactttggaaagaaaagtaggaatagtagcaatccacaatgcaaaagtagccctctgcatcatgtgagttctaatgcttatagctgcagttgtattctgctgctagtgcatgtgttaacataacaagaaatctctccctccctatcaaaacaaatccagaacatgatatatcttcatgtgagcaaggtaaacattcatggaaatcacattgtaagcaccacattgtttttttaggataaagacatgtcagttttaattaatgctatgataatcatcatatgccctcctggttgctcagatcgattgctaacaaggaaacagatgattacttacattaatacgcttggattttaattttcggcacacttacacactatgcatatgttctttatgctaattaatgatatgcttgtggaatacacactactaaaaaaagatttttctatacgagagcccttgtagattgcaagtggaccgtaataagtcgcatcaaaaaatcgaacccttattttcgcaaatgactctttatgaggcccgcatccaaaaatttattttcgtagatgggcctcttaaggggccacatgaaaaaatgagcctattttctcatgcggtcctcttaaaggaccgcatttttgcatgtaggtctcttaagtgaaccgcatggaaaaatacccttcctcttctcagagatattttctcatcacttcaaactttttaactcctctccactctctcccttccttcctcctcctctcctctcctttgctctctccttttctcctctcttcgcctcctcaccgagtgcgacgagggacgactacggcaccaacgatggcgggcaagcgggcgggcggccggcgggtggtggcggcgggagcgggcggccggcgagcggatctgccacccccgtcctcgagagtgatggcggcgcgcggatctgctttacccaacctcaggagtgtcgacagcgggagtgggagaccagcgcgtggatccgccgtctccccgccaacggtgacgagcagatctgcagcccccgccctcgtagcgaccgcggagtgcggatttgccgcccccaacctcgggagcaggcgacatatttggcaccgccgccctcgggagcgatcacagccacggcgacggtgagcggcggctgcggcgagctcgtggatccccctcctctcctccctctctccctcgtcttctgcgatcccggcagccagaggtcatggggtagcgcatctatcggccgtggatccagccgggatggatctaccaacaacaagagcaacttgaacgtaagtcacatacgagttcctattgctagctccagcgatagcttgcctctatatataagtctataatgtcgagtatttatgtttgtacaccatcatcgcatcagttatattttatttttaattcgagaaactctgatcttgtaattaattaccttctggatttcttcaatatatgtatatctgattcttgcggtatatgtatatcatattgtcgtatgcagaagtgatggattcgtcgatgaaccctagcccattgatgtggtttgataacacaactcataacttgcttcgtgctgctgactgttatgggctggaaaggctgaaggccatctgcgagacgaagctttgcctggatattgatgtgaagagcgtgatggttatattgcttctcgctgatcagcaccagtgcgacatgctcaaacaggcatgcttctccttcattgccaatccgaacacactggaaacggtgactggaacaccagagtatcatcagtttaagagtttatacccaattctactaatcgaggttctggagaatgtttgcatacttcgcaaatgatagttacatgtcgacggtagctttatgctttattctaataaatacaatttagttgtgttgtttgggcatattaggttcatgctatattctctactgtatgtgtgaactttaattcatatcagaccaaattggatgtaatagtactgcccttttaatatcatcaattccagtggttttaatttgtttagtaaaataatgtgttggtattacttctgccatggttgtttattccacttatgatatgaggttgtgctagatttaatgtttagtgtgtgtgaaagatagaatgacgatggcttcatgtagggatggcaatatggatccctgttctccaaacgggactttcccaaggggcgggatgggagattattttgcccccatgaaaatgctgtagttgcaagtcctcctgttgcttatttctaggaagaaaataataattaggtttcagtttcatgcatgttcataataggattattattcccataaagtttataatccacattttctaacactgccacaataccactcatcactaacggctcaaaatcatatcatgctttggcttgggcagccgttacacagactattggtcgatgattagggggcttatctgttgttactgttatctgatctctctaatggcttaggattacaaaccgttacaaataagtcttactatctgtgatggtcgctatcccaagccatcattgattagtatatatcagtgatatcaatgatggcttagaattgtgagccgttatagtcttgttagactagatcttacacttgtctcaggacttcgtctataacagttggctattttgagctattagtgatgtccatggaaatgatttatatttttccctttttaatggctagctgcatgatttgctagtcatataccctttgaaagcaacataacacaatataatatatcacaaaaccatatataccacatatcccaaaagtttaaaacttgaaatttatttgcccttaaaatgttaaaaatgcaattcataagttttcctttgtaaccctttatatttagaaaaaaaaaatagaaaacaacaatcttgttccatctctcttagccaaaccacccatggtaaaaatacgagacgatcgacataaagtaatattcccaaggtctggcaaagcgtaaaccatgagaactaaacgtgaacaagtattatggcgaaaactgtgtggggttagcgttcaacatgagtgcgtcatgcctaaatttttagtgtggaataatcttaattagcgttcaacatcaagaatgaagtgtgcccctgtgtgttgtgttttctgattttctatgcattcatacttgatgtgcactaaaatgactaaggattgctttcaaggaacattcaaacaaatattagacattgtgagtagctagtcctctgttaaactggcataattttatcacatctcgtcttcatagttaatctattttcttaaaaactatattatttttatctcaatatctcatcttcattcctttccatttccgtttgaacgtaattactagttttgttaaaatttcgagggaatccatgcgtactagtatattgttagttgtgacctctagcttttctaattaatcttgttttcattcaacttatgtcatctaatttagtttcaacactaatacacaagctctagtgcactggtttgaaagtcaaacagcatctctctgatctctctctctctgcacacatttaatttgcgtgagaaataaccgattaatttacttaaaatattgttaaataagaaacatgatagtacggttcaaagataaatgaattaaaaaggcctatatataccctactagttttagttcatctaataaagtaatagtaaattactaggtacatactcttgtccattcgatcttaatcttgatactgttgaaacaggaacacccccccccccctccaaaatagaaaccgtgtaccgatgttttcgcaaaaatctcaaattctattcctgtttttagctgggtagcaatgtgaatattggtatagaattcacagtattttatatgtaagcaaccaatgaattgcacaagtacaggttcattagctacataactctttttttttttgcggggaagataatgtattactcatttaaaaagtcatcacagcctagctgtaatatggacttacaatcctcttccaaccagaaaccggacaaggactcaaccctagccttattagcaagaaaatgactaatccgattctgactgcgctgaactttcttaatgaagatttctgtccccttccatgatgagttttgcctcctgaacaagattggctagttctgatcgatctctccctttctcttttttttttttttttttttttttttttgcggggagatctctccctctctcattcagcatttggataaccgacatacagtcggtttctaccacgatcggtagcatcgtccactggaacgctttcaccaatccatcagcgcaagcacggagctctgcttccagcgctccagagcatttctgcagaggcctgcagcaagcaaaaatgggtccgccggaactgtctctgaggattgccccgattcctcataactcattaatgatgcataactcattaatctgtacataactcattaactgtattaagcacgaatgcatatatattttagcgttaaaattctatagtactgaaatatcttcagattcaaatgtaaattccaaaacaggaagagaataacgtgtgaccctcaattttggaagacaattaattaatttgtatcgtgactacattttcctgctgcttatctgttggtgagttgtaacagctatccatgaattactgtaactaacaattgcatgccttccatataaacacatcaagaaatccctcttctccatccatccatccaaatttaatctctagcccttgctagctactccttccgtttcacaatgtaaattattctagcatttcccatattcatattgatgttaatgaatctagacatatatatttatctagatttattagcatcaatgaatatagaaaatgctagaatgacttacattgtggaacggaggaagtagctaatcaatggatgcacctctcgagaacaaccagcccgcagtcccagaggctgatgcaccaatgccaccgacaccacctcgtacgcgccctgtgccccaaagcacagcaagcttataagccgatgcaatgtccagataacttatcggctaacaccccgataaaacactagcataaacctatcggcttaacaagatctatattatcaacaacaatctagaaggtcgaacctaaccgacacagcacgaaattgtatatgataatttaatactcgatgagccgatagatctatctaatatgatggatataacaaatctatttagaacaacattgtgattctagagatatatcggctaagacagaagatcggacctaactaagacagtcctaactaaactgatgcgtctctaaacacaatgcaattagagatagagttcataaatcaggtaggcaaatatatcatccaaaccagagcgatccaagagatcgaagcgatgcagccttgaacaacaccaacgtagccgatagattcaccaaggccagcggaacgtatgacttaccccttcgccggagatcgaactgaactgacgcagccccgcgtcaggtgccaaattccgccggttgataagtaaaaacttcggaaaagagagtggtgatgcgccgagagtagttatattgatcgagagatactttacaatgaccccgggtgtacatatttatacccatgggtagatactcttccttgtaggacaagaaagaaactttcctaaagataaaaggaaaacacaaagtccttatcggacactaaacatacttttctaaagataaaaggaaactaacaaactattcctaattaatagataacttgtcatgttacatcctccttgaactcggtctcttctagataagtttccttaaccgaatcctccaagaatccgactgttggcgacttgataattctcatcggctgattccgagatgccgaagctgatagtgactaagccgatgatgatttcgggcttacaccattttggcgttaacacccatccccaaaccttcaacctctccgtgcggcaggaagaatcgtctcccactgacgtgcctaccgtttcctatcgcggctagcgggtctctcttctccggcacgtagagcctggcatgcaagcagcagcagtgcctgattgaggaaaaaaacatggcacgacagcggccatgcctacaataagctaggtaggtcatgtccaattaatgaaaataacgagataaattaagaaatggacacaactcattattcaactttaagtgccttttgcaatcacggataattttgcaatcagttaacacaaagcacaaatacttgaatggagaagtttttgaacgaaaagaatggagaaatgctccgagtgcatccaatgcggccagcgggaggcttgccatcgcggcgaccaccataacatggattcgatctatagctagcgacgaaccaggcagtgagcagcagtacggccgtgccggtggtgaaggacggcatcaaggcagcttgggcctgacctgagcgctaccccaccgttgcctataggccagccggactctgaccctgcttgagttccgcccagtttaatgtctagttagctgcatgattcgatgaacatactacatgcgccggtgatgcggccggcctgctgctcactgcatggttcgtcaatggagagggagaagatttggggatggggatcgatctaggaaggagcacggagaagaggaaacaaggtaaggggtcatctggaaatctgtatagaggatgcgggcgtttttctaaaaagaacaccccacctacatcgtgtccgtcagatcaggatcggagggtttataacagccgagtgcatgagtgcagaaggttaggtgtgtgcataggatatgttgcccagttgaaaagaggaaagctggaacgggcacaagtgatattccattgtatgtgcagcagcatgcacacagagatggcagcaatggcggagaggctccacctccgccaccgcctccgcctccaccaccagcaggtgctgcagctgctgcgataaactgaaccaacaggacagttgatctgatcaatacatgcatgatgcagaacgaagtgtgtactagattttaacttgtttatgaacgtttggtgttcttgtgataagggggtgtggagattatgggtaccccatacccacacggcatggttatccgactagttataggggataacttatatctatgtaatatgtaacagatcatgacttgggtgttatgtttccttgtatattacggaacggcctaaagtcctgatttaggaaaccgataccgtattggttaaggtttctatcttgtaatcctgccccccatcctatataaggtgggcaggaggccctctagggggcatatatgagacaacctgatcgtcagatcaatacacacccggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggttgcgtcgagtttcctatcaacgagcacgatggaattaacttcatgagtcgccgacttcgttttcgcttcgggagttttcacttcctttccgtcgaccacttcttcaagctcctcttctctgacttgatccaaatcagtcagggggaaactcaatctgatttttatcattatttatcatattgatttttaatctcagattaatctcttgctattttttgttgttgttcgcatataattacgcggcactattgaggcgattaatgctggtcatggagtcgaggcgtctcagctttccggtcgatcggccgcgagtccactctgtcggcttgtcttcgccaccgccattgctgataacaacaacgacttcaccgccggcctgcctccgtcgccgccgagtggtgcctccgtctacacggctggcctattatgccgccgctgttgggcgtctacgacttcaccgccggcctgcctccgtcgccgccgactggtgtctccgcctacacggctggcctattatgccgccgctgttgggcgtctacgacttcaccgccggcctgcctctgccgccactgactggtgtttttgcctatacggttggcggactccgccgctgttaatgggcttcatcatctacaccactggcttggttccactagcgctgactggtgtttttgtcaccattgatggactgctttattcccacatcggctacttctgctgtcatcgagggaatacgacaaagctaagtcatcatttatttcattctttatatgatattttgtcttttcctttgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgccaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattaacaagagaagaaatacatattttaaactgcttgaatttttctcgagtattatatttatatcagatactactcatcctatatgtttgttctgcaggatccagatccagatatgcataaaagggattcatggctttaagcttatctcttacgctacaggaatggatcagtcagaacatcaccaccggctcgcctcgaccgctgccgacttgtgtttccgcctgcacggctggcctttatgccgccgttgttgggcgtctacgtcttcaccgaccggccgcctcgtccgccgccgactgatgcttccgcctgcacggctggcctattatgccgccgttgttgggcgtctacgtcttcaccgaccggcttgccttcgccgccgccgactggtgttcccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgccgctgccgactggtgtttccacctgcacggctggcctattatgctgccgttgttgggcgtctacgtcttcaccgaccggccgccgcatccgccgctgactggtgtcactgcctgcacggctggcctgttataacaccaactgatgctaccttcttcacggctggctacattgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagctaccactactgatggacatcatcgtcttccgttgccgactggttatgccgccgccgactagtgcttttatcttcacaactgcgcgtcttcgctaccagtttgcttctgttgccgccgacttgtgttcacttcatcacggcgatgcaactttgtcatcatggtggagcgacttcatctttattatcttcggcactggcaaattctattgctgctacttcgcaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattaatcatccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcctactctgctgccgttgatgggaaacttcatcatcatagtcagctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcgcctccatggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcgattgttacatctattttggagtatcccataagggataaccactcagatcagaagctattcatatgagctacgcttggtctatattacccggaagatttgttactcgggagcatgttatatgcgtcatcctttaaagggtatcgaaggcatatttttttgcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacgtctgttaaagcagtgtgcgcatggcgtatgcccaatactttggaaatttctttattcacaacatacaagcttctttatagctattttgctatgtgaattttcaataatgtagccaactttaggttacactcatcatattttacaaagcagtcggtatatcacttggatcatattattcagggattcacaccgcatatgctacatattaatattaaatcgcttggttgactataattatcaaaaccactcggttggttggattatttattccttgactatatgtttggtttgttcgattaaccacatagtcgggggttacacctattaggtgcatctagtcgatgcacctgactatatttttcagccctccacagtcttcagatttggtaaaagtactcgggagaccatgacgaagatgattgaagcactcggctttggagtaatctagttcgagagaaggttatctttccgactgtgaaggtctcaggggctactgtggagattatgggtaccccatacccacacggcatggttatccgactagttataggggataacttatatctatgtaatatgtaacagatcatgacttgggtgttatgtttccttgtatattacggaacggcctaaagtcctgatttaggaaaccgataccgtattggttaaggtttctatcttgtaatcctgccccccatcctatataaggtgggcaggaggccctctagggggcatatatgagacaacctgatcgtcagatcaatacacacccggcggattcaaatccccaaataggagtagggtattacctctcattgagagggcctgaacctgtctaaatcctttgtctccacatccatccacttttaggtctcgtgcgctaccccgttttattattgccgaattcatgtttcgacagggggattgtttgatcttagagtggtcaaacagtacccttctttagctataaatttctcgtatgagtaataatctgaaacatatattttgttcgatgaaacttacttgcttcttcaaactgagaaatgttgtactccataattctctacaaaatattttgcttaatggaatacttggcatatatctttatttaatgtgctctgtgctgtagtagttattatggatttgatccaaaatggtcatgcagtataccttgctatatctctctttagttgcaaaattgatttcaatttccagtatcaataatcaaaagcattattttgttcgatgaaaaattttcttgcattggttaaacttcataatattgtacttgcatattctctggttttttagtatgggagcattttggtatggaagattcgttacacaacaaacaaacaaggatctggaatgggttccatacatcgtcattttggtggcagtacaggaggttagggtagacagaaatgcaagaatttttcaaaatgaaataacaatatgccaggtaaaattaatcacgggaaagattgaggagcaagaacttgatgaatccctgggacaaataaacacctctttctgtttagcataatcacctataacacaggagatctagtatagacacattgtctaaatttctgcattttgcttaatttttctctgctgtactctcactactgtgaacctcacttacctagcatctctttcgtccccagctctatcgacgaaaacaaggtaaaccgagcactgactatactcagtttctaaaaataacttcataattattgaacacatactaactgtataatatgtttccccacgtgtgcgcagtaaattctttcaatatttgtgcaggtgtgtatttcatgatgaccttagtatttatttccccataaataaccacaaaatgaatattggtacttcagtttgtactgaaactatatttaattatattgtaaaatcattaatgagttatgtaattgacggacatagcaaatacctgctcaattcaatggatgcctacggtataagttagaatgcagcattacgagattatattcgtaacaaaactttttcaactgtttttatgcatattcaacctaaatgtttttttttttgacagcggagcaaatggtgccccccactccccaatcctcctctttgtatgtagtcgactagcattatttcagactcatgtgataagtttggctcaagggagaggagggagtatatatgtcaagatccatcggtgtaattatgtaaatgcatttacaaattatatgtactagccacctgcgaatataccaccactcatttaagcgctccaattctattgtccatcccacacaaggattgtgcccacccgatcaagatagtacttaaaaaacacaaaatccacttccaactacttttcttcgtacattgcttcccggcatcacgcgcatgttcccgagtacgtctattcccgatttttctttgccttccttcgtgtactctgattaggagaactatactgagaaggatagcaagatcaatggatagattcaatccaaatacctgatcatcgtctgtagttcctttgggtgatctcagttatagttcctttattggcctagcggcggatggtcatgcttagcggcgtttagttcgatgctagctagccttcttggggtctttgtgttcgtgctgtcgttggcttgttgcgtgagtggtggttatttttcttcgcattcctggttatgacctcccaaggttgtaatcttgtttttttttcctgctttatcaatataaacttcgcactatctggtgcgagtcattcggaaaaaaatacctgatcatcgtgggcctcaaccattgtttaattcggtaacagatctagctggtggttgctgcttgtcaatctgaaaccaaattaatgatgtgtcatttgctggtatagagtatagacaactaacagcagccgttggatggtagcttctacgtactctccataaggccttattcagtttggaggggattgaaggaaaataattccacaccacaataggtgtaaaattaatccactctaatcctttcctcacgaggattaaccgaacatggcatgagggattaggggatagagatgcagatgagatgccccttccgccgctggagattgcatcccatcgatgtcaccagataagatgagatggaaaaacttattttgtgatcatatgtttatttcccgtattctaatttctaatctcatcggatttaaaaaaatttctagtatcatccttattgttagttaaaaatcaatcaaaattagagcttttatatatgttgttatgctaagtaactaactgcaaacgtatgcatgtatagtgctcctatgcaatgtttccatcatgaattatcggctattcatagatcaatcggctacccattgatactggtaattttctattttgatagttcctcttccaactttcccaactatattgtgctttccacacaaaacacaatacaattatgatagtataagtttcccacgcgatatgagatttgattacaatagcagcaatttgtatatgtagaaaaagaaaaccaaagaaaaattatagctagcgtatatatagcgatcctaatatttcaatttaataattaacccataatagctcttgttccgctcgataaaactcaaagctcttatattgcctacacattgtaaactgaaactaagctctcatattgtctttacccattgtaacttccgagtatttttttttaagtctaatttaaatataaattccaaaacaggaagataatgactggtgattctcaaatttgtaatacaattaatgcttatcttttggcgagtggtgacagccaatcatgagttaatgcagccatctcgatttccgtcctatatgaacaccccaacacagatccctcttctctcatccacccaacttatcttctatccctagcaagcaagctctaatccatggcggcgcctcaggggaacaacaaccaggctgcagctccggcggcgccgcctccgctgccgccgcagccaccgaggccgccactgcgacggcaaccgctgctggaccagctcccgagacgcctggagcatgaggtttatatatatatccttgttccgatttgatggatcgatttcatccatttcttgtgatagatgttcatgcgttaatgagcagatcgtgatggtattttatggatggcttatatatatgtgcagatcagcaggattgatggtcgtatcagggagctagaggatgaatgctacaggcttgtctctgaaggacatgggtcgacgctggtgataaggtttaggattgaaaagatggaagctttgagggcaaagctgatatcccgttacctgcagcagcagcagaacgacgacggcggcgatagcaatggcggcgactctccgcctccgcctccgcctccagccgccggtggtgccgctgcggtgaactgaaccagctcatgggtggtgcatggtcaatctgcaattctgcatgatacagaacgaaatcttatatatatgtgcctttgtagcatatgatctgaatcatgtactggtacttaataatttgtttatgctatgaatgtttggtgtacttttgataatggatttgatcttagagtggtcaaacagtacctttctttaattataaatttctagtatgaaatccaaaacatgtttttgtttggtgatccttgcttattcacaaatatagtactccatagttgtctgcaaaatatttttgcttaatcaaatatttagtttttttttgccgataaaccattttctttatctacaaaaagtagttttgtgttgttcaactgttgggaaactctgtgctgtagtattgattatggatttgatctaaaatgttcatcagtacgtaccaatattaattacattttctttcttgtagcaataactctagttcgaagaaaaaacccctttgctttgttcaagctagttatctggctaatttgttgatgaaagctagctgggcctttattatatcctccctttatcatagaaaaagcttccactgcacaataatcctatatattattgtgaaaggaaaaattagaatagaatatgctatatatttttcagaaggctaagcctcatgcgctggtatgtggataagtacaagacggctgaaggaaccagcagtccaaaatgtttatgggatcattcaccaaagtgtctgcctgttgctacttagctacgataagaaatccatgcgtgctatctattttaacatcaagcgctcaccggaggctacaacctcagatctcgctggagacagccgccaccggtccaccaatatcgaaacagacaccctagttggtggagggttgacgaacgccggagatgggtgggagggtagccagagattgtagtgagagcactcgcaatggtggattttggggggtcatggtggtggatttggagaagatatctggaagagaggtgagtggtatgggttattttcttttcttttctcccctcaaatgccctgactagtcaaagtgtgtgcggtggaaaaatagttggtgcccgaagtgaaagtggtggtgcggaatgtatttattcagcgggatttcaatattgcgggaacccaaaagtgtgccctgacgggcaaaccacgtcaattcgtatatatcgttactatggtgaaagaacgtagagtaagaccttttatgatcaaataaaataattgataacaaagctggactatttcaatattttcaatccagtgagcactaataattcaacatttgaatgcaagattttaacacggaataggaaaaacgtggaaatagattgcaatactacatgatctcaaaacataggaacaatagaagtaatatcgtgttagctggtgcataagaatttagaattgaaacacagcaattttacaggaaatcctatgtgtgtgtgggagagagagagagagagaagagaagagagagaggggggggggaagagataatgtgcattggacttagctagcataggaaaaatgaaacatgagatatgagctcatgttaaatttcttatggagggatgtagggaagcaatccatacgaatcttacaatcctcttcctttgttccaaagggtctaacatacacaaattttaaatatattatatgaaaattaacttatagctcataaaaacttacaaaattgcatgcagaaaggtcaaatttagattaaaaaataaaacaaaaaccacctataacagagaaaaaaaaacacttacattctacaatgagtaatttcatgtgactgaatttcagcagcactccattgggccacttgtgcattctggccttgtgggcgttgcatttgtaggttcgaaacaaataggtcgccttgccttcctcaccgtcttctcctcctcctcgtccgccgccaccgctggcggccatcaccgcaatgttcgtctggtccgtcacttccccctcctcccctcctcctcctctccaatttctgaaacaccatgctccccctcttgcagcggcaagcatggcggtgccgaggaggaccaagtcgatgtccgccgtgaagacaaagcaaggcgtgcacgtgttggaggtcctggggtacagccggcacaagggcatggggggcggcagcttcatcagatccggtacaccaccagtgatcggatctttggtgactaccccttactgtcacgaaaagttagaatgccgtccccaagaactttgttgacagtatgccatcacaaaacgcctatcacacttgattggtcacgaaatccaatatttggtgacggcaagccgtcacaagttatttagtgactgtatagcagtcaccaaaaggctattcccctcattttgttgttttggctattttactgagagtaatgtgttagctgtagggaaaatcttttcatttggcaggggatgtttgtattcacctaattattctttttagtgataagcgatgtaccaatcaatagtatagtgactgtagcgaatctagaattattttagagcctgggctaacttcactaaagctattatttactatagaaattctatctcaattttcctaattatatgaaattttagtggattatccaccgacgagcccgggcaactgcttggggttgctgggcaatagattcgtcactgaatagtgaggcgtatgtggatgtgatgacacaaacccaatctctcaaaggtgctcaaaaggatacgatgagtgtgtgcacgtttataaggatgagtatgcgcgtgagtatatgagtgcctaaattataccatgtttctaaaaaaaacaataaaggtactaggcaactgatgaacacaatgccccgtacaccgacaacatacctcagtgagagtaaaaaaataggatcattggtgtttaccaatgtagccacacaccaatttatagaatccgtctgttttacaaaatctgaatttagattcatacaagtaattccaccttataggcttataccacattttgattttcttttctatctcgctttgcatcacaaatagcaatccaacctaaaaatccatgagaaaatatagagaacactattccgtgggaacgggatgacttaagtcactaatggtaaacgctatttcgatcagaaagacgatgcgcgcatgattttcacagagtgccggcactatgcatgtgtttttccttttcttgcacaagatttttacaaacaggtctccggcccatgtggaccgtttgggcatgtgaatctgttggcctaactacaattcatctatacctggaccgttcatgtgactttttttaaaactttttttcccttttttctcgctttgtttttaattttattttatttttggttgtgatgcttttaagatttagtatggaacagaaaaattgcattagcataattataataatcgtgtaatacacactatttttttctttttattcgatacctataaatatcagatccaatacgtgagtatcacgtatcagacccgatatctaaatattagatccgatacatataaatattaggcctggtacctatatgtacccagatccaatacctgagtattagacccgatacatatagatatcacgtccgatacctatatgtaccagatccagtacctgagtatcagatccggtatctaagtatcagacccgatacataaagatatgaaacccgatacctatatgcgtcaaatccgatacatgagtatcaggcccagtatctaaatatcagacctcatacatatagataccagaccagttacctgagtaaatattagacctggtactcatatgtaccatgtctagaatttagaatttaggtaacatgtatgtctaatatctaagtatcatgtacagtacatagatgaatcatatacggtacctaatacttacgaggcatatgtgcatcacacatcgtaggagacctgtacgagtatattgtttaatgacatggttggaaatgggagattggaatgacgaagcgctagaagcaggggaggtgatgtcagcgttataattgatctcccgttgaaacagaatcctgtggtgtagtagttctcaaaatccatgggcctagcccggcccacttaaaaaagcccatctatcagtcagataaaaataatcagaaagaggtaaaaacgaaaaaaaaaaagacgaaaacaactccgctgcggtctcatcgccgtcgtcatcgccgccgccgccgccccattctccggccatcctccgaaggttcgctcgctcccatggcttcccctccactccccactacttcttgctccaaatgtgctttctcttttttctctcaccccaccctgacatgttgccgttgcttcttgattccctccccaccggcaatccaccctcgccgccgccgcctcaccagatggcgcgcgcaaagacggtgtcgaagtgcatcacggagacggcggagggaagccacgtgttcagcatcaccgagtacagccagaagagggggatgggcgtcggcaagtgcgtccggtccggcgccttctccgtcggcggccatgactaggccatccgcttctactccgacggccatgggagctccgattacatccacgtctacctcgatctcctcaacagaggtgtcgaggtgcacgcgtcctccgacctgaggctgctcgaccacaccaccggcctgtctacttcagtgacaaagacattgcccaaagtgttaagctgctatgattccagtagttttgcttcattggctaattggtcgaggcatcggcgtatctccgcgacgatcgcctcgacatcgagtgtgttgtcactgtcatgaaagagccacgggtgtctcagaccaaatcttcccccaaagtcgcggtgccgccgtcagacatcgcggcgcatcttggcaagctgctggaatcgaaggaggcggccgatgtcacattctatgtcggggaggatacctttgcggcgcacaaggtcgtgctcgcgatgcgatcaccggtcttcaaggcggagctctttggcccgatgagggaggcgggggcacaggtcttacccatcaaagacattcagcctgatgttttcaaggccctgctccatttcatctacactgattcattgtctatcattgatgatcttgtgggagatgaccgtggtgaaatgattcggcacttgctcgtggccgcggatcgttacgccatggagaggctgaagctgatatgtgaaagtgacctctgtgagaatcttaatgtgcagactgtggcagctaccttggctctagctgatcaacatcattgtgcgtcactcagggatgcttgcattgagtttatgtcctcttcttcaatggatgatattgtggcgacacaggggtttgtagatctcaaaacaaattgtccttcagtcttggtggatgcatttgtgaacatgagtatgctcaacaaaaggtagactagcagcttcctgtttaatgaacctgtttatttattaggagtgagttttcaaggtagtcaggacctcaggtcatcaaaagctaaagctattaacggttagtttagtatttgcatgaacaccttgctacatatttatctgctgaggacttgatgagatgaatatatatattaaatgtctacttccctacaagcttgatgttttcccactaggatttcttcttagttttgaagttagcctttagctgatcagtacaactatgacaagcttaaggatgtttgccttgaattttatgaccgcttcagcggtgatagatactgtgttggcaacacaaggttataagaatctcaagaaaaaaaagatacacttctgtcttagttgatgtattggaggaaagaatcaaatgttataacgcatgagcggcacaactctatcttagactgtctctggttagtttagtttttgacctgaatgagtagattgctagtctttgatttctagagagcagacaatcttttcttgtggcatcatcagtgatcagcttgggttcttaaatgcatgatgaggagcctcatcatcagtgatctaccttttgctagagcagctcatcctgaattgaacacatggatgaggagcctcattataagattacctatcagattttactggctacaagagttttaaagcatgctctcttcttagataaactcgtacaagagttctaatggctagtttgatcaataatttttgggtaaatcttactggttttatctgttgatgaactgaacatatgaatcgttttgcttctgtgaaaggtctatgttccaattatataacttttttcttataatattatatgcaacatatttgttcctgtttattcccatgcttaatactgcatatcacagtccagatggtctaaatcggatgtagatttagtgttttacactgttatggtctcatgcacatcaacaaaacagagtcaagaataatataggatgcagttgtttagtggatatggaatactaaataaattggaattatgttggtgctgtcactggggtgattgtattttggtggaaattcattttcaccattccgattggttatgaattatgtgatcaacaacctcagagagttcttagagggagaagatgggtatcgtccaatacagagactaacttaaaaatagcttgtagcgttaggcaaatattctacatcagcaatcacaaagttaccagctgtaatatgaaatacttgagctccatggtcttagttgacaatgttgaagggataaatgatgttaactgagggccctgtttagctcttaggcctgtgcatattgttattatcttaagcctatgtttctattgtatttcagaattgaatttttgaagttttgatatttgaaccctgcaatacactgtttcatgacttaataaggagcacgcctcttgttgtacagttatgtggttttttaagcatcattgtacattcatgcgttgagaacacattttacattaatatcttatgaaaacacaaacatgtatcagtacttcgtttttcttttttggagttactgttaaatgctatcccctctaacaaaacttaaaggttgatacaccctttataactagttagtacttttgcacggaatttgtgagatacttggacttggtactttatctgaacctgttctggtctgtgaaccagcctaattatcatctataccatctaatacatgttgagatagtgagattctgaagtatgaattgatatgcttggtgttgcgatgacaatattctgtagcaatatgaatcagtatgcttggtgttgagatgatgaaattctgtagtagtatgattcaatatccttggtagatttaagagtagaattctactctcccgttttttaatgtttgacaccgttgacttttatagataattaaatttgtccattcgtcttattgaaaaaatatataattattatttatttgttgtgatttgtttaatcattataaacacattgagcaagacttacactattttaatttccacatggatataattcaatcccactgactagctgagtgctgagacccgatgtatcggttgatacccagttcctatgggctcgaggagagaacatgttatgtggaaaatacaaagtgaactggaatgggtctgtagaccaaaagagctaggattgctcgacttgcaactcttctcttgtgccctacatgtcagatgtctttggtacgaatggacatagccgaacaaaccatggctagggttaccagttctgtgtgatgaagacattgcactctttaatgttgcaatagagatcacttcagaaatggtgccaagtatatagacattcaaaccctcagttgtagtaccaactctcttccaagtgttgatggcgggggggagtacatgatagtcaaagatacactcaccggccagcaatagatgggtcgcggagttacaatccctactcttcaccactttgcagcatttccatgaatttgtctatctttggcctttctgcacatggtgcacctccaacaaataccgatgacacgatccgatggaaattcacagatattacatccggcacaactgatgacgaacaggaacaagtgtctaaggtcgctggctccattctaagtacggcccagcaacggcctgttcgtgtaactaggcccaacccgaagtataagggtggaaactgggttaactagctgtatataaaggagagagagagaatcgggagggaggacatgtaaagacagaattcccaactcaatacaaactcaatctctctctacaactctgtctttctctctgcttctcttcctctattcctctcaaactttctctgattctctgaaaatatcttacttctcttccaagttggtaacatttggtatcagagccgcaatcctggagaaacctcagttcaaaactcgtcttcagatccaagtcgacgacatggcgaagcaaaacgagggattcgagaagactctgttggagattcaagcggcaattggaaccatggtcgtcaagcaaggagagacacaagagatgctgctcaaactggacaaatctgtggcgggatggcgacctcaagttgatgctgctgtacaagggttgtagcacgacatgtaggagctgaagctgcatgtcctcaagttggagaagcagagcgaggagggcggcaattcgtcgaacacctcgcaggcgtcaagggtgacggaggaagggggtcaccaagctcctctgcttcctacgcccagcacgccgccgttgttttccggaacagcggcgagcgatcttggtccagatggccaccgcgtcacaaattttcaccgggggaaggcaccgggggtagttcatactctcgggccacctccggtcaagggtacgtaccagattcccactgaattttctgttcctcatggggttgagtttggcgcaaattcgagtcggggaaatcgggatttgcatggggagcaagggttcaatcataggctaccgaagttggatttccctcagtttgatggttcggatccacagggttggaggatgcgttgtgagcattattttggggtttatggaactcatccaaatttgtgggttcgggtagccaccatttacttcatggggagggcaacgtcttggctacgttcatctcgtgctcatgaagtttttgtcgattggagtcgattctgtgaagcggtgaaccaaaaattcgatagaaatcaacatcggcaactgattcgacagcttgatcagattaaacaaaccggttcagtgagcgagttttatgaacggtttgatgatctgatgaatcagttgttgacgtatgatcctatgtataacactttgaatttggttcaccggttcatagaagggttgcgttttgacattcgcaaagctgttttgttacattgtcccgaggatttggagtctgctctggttttggttctattacaggaggagttgtctgagcggaatcaagagcaaaggaaatttgtggatggatcgcagaagtttaaaaatgcatatccattaccattgccaccaaccaaggttttgaaatctgaggagaagaaaggcggagagctcaatcggggtactaatctttctgacaaggttagtgcacttcgatcgtttcgtcgtgcacaaggtttgtgttacttatgtgcagaaaagtggtcgccgacacataaatgttcaggaacagttcagcttcacgctattcaggagctctttgcactatttcctgacaatgcaaatgaggatcaggctggcatatcttctgaagatagtgattcttccttgttagctacgtcagttcatgcagttcagggtactgattctcagtctaccattcggttacaaggaaaaattcaggggttgaatatactgatgcttgtagattctggtggttcggctagctttgtcagtgatcaattggctgaccgtcttactggagttcagttcttagctcatcctctgtctgttaaagtggccaatggagaggtgttgcattgtcagaaagaaatgccttcagatgaatggtttgttagtggtcagaagttcttgaccacatttaaagtggtggccttgggaggttatgatgcaatcttaggcatggattggttaactaagtatagtccaatgcaaattgattggcagcataagtctattcacttgacagttatgggtcatgaggttttgttgcatggggtacagtccaatacttctgattgtgccttgatttctagtcagcacttacagcatctgcacagtatcgactcagtggcaggtttggttcaattatgtgctaccctcagtgactctacagaccagttatcctcaattccagatgctgtccagtctttggtacaggaattctctcatctatttgaggaacccagtggattacctcctgctcgagattatgaccatacaattcctctaattcctggggctgtgccagttaatgtgaggccttaccattatacacctgcccaaaaagatgagatcgaaaaacaggttaaggatatgttacaaaaaggaattattcagccaagtgctagtcctttttcttcacctgttttgttagtcaaaaagaaagatggcacatggaggttttgtgtggattatcgccatcttaatgctatcactgtcaaaaacaagtatcctcttccaataattgatgagttaatggatgaattggctggtgcttgctggttttctaagcttgatttgcgttcggggtaccatcaaattcggatggcagttggtgaggaggctaagacagcttttaaaactcacaatggtcattttgaattcaaggtgcttcccttcggacttacgagtgctccagctaccttccagggtgtgatgaatacagttttagctgatcaattgcgtcaaaatgtcttgatctttgttgatgacatcttggtatacagtcgcactttggaggagcacaagaatcacctgcgtcaggtgtttgagactctgagtaagcatcagttacgagtcaaattgtctaaatgttcttttgcacaaactcaactgtcttatctagggcacatcattagtgctgatggagtttcaacagatccagaaaagattcaggtggttcggcaatggccagttcctgtatctgttaaagatgtgcgtagctttctaggtttggcagggtattattgcaagtttgtccgacattttggcatcattagtaaaccattaactgagttattgcgtaaagggcagccttttatctggacacaacaccatcaagaagcttttgacactttgaaacagagtctgatatcagcaccggtgttggtcatgcccgatttccagaaaatgtttgtggtggagactaatgcttctgaccgaggtattggtgctgtgcttatgcaagatcagcatccggtggcatttttgagtaaggctttaggacctcggactcaagttctttccacttatgaaaaggaaagtctggctattattctcgctgttgatcattggcgcccgtatttacaacatgatgaatttttaattcgcactgatcaccgcagtctggcctttcttgataaccaacgattaaccatctcttggcaacataaagcaatgactaagttgttgggtcttcgttatcgtattgtgtacaagaaaggattggagaatggagccgcagatgatttatctcgtagatcttctgatggtcttccaattttaagtgcattatctgttggtttaccggattggttacaggatgttgttttgggttataagtctgatcccgaagctcttcagcttttgcattcttttaaggaaggcacatctcattctactcattttgagttgcagaatggtattctttatttcaagaaacgtgtttgggtgggcaataataggcagcttcagcagcaagttctggcaaatttgcacactgctgctctagggggccattctggaattcaagtaacctatcagcgagttaagcagctgtttgcttggccaggtttaaggcaaactgtgcaggattttgtgcaaagttgtgcagtctgtcaacaagctaaacctgaacatgtgccttacccagggttactacaaccagttcaaatacctgaacatgcttggcaagtcatatcaatggattttattgaaggattgccccgttcagcctcttataatagtattttggtgattgtggataagttcactaagtttgctcacttcctgcctttatcccatcctttcactgctgtgtctgtggcgcaattattcatggacagaattcattctatacatgcactaccgcaggccatcatttctgatcgtgatcgagtgttcaccagtattttttggaaggaattgtttcggcgttctggcactcaattacgaatgagctcttcttatcatccacaaacggatgggcaaacggagcgcgtgaatcagtgtttggaaatgtttctacgctgttttgttcatgcctgtccatctagatggagccagtggttatctcttgctcaattttggtacaacacttcatttcattctgccttgatgttgactccctttgaagcaatgtttggtcataaacctcgtcattttgggctctcggtggattctgttggggtgcctagtgcattggaatgttggatgcaggatcatcataacatgcaaagcttgattcatcatcatttggttcgagctcaacaacgaatgaagagtcaggctgattctaagcatactgatcgcgtgtttgcggtgggtgattgggtttttatgaagcttcaaccttatgtgcagcaatctgtcatgactcgtgctaattagaagttggctttcaagttctacaggccctttcagattcttcagcgcgtgggttctgttgcctataagttacaattacctgccaccagtttgattcatccagtggtgcatgtgtctcaattaaagaaagcagtagctgcctctgaagttgttcaatcaacattaccacgtttggatcctgattctgggcatctggctactctagtagaggttcttcaacagcggctacgtcgtcgtggtgataaaatgattgttcaagctttagttcgctggtatggtacttcgtcatccaccacttcttgggaagatcaggaggagttaaggcatcgctttccttctaccacagcttggggtcaaactgtgtttcaaggaagggggaatgttacatccggcacaactgatgacgaacaggaacaagtgtctaaggtcgctggctccgttctgagtacggcccagcaacggcctgttcatgtaactaggcccaacccgaagtataagggtggaaactgggttaactagctgtatataaaggagagagagagaatcgggagggaggacatgtaaagacagaattcccaactcaatacaaactcaatctctctctctacaactctgtctttctctctgcttctcttcctctattcctctcaaactttctctgattctctgaaaatatcttacttctcttccaagttggtaacaacagagcacgccaatatactgcaaaatcaacatatcggctccaattcgaaggtgcagttgcaacatatttcaaaaatcccatccgggatacatagaccccgccaaaatattaagttcttttcatggctaataatcgaaaatagagtttggacagtacacatgctgcaaatcaattgaccaaaccaactacattgttgctttgccgagcagcacaagaaacaacgatccaattacgtccgcattgatgcctttccaagagaatctaggaaaatgttggcatatggttgcaactacacatcaaaccatcaaagtggacaaactacgcaaccatgcaagagtggtggacaacaagaagctatgcgcaaaacacgccaaaaagccacacaaaatgatccaagctatttgcacatgatcaatcgagtattaaatacaataaacttgaaaatgaatatacttgatttttttaaaaaaatatatagaaaacttttgcacgaattaagcgtattgtttagcggttcgagaaaagtgctcatgaagaacaaggaaatagcttatctgactagctaattagaactcaggctcacactactacaaaatggaagaattgtaggaggtcagaatcagttttcacatacgaataaatggaccgcttgcaaccataggctattaaaaatcgaaaatgtttgcaggtagtttttatcctacctgaaaaagcctattttcacatatgggggcactaccattcccaaaatatttctgtcatacctcgtaaaaagacctgccattcccaaagataaaatcaattgagccttcaatgaagcactcactaaaatagcgccagctggaaattcttattattttcgcttgtccgtcttgatcaatgggctttggagccagggagacattttaagtgtaccaaaaaaatgcattagtagaggctaattgaactctcttgctatatcaatatatatatggcattttcttgcctacatttcaaaagataaagaaaaactaatgttcttagctataatcatgttgtgtgaacatcaatagaagcgttctaaaatgtaccattcttagcactgttttatcaaacaatggttgtcaacttgaacccctggccttgaaacgtaatgtttggctttgacatatgcattgttaccttttcactataagataaaggtgtacaccaatatttgcttcaacaatgtttgaatatttatcaaaattagaagtctaaatgcaaatgtttataagtatattcctcttattgtgatgttgtttggaataatttcaatttctacatgcacaatactgaaattgtagtagttatgggaatcaacatagaaaacggaggggaggatacaatgtataaggaggtgggggccaaggcccccagtcaatttcgactccacacttatacccatatatttatgtcacttggcccccccaatccacatgaccaacaacctctacctctgttctgtttttttggaatacactcatgtgccaatctagtagtttatttctccccttcaattggaagcatcatttctagttgtttgtaccgaaattaaaatggttactttatgtctctaaattgttatatcaattatgaaggtatattgtaagggcattttttttctaatatagctgtccacactcaaattgttgtatctgtgtccacccatagaccatatgcaattgtgtaggcggctagaaattggcacaaaccgttcttgactgaaacaatgttgaggtgaatggaagaagctgtgagatctatatcatttcacgcaactccaagcacatgaagatgctacatggcttgtgatactgagaccaaggcaggtacaataaagctgtgaagctaaaatagtaagggaaataacattatgtgccatttacacgacaaatcaatatatcaaattagaaaatgacatgtgtaattgcgtcacattattgtgtgtggtatctgctatcgcaaaaaaaagcctggtgcataattataatctcccttcactacttcagcatgctgcttcattctccctctgttttttaatatatgatgttgttgacttttgagatatatttgacaattcatcttattaaaaaaatataattatcttttattttattatgacttgatttattgtcaaatattctttaagcatgacttgaatttttttcatttgcacaaaaaatttgaataagacgaatagtcaaatgcttgtcaaaaagttaacatcatcatatattaaaagatagaggtagtagcttttagttattatactctctgctctaacaggttcatccagtcgtgtcagcatgtcttcagtcagtttaggagtgatgtttgtgccaatttccagccaccaattgacgcgattaaacatgccatatttttaatttggtatattgatatgtcctgcaaatggtgcataatgttatttccctctactttcagggtttattcggattagaggaacttcataggatttttggaggaatactgcgtataggaatttttttcctttcctgtagttcggatcatgaaaactggttgtaggaaatccaaaggaaagtttcctttgatgctgatttcacaggaaaagtacatgaaaaatccatccacctcgagctctttttttcttcccgcatgcaaatcctaggcaatcaatttcctgtgatctaaatgctctcaacttttgtattcctttgtttttcatttatctgttttacacttagattccttttatattcatatacttttcctatcctattttttccttcctataatccgaacattcctataatccgaacaagccctcaacgtattgtgtcacaaacactaccatcgagttgagtattggtttcatttttctaaatcaacggtgggttgagacttcacatgcatcctacagtattgcatcctagtatttttgtagacttaacaaataagaatgcattaagatgttcactggacatggccataaaaggtagcatcttcacgattgcctcttcctgtaaattgcttgagaacgcatattagcagcccatgatcttatcggtactactatgaaaagacaatggtagtagtggtgatcagtctgccatcaccatcatcactgacatttaggcaataatatcggtaaaacacatgtaaatacgatgcttgctctttgtactgatgtgctctataacagttggggagcttaaaattctgagaagcagctgctgagaagctagctggtgagaatctggagaaactggaaaacccagcttctggcttctagtatattttccagattcccagaatctgggtaagaagctggactatttgggggagcttctggcaactggagattctaggagaagctgcagctgctagaaactcctccaaacaggctctaatactgtctccttcagtgcggaaaggaaaaggcatttggatttgggtgagtctgtagttaggctgcagctttttaattttctgagcataaacatttctttttgttttttaagatgaaaaatcttggttcgagaccaattacttttgctattttcagtagtccgttgcaatacatgagcatttactagtgaagggaaaacataaagagtacttatcttcacatggcccaaatgaataccttgcaacacagaaaaatagagagagatccaaaacacatgagaggggagatgctagaactggaaatcaaacacacggtggtagatcaaacgatgtgcaaggggaaagaagacgaagcaaatcaagaacaatggtctcaagtgttgtttcaatttcttcgcttttcagccatcattgtgtttcacctctcccaatttcacaacatattgggtctaattctagtcctggaagcaggaaatgatttgtattaaaaaaattgcagttaagttttttaaatacaagtgtctctgaactttaatatataagtatgtaagatgcaatttgagtaaaaatcatataaaagctagtgcttcatataaagtttcccagttttaaattttctccatatattcattttctcggctttatcaaaacatacatgtgaaaacttcttgcaaacgaaaagatatgatacgagaaagtcaacaagagagagtaacgaaagcaataagcaatggcagcttagcagtggaactggactaaatcaagagcagtctcttcaaagagccggggacactcgttgctgttctcactataaaactcttaagagtgtaaataatctgttccctgacattattgatgtacttcagtatattgagaaagatggtccaaatgatgggaaaaaatgtcaagcacgtggtcttttggattatgtcaaggattttgacttcgtgtttcatttgcacttgatgttgcttatcttgggacatgcaaatgctctggcactgtctttacaaaggaaagacaaggatattttggaggccatgttagaggtgaaattaaccaaataaagatttcaacaagttcgggatgatggttgggaatctcttttggagagatcatactcattttgtgaagagcacggtctccctaaattggacatggaagaagagtatgtagatcggcataaaccaaggagaaaaactaatcgcactaattatcaacattatagatatgattgcttgaatcctattattgacttgcagctcacagagttcaatgatcgtttcaatgagataaattctagcttgcttactcatatggctgcattcagtccaaaggattccttcgattcctttaagcatgaccatctaatagagctagcaaagtcctatccggatgattttgatgcaaggcaattgaaggatcttgatcatgagcttcagatttacattgacaatgttcgagaagatgaaagatttgggaaattaggcactatttcacaactggctaagttgatggtcgatacaaaaaaacatcttgcttttcctttggtctatcggagcctcaagctagtgttagttcttcctattgctacggcatcagtggagagatgtttttcagcaatgaagattgtgaagacagcactacggaatcgtattagtgatgaatttatgaatgatgctatcttatggttcgtggagaaagctttactagctacaattccaaatgacgacgtgatagctctctttcaaaacatgggaattactcgtagggtggaggtggaagtataataggtaactattgttgacattttatatttcgttggcatatattgttaattaacttgtttactgtattttttttcaatctattattaatccattacaatctactagcatatagccctgtacaatcatgaatcgtcaatcagttagtgttaaatttttgaacaactagttagtgttaaaaattgagagtgacactggtgactatttttcctggatccgccactgatgaaaaggaaccatataacaaaaattaaaatctgaacaatcaggaaatcagatttaactaatgacaaatttagctgcaaaatttgtagaatttttggggtatattcattgtcctatcaaaatcaaaaggaaacaaactgttaggcatctaaaaaaagtacagatatttcatcatacaaaaatgcaatggttgggctcccctaagttctaaaaatgcattccagaagaaattgcaatacccttcagtgaaaattgcactataatttgcactgcaaatatatcaaatttaatatgcaattttgaattgattattaccttccatgagtcctgaaatcaagcacagttttattatttcatcaatgactctcttttttcttctccatggttctcttcttcttcccttcaaacagctgtaggagctccatggaaatcaatctacatatatcaaaaataaagaaataactgaacaattagatttaaaacaagataagtgagaactgttggtacattaaaaaaaataaaaatgttgcatactgccatgtagtgaaaattacattatgagagttgcactgccactatgagagatttgcatgatgggggtaattggaggctggtgtttagaagaaatctttatgagcggagagaagagcttgctgaactaaagagtatgattaacttgtgtcagtttgatgaggggaaggagagggacaaagttatattatttggcctataataggaagaaaaccttgttcactaaatgcatacaatgtatagaatatacagaaatggtggaggtgtggaagagcaaaatcattttctcttgtggtggagaatatacaaaaaccttgttcacaagcattttctcttgtggtggagaagctgccatgtgctttagaacaaagtgatggggtggggggggggggtgtactatcctttgactctaagtggccgatactatataggaatgtttcctcatagaggagggaaaacttttgtaataagattgaaactactaatcacatcttgtttgaataccctttagcaatccctccgaaaaaatcttgtcgatttcagggagtgtttagggctgctgaatgagaagaataagtccagagtgtgggtgcgtggctagtggctagtgtctgctgggttttgtggcctgttagaacttacaaatgattgggtttttaaaaatgctcttataaattctcctttgtatgtcatttataattccatatccttcttataaaaatatagcatcttgctaaaataagaagatcaagttattctagaatggtggcacaaagcgattttggagcagcttttttttaaaaaaatgaagaacactagacattgggatgattctggagcagctataacaagtgaagccgtggaatctgtctgtagtttcctctacggtgatacggagtatgttattgtctggtgtttgtgcttttttgatgattgttgccgcctgcagcatggtgttacgagctgtgcttgttggtgttgggttttctcacaaagtcagaccaatataataatataatctatttcaagaagacgaatgaaaaatctcaattattttttatcaattttataaaatcccacctattaggatcaaattgtataaaatcacagtgattgacatgacatattaataaattatgtttctaatgtttcgtaaaaccacgttgttaataaatctgatatactcatatatcaaagtttttaaaaaaaacttcagttacatggatatatcatttgtatgattaataaaaaacaataaattggagatataattatagaaaaaaatatgatagatcatatcaaaatgatcaatagtggttttgtgaaactttataactatataataattagggttattttttatataccaaaatccctatagttttgtgcaacttacaccatataatacctagggttaggttaaatttactctctctttttttggaaaaaaaaatcagttatagcgccagccggcaattccactcctgatcggagcagagctaaccgaaaaatcccaacaaaaaaaaaatccgcaaaaaactccgttccgttccgtctaaaattcaccgcggatattaccaccttccgtttgggctcggcccaatctgctattgggctccctcgtcctcgtcttcccctccatccgccaccgccgccgccgccgccgccggcgatcttctcaaggttcgatcccctccaccctctcccctcccctccgccgctccggcttgccgtactaacccgcccttccttccttcgcagtgccgccgccggtggttcgattctttctttctttctttctttcttttttccccaatccgttcgtccgccctccacctccgacgcggcggcggcggcatgaagcggcaccagatggagtcggtgccgaggacggtctcgacggtggtgcccaacacggcggaggccacccacgtgttcgacatcgtggggtacagccagatgaaggggaggggccgcgaggagcacgtcacgtcggggaccttcgtcgtcggcggcctccactgggccatcctcctcttcccggacacccacgtcatcctcctcgacgacgaggaagacaacgtcaccgccttcctcgagctccagagccaggggggaagcaaggtgcgggcgtgctgcgacgtcaggctggtcgaccagaccaccggcctcgcctcctctgctgcgccggcgcagccggatgccaagacattcaaggtgttcaatgccgatgaatccaacagggtcagctgtctcaagatgaagaggaccgaattcgaggcgccgccgtatctcgtcgacgatcggattaccctggagtgtgtggtcactgtcaagaaggagccgagggtgtcgagagctagaccagtcccgaggatcaaggtgccgccgagcaacatgatgcagcaactcggcgatctgctggagtccaaggagggggcagatgtggtgttcgatgtcgcgggggagaccttcccggcgcacaagcttgtgctggcgatgcggtctcctgtcttcaaagcggagctatgcgggccgatgagggagagcgggacagagcctatcagcattgtggatatgcaaccggttgtgttcaaggccctgctccagttcatctatactgattggttgccgtcaattcgtgatcttgagggagacgataacagcgagatgatccggcacttgcttgtcgccgcggacagatatgctgtggacaggctgaagctgttgtgtcaaagcatcctttgcaagaatcttcgtgttggtaacgttgcaactacactggctctggctgatcaacatcattgtggcatgcttaaggatgcttgcattgaatttatgtcatgtccaaacatgttggatgatgtagtggcatcccaagggtttgtggatcttgaaaacacagctccttctctcgtcgcttaggcaaaggaaaaaatgggcaggttcaagaaaatgtcgaggatgacaaagagcaatgcaccggaagatgaacctaacagtaattcgtttagtttataagtaatatggatatctgtctacttttactggatcaggtccttgtggttactttactctctatataaatagaaataacttaaacactggtattgcttgcacctattgtgtttagaattaacttttgggtaaattcacatacctaacttgcacattagactaggttttgcaaatcagtaccgagcttgttttccagttgcaaaatttgtaacaaaacttgctccaagcgataaacttttttcaagatccaaaccaaagtggaacaaaggtagaaaaaatcaattcattgtgaaatttgctattatttttccaggaatactatttgactggagtaaattttctaggatgtctgtatgttatgcctaagaccacccttgcagtaggataccgtctgctttgggttctttattatattatctccttcgagggttttttaggatcattcaggctatatttagtctattttggcttttacttccttttctcagggaagtggttaaagacctcagaagcagatttctgctgctcattatatgtccttgttttctaagagccatgcatattgagaaatgaaggtgaaaattggaggactgagtaagtgagtatttctatttgatcagctagtgcagccccaacagtagattttttttatatatatgccaattttatgattccagcctaagaagctattgtgaaacattgaacgtgctgtgtttgtggcaacttttttcttctccaaattttgttttattaatctgagtattctactactgtatttgagttaatctattaaatgcatcaaagtgaaactggggcaagttgatgctgcctttattcgttcagcacaaatcagctattatcacctttggtcctttggtaagaattctttcaatgtttctcctggaactgtgcttaattttggggtgatgcaagtctgtaacaccattgcccttggcaaggatgaagataccaacatgtctgagcattttttttttacttaatacccattttggacaagataccaaactcttgttagttctgaaccaaattcttatattgattttctatagcaaattacctatttaaaccaattaaatcaaggttttacttaatccaaagatgctctaacaactctacttctagtactccctctgctaatgtaatcatgtttaccttatgtcacagcctactttcaggtgatcttcacttcttcagcatatcatgaacaacataataacctgaaaaagattgaaacggcatcattaatgataggaagaaataaaattagtcatatctgacgaaacatatagtatcaattcccgtgtaagaacaatatgtgcacagtagattaccatgtagcactaaataagaagattagggaaaattacgacaggaaaatcctaagcaaaacagaagactattccaataaaaaggaaaaacagaatctggcatatactgttcatttatttgtattttctcaaaaatatccgggatacaattttttttggcagaagtatgcgtcacaactattgcgcaaaaattacatggacatgaaggtggtgtttgaatccagggacttaactttagtctctgtttttagacactaatttaatttagagtattaaatatagactacttataaaactaattacataaatgaaagctaatttgcgagacaatttttttaagcctaattaatctataattagagaatatttactgtagcatcacataggctaatcatggattaattaggctcaatagattcgtctcgcgaattagtccaaaattatggatgggttttattaatagtctgtgtttaatatttataattaatatccaaacatccgatatgatagggatttaaaagtttagtcccatctaaacacaggtcgaagtctcgcataaggaaacagcgatacagaacagtgtcgcataaagaaaaagcgatagaatgtcttgtccaacggtgccgcttaattagtgattaattatcctaattaaattaattaataataattagttattaattagttgctaatcaatgtgattaaacattaaccattgcccctgttggtgagttgggcagccatgccgtgcggtctcgcaaatgggctgtgcgagaccgtacgctcccacccaagctgcgcgtcgtcactaaagtttacaaaccgtgcggttatcacgtgcgataattttcttaatttttgaaactatgatatatctcacggtaatcatacggttttcacgataattatgtggtaaccgccaaaccatggggtgacggtatccactcaaaaacggtttagagaaccctagtcatcagtcgtcaccccatcattctcacgcaatgggtcagcaataccatattgctttcgtcagcgacgaaggtatagttgtgctaaaaattttcatcccgaatatttctgagaaaaaaaataaacaatatatttttaaatttaattcgcctttataaccgtaaggcctttttccttttctgaatggggttaagttcatgggccgcctaattgggtcggcattaggccatccaaactaggcccaaaaaagggcaaaaggcatcgtgttggtccgtctccgagttgtttccctatttgggccttctctcgtctccgtcgccgccgccttctccaaatccccttcgcattcgatcccctcccctcgccgccgtctcctccacctccgccgctcgccgcccgatcccctcccatcccctccgccccgccgccccgcacctagatatgccgtcgtcgtcgtcggcggcggcggcggcgtgcgggcccccggagttcacgccggggtggaagacggtgtcgacgtgcgccccggacgtcgtcggcgagggcgtccacgtgttcgacatcttcgggtacagcgaccacaaggggatgggcgcccacgagcccatcaggtcgggggccttctccgtcgccggcctcgactgggtcgcctgcctctacgccgacggctacggcgtcgccggcatcgacgacgtctccgcctacctcaggctcctcggcgacgcgcccaccccgcgcgtgtgggtctcctgcgaggtcaagctcgtcgaccagcgcaccggggtggcctccacgccgcagcccttcctcaggtacgccctggcgttcggcgacaagtgcaaggccctccactgtatgatgatccccaggggccagatcgaggtggagccctacctcgtggatgatcgcctcaccatggagttccatgtcgtcgtcaggagagacccccgggtgtcgaggaccgcccggttcccgcgcatcttggtgccgccgcccgacatcaagcggcagtttgccaacctgctgcagagcaaggagggcgcagatgtcaccttcgatgtcgcgggggagccgttctccgtgcacaagctcgtgctcgcgatgcggtcgccagtgttcaaggcggagctctgcgggctgctgagggagccgggaacacagcctattaccatcgttgatatgcagcccgccgtcttcagggccctgctgcaattcatctataccgatcagttccccgtgacgcgcggtttcgagagacgcgacaattgtgaaatgatccggcacctgctcgttgctgcggacagatacgccgtggataggctaaagctgctatgccaaggtatcctttgcaagaatcttaatgttcacaatgtcgcgactacgctggcactggctgatcagcatcaatgcgacaagctgaaggatgcttgcatcgaatttatgtcatgttcaaagaagatgaagggtgtagtggcgagcaaagggtatgaggatctccaaagaatggcaccttctgtcttggcggatgccgtggcgcagatgtcgaagctcaacaaaatgtcaaggggtagtgttccacaagatgagtctaagagctgttagcttaatttataagggatatgggtattctttcttctcttcctaaatcaggtaccgtagtcagtttactctttacattttgggagcacctttgtggtgcttatctgtttatatgatagataggtttattttatctctttgcaagctttgtttccattaactgacatataacctgttgtccttccgcaaaatttattttgtgcgcccttgatcaaaatttggatactgaagataatcctacattaacataactctgatggcctgctccgttgcaatggaacagcatcaacataacaaaatcgcggtgttgagggagcatagtggcatcaatagcaataacattgacttagtttagtattgtcggtgactattgtggttccttgaaaattaacttgccaggaattgtatttggcaagagtttgtatgttttgactacaacctcatatttatttttcctaatccatgttttagaaacctaaatgaacttccagtaggaccaggggcggatccaggaacaaaaaattggaggggactcaattacacagtttcttcaatctccagccatttagggacctttaatttatcatttatggtgaaaaaattgaaggaggtgctccgggggtatccatgggtcttatgggtgtatgggggactcgagtccccctgcacccacgttggatccgcccctgagtaggactgagtgcttctctttgatcaaccagagcagcatgtttttatttttctcatgtccctgaatcaggggccctgaccatagccaatttgcgatttgagccaatttgtcatggaaccaaaaagagggcatcaagatgcaatagtatatcagcgtgacgttgtgctcagtttgtactgataatagtaggaagcactatatttctggaggcaggacgttgtgctcagtttgtactgataattatagtactatgtcaaattaattttttataacaaaatagtatatcaagatgcaatagtatatcaagatgcaatagtaggaagcactatatttctggaggcaggacgttgtgctcagtttgtactgataattatagtactatgtcaaattaatttttttttgttgtaatatatgattagaatggaggaagtgtttgtcaggtggttctgtgattgacagtatacctctctgcttctgtccctattttcagaatgattgttctgggccttctcttaacagaaggttaaaggcaacccagattatttatcccctattctgaaatttattctaaattactggtatgcagcgcttttcatggtcatgtattgtgcttcactttgttataaacagtttgtccaaaattcaggatgctgtcgcattgttactgaagtgcaagcaatatttatgtatgtctaaatttgtagctaggagttggattattttgggatggagggagtattccatagatagttgtttgcttgtcttttacttcctctattttacaatgtaagtcattctaccatttctcacattcattttgatgttaatgaatctagatagatatatatatctagatttattaatatcaatatgaatgtgggaaatactataaagaattacattgtgaaacggagggagtatgagatttgataggccgaagtacgaaggtagactgcatttttatctagaatccgacacatatatatggtagtcctcgatagttagaaggctgaagaattcgaattcctattcgtagacctcgatagttagaaggctgaagaattcctagtggtagtcctaactaagctgaagaattttctgaagcaaatgcgtcgataaaatcaaccatgtagattggaggcgcctccaaatcgggtgccagatcctctaaaaaaaaatcggtgcccgatcctctcaaaaaaaaattgatcggtcaaatattgtagttgaccatcaatgaatcaaacattaaattatacatagtgaaaaaaaaatcagccacttacattttttttgaaacacttgtaaagacacgttgaaacaaattactgtcacgtatgaaacattgcattgagtattaatggactgaaacatatatttttttccactagaacataattatgtaataccttattgtgaagatttaattacaacgaacaacgttagatttaattataacgaatacaataatgttattggaacatagattagagaggagagacaataggggcaaaaagaaagtcggtcaaatgttgcagttgacacctagtgaaacattaggttatacatagtgaaacgataaaatcagtcactgcaacatttaattgttttttttataaaatcagtcactgcaacatttaattgtttttttttgaaacacagtgaagacacgttgaaacatgttcctatcacgtatgaaacattgagtattaacagaatgaaatatatgttttttttttcatcagaacataaacatgcgatatcttgttgtgaagatttaattataacgaatacaatggttttatcggatggtagattagataagtactttaagacaaaaatcattttgaatgttgctaaatccatgcatgcatgcatggatagataggagagagagagttggggcaagtagttaaataaattttgtgaaatacactcaatgtacattttaaaacatgtccctatcacatagggaacattaagttctaacggtctgaaaaatatatttttcttttatcaagatataatcatgtgatatcttattgtaaaaatttaattgtaacaaattcaatggtacgatcaaatcgtaaatcggataagtagtttaggagaaaaaaatattaaaagtgatgagagaaaagaaaaataaactagttagtcttgcatgcatgcagtatcatggagccccattttttctcttcaaatcgggcctctcgctgtagatttcttgaaaaataaatcttattgccagtgccaactgccaaggataaggtataccttctatagatggggtcatggaatacattaatactatatactacaatataatgtattagagttctagtcgcggaagataagatcctttaattaagtaaatatgtagataaaaaaggttaattaaggaaatatggtagataaagaagtaaattatcttttcggaataagaaggtattagaatcctagttgggaaagataaggtattctatatctcctagttttacttggaaaggaaaatgatcttcggtataaatacaagactcctgaggagaaaggacatgccaagccagattcaagccaatatagatctagacaaaccaaatgtgggagccaaagatgccgacgtaagggatctagagctatctccaatctcgccgaattcatattcgaggacaaagactgcactagccgttggctatttgtgagagctccatgccaccatgctactagattagattatctaaaatattgtacttgtgtgatactgatatataaaggcaaaacaccggtttcggccaacaggagttgggttattacatgtcatttaaggggcctgaatctatataaacatctttgtcttctatctcttttactacaatctcgcgtatatcctggttccaacgatccccaaactctacaaatattgtatgggtatagtccgtcaaaagtggtgcgctaggtagggggacttggtgcttcaaggtttcgatgcgatgggtttcaatagacggattctttcgataacaaactcctcgatgacttcgactttgggagatatgacctgatcgaaatgcgttctcctataaagcaggacccttattatctctatctttctcaagagatcgtcattgtgggtttttcgatgagggacacttcaacaactttggctctgctatatatgacccaactagagtatgtcaccgccaacaaccagatctatcaagatcaaccaagtttcaagacgtcgcaaccgtggagaacaatagttcaatgttgtcgacaacgaggccccagctcggatcaactacttccatcctaacattgcatccaaaatttgattggatcagaccggcccaaaggcacgaccagcccatcgacaatagcagcagcaggctgagcactatggtcgacgacatcagcggctgccaaagcggtggcctccgtgccaatgctagtagaggcgtagctaacgggggatggccccaagaatacggagatccgaggcggattcatggatctcctatctctccacccctctaccctctcggttctcactctcacaagtagagcggtggaggaggaggtgaggaggatgaggagaggagagaaaagccgagccgacaaccaagtaggtcgtgccgtgctgggcatggcccaacggccaggctaggccaacatgagcccaacaacagtcgggccgtgccgttcttggactaggtcaaattctagtgccatgtgccgggccatcgggctgcgggccttttggcaaactatacctgtagcaaaatttaccaaaagaaaatgtagcagaattttccaagccggacaatagcttaaaaaaatattgtaaatgatgatcagtcgattcagtaaatatacgaacaatcgtttcagtaaagtaataataatagtaaattgcatcgccggtatacaaacttgtcaggtgggtataatttagtgcacgaacttgtgaaatgctcgttttggtgcatgaacttgtcttgtgcatgcggaggaaggcgaaaaggacactacattactaatcttattgatttagggcatatctcttagaagtttgctattagacatacacttcttcaataaagaatagaatatgatatagtgatagtagaaaaagaataaaaagacaagcaatggtacaaaggttagaaatatatgaaattcatcatttccatggtgaagaataaaatggagaccaaatttataaatattgaatatcctatagatactcactacacgtatgcaagtcacattctaatcaacatcacttcataaaattaacattgtcaagttattttggtcctcgttcgcaccaactaggcaagttcgtgtactgaaatgaacattttacaagtttatatactaaggccctgtttgattcagcttaggattattataatctggattattagaaataagctaaaacaaacggatagcttattatgatagattattacaatctataaaccagattactataatctcaactctaaaggtgctttttagattattgggtggctaacaactaacaagccgcttataatctaggaaaacaaacagctcacagcttattttatgccaacttatcataattcaaattatagtaatctagttcaataatctagattaatcttaagctcgaacaaaaatggcgagaatgcttctcattgggtgtccgggccgacgcaaaaaatcggatggtagtaaccctcttcacccgagacaacagaagtcctcacgtgcacgcagggagttagtacacatcagcacacgtcaagtgcatgcgtccatgcatattcaaatattcaaaatttaaatacatgtttctctacaattatttatccacctacgatttaattataccattagattcattataattacatctttatataaagatcttgcatggttatatcagacagcggcgagcggcggcggacgggcagacagcgcacaggggcggcggcacgcgggggtggacgggcggtagcatgcgggcacgcgcggtgcgaggcgaggcggcggcccgtggctcatggagagcagctcgttcgccgtcggcatgaacgcccggcatgtctccggttacatggcgtagctcgtggaagatggtgacgacgatgaggtcgttggccatgaccaccagggtggtcggtgcagacggcgatgctcggagtggcacgcacgacagcaggcaggcctctagctgccgcctccgccaccagcccgtcccccctatcccgagcctcgcctccagcctcctccgccaccagccgccgcccccatcccgagcgccatcccaacggcgaagaagaagaccggaccgcggcgtcgaacgcctacctgccgccgtccgcgccgccgtgccgtgcgtgctgccctgcctaccgtcgcccaccgccactcccatccagacgacgaagaagaagaccggaccttcccctctgcgtcttgcgccgccgttgctccctcccggcggaggagttcgctgtcgctgcctttgtgtcccgcgcggacgccgcctctatatcccgcgccgtcgctactccctcctggactgcggcacagaacacctgcctcgccgaccacccacacccactacccgtccccacactgccgtgcgcgctacgagagaggaacaacaagagagaggaagagcgagagatagaagggagaggggaagaggggtatgacatgtgggtcccacattttttaataaataaaatgctgattggattgccataagtacgctacgttggacaaaaccgctttggattgggtcgagaggggtaatttgtctggtattaaaagttcagggtgaacgatgattggttttcgggtttagggggtaattcggtcgaccgcgctagtttagggggtaattcgtactttttcctaatttttttagtgttgcacatagtgttatttagatgtttcacaaaatatttgctaatgttgcacgtggtattttttcggatgtttcaaaaaatatatttttatgtttcaataattacaactcaatgtttcatgcatgatataaaaacatttcaacaaaatcaaatatatgaaaatatattgtatgtttcatataatttttttatgtttcattcgttaggacttaatgtgtcatgtaacagttgttattgttgtaatcaatattttttatatgttgcatctctatgaaatatatttcattaagtaagttgaaacatttgcacaaatagtgaaacatttttttttcagtaaatagtgcaacaatgattgatttttaggaaaaacatatatatttttcatcaaaatacggggccacctacgaatcaggcgcccgattttttttttcaaaaatcggggttccaccaagtagatcagaattgtttcactaagtagatcgaaaatgtttcaattgtttaaaaagctgaaacacaaccaaatcacctcattaaacattttgctacagcgtatgaaacaaagggtttcctaaaaaatcgggcgatgttttaccttatataaaaacaatgtttcagcaaatagcaaaagaatgtttcaattcactgcaacatttgatccatatgtagtgaaacattataagtacactaggtgaaacatttttggtggaacaaaaaaaaatgaaacggcttcccttaatagagagtttctgtaatattgggtgatttgttgcaaaagaatataggtagagttagcggtgtttacaccggtgtcatgtgtacgggggtacgtgtattgagaaaaaaggccgagaaggcctgttttcgaagctagaacataggttcagtgaggtttaggtactttgacacctaaaccgatttgaaatgcgtaatatcgcatttctataagcatagtattgtccctcgttgtgcatgcgcacgtgcacacatgtgtgatgtgcgcatgcgtatgcgcacgttctattggtacacgcgggaagccttctccctctcagattcaagagtcaagaccctaaacaagaagcagcttgttctttcgcgctactgcgctcaattcgttgcttgttcctttcctttggatttattatcataggtagtgttcgagatcgcctctgtgcggtgaacgctcgaattaattcactgcaacttttgatctatacatagtaaaacatcataagtatactagctgaaatatttcttgtggaacaaaaaaatggaacagatccccctaatagggcgtttccgtaatatgtgggtgatttgttgcaacggtggggcgggtggtggggatacgtggtggaggcgtgggaggcgtggaagggtaggggccgatcttttctccccccgtcgggcacctatggggaggatttccgtcaaaatacaaatgtgtgtgagatcttgttttaaagatttaattgcaacgaatgtaatgatgtagtcaaatcatagatcaaataattaatttataagaaaacatatttaatttcgaaaaacaagttgctagttgcactactatatgtattgtgatgagtgagagagcactgagatactacatgccaatgccatgcagtagcagtgccagcgtatagcacacgttacactaggagcatgaaccttgcgtgtgctagttgttgatttgctattagttattggatggatatcgtaaggctaacatggcctaaattgcatccacctaatatgtttgtataccaccaatataataatttactcgtaataataatatcccaatggagcagtcgagcgcggagcctagtattgacgtggaaatttccaggccgtccgatgggaagctaacgcacgggataaaccctacactgatgagagaataacgaaccatccgcctcccacgatctcgtctcctcccccaaaaacgccgcccctctcccctctcatcctcctcgacctcttcggtgattccgcctccgcgaggtgctctgcttgatcgagccgcctccacctctgccgccgtcgatcctcgacgccggtctccagcttgcaggtacgaacgtcctcttcgcctcgggtctagttacttttacatctggatgtataggatagttctcccttgcgaattatggattttatttttgttgttcttttatacatgcgcgacatatctaatgtacagattcagatccatggatatctagtttgtgttcaattcaattgatgtgtagttggtaatctttttttttaatctatactcttgtgtgtaattaaaataggggaaattcggtctatgacatcgcatcaacctgaaattaagagagaaattaggtcagccaacattggatgggctcttgtatgaattgattgaccgtgccgatcaagaatttctttgttttcctttttgttgttgttgttattcataagatttaagttttttgtttggctagagaggaataggaggattttccaaaacgtgtcttgctccgttagcgaagtagcctatttgataaagcaggacttagatttgcgaaagacggcctttaaacctccctgaggttctttagtttcgtctgaacttctatcccttcaatgggattgtaaatacttttggttttttcctcctttcaattaaattccggcagttcttctgccgtcgtttctgctcaaaaaaaaagatttaagtttttttttaatccgagtgggcattcaagacaatactcgcaatcgatatatgcatgtgttgttcatatactcctccatttctaaatatttgacgccgttgactttttttaaatatgtttaaccgttcatcttattcaaaaaatttaagtaattattaattcttttcctatcatttgattcattattaaatatactacttatatgcatacatatagttttacatatatcacaaaagtttttgaataagacgaacggttaaacatgtgctaaaaagtcaacgatgtcaaatatttagaaacggagagagtatattctttagaaggtagtaataacttaggcagactttttcctgcaagaattaattctttgcattgtactgtttgctttgtattgtaccatacctgtatgagagaataaacataacacatgcaccatggatagtaacctaattttaacccctatttctctccagactaaataaaataaaataaaattctaacaaatgctgcttgtacccaggaaattaagggtgtgcaatggaccgtctccctgacgatgtgttcataaaagtgctccgctgcctccctgcaaggatgtgtccaaggaatggtgcactatcatcgacaccaatcggctgctgctcccacatgttctgccacacactcagtgcacggcatcttttccaactaccttgaccatgacatgacgcacttcttctcccgccctagctactccgcgggctgtgggattgatgggtgtttcaagtttttacccattgacgctataggatttaacaaggtactggaccactgcaatggcctcatcctgtaccacggcaaaatctcagaacaatataagctatttgtctgcaaccccgcgacgcatcgatgggtccagcttccaccgttcacagaatatgatagtctatgcattagtgctgagtacctcgtcttcgaccctgcagagtctctgcactatgaggtgttcctgatccctgatttgcctgaaattcctaccaagaagaagtgccacaaaggtccactcgtgggtaaggacgctacagcggaatggccaccgtctgtgcacacattgtgggtattctcgtcgaggactgggaggtgggaggataaggcttttctccatgaaggccacgcca

SEQ ID NO: 75515 - DNA, 15756 bp, Oryza sativa
aattcctgcagccatgggcgtgaacttgtcaagtccagccttaacaatcaaattgatgatatgacatgcacagcgttgatgcaaaaataaatgggtaatttggaaccatgccattataatttttcaaagtttgagatatgccatcggtatctcaatgacatgtaggacccacacgagtcaatgacatgtgggtcaggatgacatatcttaaattttacaaaattataatggcatggttacaatttttccaaaataaatcaccaacataaccagacagagcaagagtaagggtttccatagctttagaatgagcaaaagcattgtctaatgtaatagagaaaaccttatcagtaataccatattcttcagcaacagcaatcacacgctcagcaatattagcaccagtatgtgactcatcaatgagcctaagacccaagaccctcttttctaattgccaatcagaattaacaaagtgagctacaacactcaaataatcttccttagcatgaccagaccatatatcagatgtcaaagcaatagagctagcagaattgagacgatcgataataacagaacgacgatccttaagcatcttgtaaaaatctctggtagatctctggtagtagtttgtctagagacaagaacaaatctagggttatgagcagccttaatatagttcacaaaagcaggagattgaccaaaactgattggaagatcctctctagcaatcaatctacacaattcaaacctagcaacttcaggactatattcccatggaataacagaaccatctgcactaaatctaagcatggactgaggcaaagcattagacccaagctttctaggtttgcatgacttaatatgcctaagcaaatgtccagtgccagcagaagaacgagcactcaaagttttatgatagtaattgcatttagcagagacttgaaccctatttccaatggtcgtttcataaagttcctcaaagtcatcccataccttggaggttttggtcttcttgttggtacaagtcgcactagagccagtcggcatcccattgccactgtcgtcgaccggcgggtcgtcatcatcgacattcacatggatcgggatgtcggaggtattgccgaacacctccacacgatcctcctccacatcatcatcgtcatcactgtgcatccccatagtcctcaactcgtagttgacggaggtaggattgtcgtccatcgcaggcactccggtccctcaacggcggctgccgctaagcaatgggcttgcaacctgcaagcagccaagaacactcaaggttagggctggaaatggagaaaaaaaaagaaaaacaatgggttccatgcttgtacctacgcagccggagcaccggagttgccgttgaagatgataggctcatggatctacgagaagaccaagggatctggcgaagaagaacaaaagggaaagagacgaagaggaaggctggatctggaagagtggaaggacgatgactcaggcgaccatgcgtggccggtggccctcatcctcatgcgcccctcatgcgagtcaggcgaggcatcgatcggagacgaagaggaaggctggatctggaagagtggaagggatgcgactcggtgagtctcaccggtgcgcgcctgaggccctgagcgagtgagcggcagatgcggagcggcggacggtggaggaggagatctggtgggcggtggaacggcgaaggcggatcggcggaggcggttgagcggtggcggctagggttagggttaggcggagaggcggagagcgagagccgagaggggactgggaatgggaggggcagcgctcgctggcttatatatgcgggcgcacgcggcgcggcctagctgtctgttcggctgggccatgctcgtgcctaccgttggtacgggccgtggtcgtgccgaccgttgggccgtgccgtgtcgggccggcccatcgtgccgacctcggtccgtgccgtgacgggctggcccaccgtgcccagccataggcctaggcacggcccaacagtcgtgccgggccagcacgggcccgactgctaccgggccgtgccgtgcttgggccgggccaaattcccgtgccgtgggccgggccatcaggccttgggccatatggccaactatagtcccatgctaaggcgccctttatggttttcggcattttccgactcgttttgttggagagaaaatgttctatcactcttgacaaaatgtttcatcgattggataaaagttttaatagatgcaacactcgaaaactactccaataaaaacataatgaaacatccaaacacaaccaagtgcaacaaaagcaaattatggattgaaacatcgtcaagctctagaaaaaaaaacaaaactaactctaccttcttctacccagccatctctcgaaactcacgtacattcctcgtcgatgagcttctcgactgtagctagttgttgcatcactttgacctcctttatccctccgaatctcctctcattgatggcggtgccggtggccaggatttgccgcctccattctctccgcgtcgccctgctgccgtcgccgccgccaccaccgtggctgccggtgatgatgactccaccatctcttctcgccgccattgtcatggtcgccggtgaccaagtctggcacctccgtcctctccccgtcaccctgccaccgccactgctatggccgtcggtgatgattgctccgccatgtcatctcgtcatcgctgctatggtcgacggcaacaatggctagctccgttcgtgtgttctctaccattgaagaaaatgtgagaacaggatgagaggataggatgggcaatacttaaatcgatagtggatctcgccttaattaagtgtcgtctgacgtttcatctcctctcaaacgttcgggtacaagcatttccgtgatgatgcacattcatcagtccaattgaccgcatgaattaatttcatatgatggacagttggacatccgatcatcggcaaattatcggaaagtatttagtaacttggcaagaattgttcaatgttttaccattcgataaaataaatatttcaatgagatgtagagcatgtttggtaggactccaactcctaaatttaacatcaggagttgggtctggagtggacttgcggagctacctaaacccaactccatctatctactttattttatgagagcactccaaccagctccactcccatttttagtgaagttgaaactgtttggttggacttcatatcatggtgaggtggagctggagctagagcatgccaaaacagggtcgtaacagttataaaaaattaattgcaacaccaataaccaacatgtgaaatatataaaagaaaactagctatacagtcgttgatagaaaaaattagcattatgatcaaattatagcaacttaaagccaaatttggtcgagcctttcccgcgaaggcctgtctggacaccgttgtgtagctggtcatactgtacaatgaaccacagtcagatcgcggttgtccggacagtcggaccggcagcacaaagtccaattagagttttgttgtgtttttttctttggtcccgggatttccttgattataaagcttcataaaatatagggggcccaaggccgattgaaacaacaatcaatcaattatcaaaatcaatctagtacctctatcatttgtattatacacctccctccctattgctatctatctccaagtctattcaccactcaatccctcaattgcttgtcattcttgtttctacagcgatagaggacatcctagttggcatgtcgagcttaggacaaaccgctgcgtgttaccctgacagggccccttctaggtgttcgttcggtggcatctgctctctcctatggcaacacgtgtccgatgccgttgcgagttgtatataacatgctcaaggtgtggtggcactattcggtgccaacaacaacaaaaaaaatatatattgctgagtaccttcaagatggtggccggagggcacgagatacgcctttaatgaagcagttcacatcatatgcaagtgtagcattcagtcgaatagaattgcactcgaacacaataaagtgcaatgtagataaacaacggatcgcaacaaaaattacccaactccaacaagagctaccatatgttttcttcctctgctccatgatcggctttgccttcttccttgctcctttgactagatttgggcttcccatgcccatagagccgaagcgtgtgctagaggcatacttgaggtcgagcatggtattgtccgggtccatgcacacggggcttcaccttggccccgagccaacagttgacatggtctgagttgaaaagcaatgtgaaagtagatgaagcatgtatgcttcatcaaagcgctccaggcatacggtcacttcttaggacagcatgcagagggaggctattggccgaggcagctggtggggcaaccgattttttctatttggctcggatacctagtggagagcattcttgtaatttgatcgacactatagtacaagatagtgatagaaatttgagagatcccgaggaaaataattaggtttccatctagcataaacaatataatgatgattctagtaaactaaaactacctttgtttaagctacttggatttcttttccttttctttaacaaaacaagatttagttacgattgaaaataattttctttatcttcttccatagatcctttactcatatttttaaaattggatacttaatacaatgcaaaattatgcttcctgactcttgtactcataatccaaatccgatttattttaaggatgcaatttccattagtctttgaatacagacttctacaattatcttatcaatcagccgtgcaacgtagccaggtgcatgcaaattatgctggacttggtagctacacaacaaaaaaaaagtgtgcaatcaagctagaatacatgtgtagaactataacagcgcaaagtgctatataccagcttcggagtctagagtgccggacttatttggaccactcacactcacacttgagacggatatggctatcgggtgacaaaatcgataaccatcttcccttgccaccttctcttgctgtcgacatacatccaagtcatgatcccacacctgcaccactattagtggtggagccgccatggtcctcttcccaaaagctcgggaggtggttccaccgttgactactatcacttccctacagtccactcatcacaatctacatcaatttgcttaaaaccctaacttctctgttgtgcactgctaaaagacaacctcttcccatattaattatatttatttactagaaactataaatattttattaattaaaccatcaaaatgaagtgcatagccttccttttcctcatatacttgattttgtattgcagtaaatagtttcaagcgcctaattttcgtacttttgaatagaatattaaatcattcatattcattttagttctcagtaaaatttccaatggatcaaactaattaagaattatgcagtggcaaactagagaactcgatcacagcatagtggatatatcacaatgatgcaccagtgactgatcaaactggcatgtttgcaaatatgaacttaatctggagttgaaatttcaaatttcaaagcttctgtttgaaatttaattaatactcactccagtccccccccccccccgggcacacaccccccccccctttgttttgcctgtaattacgatattgacacaatctccaattcagttgttcgattactgtttttttcttattgtatgtttacaaagaattaataacataaccaaatgaaagaattttcacaaattaatctactaattaatgtcatttaaaacatcatctttcttaaatagaagaaacatcttagcatgatgcatgcatgtttgccacgcttgccagctagccataataccacactatattttcacagaccttcacaatcaataaataatatatatgtgcaccaaacacccatttggtcgagtgacgaaaatgacgaacaaactagctaggctattaaaattaacttccaaaattcaaattttctgaaacaagcatgcccaatagttggtcgagtgacgaaaatgacgaacaaactatctaggctatcataagggtaaggattgagattgcccatgtggagttactgaaaagctaatgacactatgcattgtgtttttttaagtaaaatgcatgagattattgtgtggaatgcagttaatattctcttgttagaaaaggcaagttaactatttggaacttcatctcgaaagtcgaaatgcatgtgcctccttcccatctactactccccatctacatctcggagtaactaagattatcgccgagtagtacatgcatatacagtactcttcgcatcaagaatcaggactacatactaattaacactaaattctgaagcaggacacaaaatgatatgaacacacatctgatcttttttaagcgaactactaatattaatacattactagctagctggccaggttttgccattaatcactttatgtacataattaaacacacacacttagagctgaccatatcagttcgatcgatcaccatacagcttaattaacactatgactaactaaattccccgcacatgccatcatcaacttgatcttcgttagatcaatccatacaggctgaaccactcaaccacactgttatcagcgtagccgccgtactccgggacatacaccaggtcatcgtctccgaggtgatctccgccgccgaagctcggcggctggcaggtacccgtcgagaacgacgagctcgggctcccggcgacgcaggcgccgctgccgcctaagcccatgatgtctccgccttctccggaggccgtgtggctccccgccgctgatctgagccgcctcacttcctcctcggcgaccaccagcctctccttcagcctcagcacctgcatgccgccatggatggatcagaggaattgaggcagcaataagtatacatgtgtgtacatgcaaggacggacgatgtgttgttacctcgttctcgaggtggcatttgtggaggatggcggcgtcgtgggcgtgcttgagcttggagaactcctcctcgagcagcttgctcttgtggcgggcgcggcggttctggaaccagacggccacctgcttggggtcgagcccgagctcggaggcaaggtgcaccttccgcccggtctccagcttccgctcctcccggaagctcagctccagcatctccacctgctcgtcgctcagccgccgcttcttcgggtcccctccgtccacctcgccaccaccgccgccgccgccaacgcacctcgccccacgcctcctcctcctccgcgctctcggcctctcgccctgcacctcacctgaaaaaaagatcgatcgatcgtggcagcatgatcagtacacagttgacacttgccatgagatggagaggcaagaaaatggcgggagctagcaagcaaaagctaagtagcacgaaccgctggctgctaggagggaggcgtccacgtaggaggcaaacatctgctgctgctgctgcttctcgccgtatcggtccatgccgtctcgcacactagctcgatcagctcagctcagttcagcctttctctctctctctctctctctctctctctctctctctctctctctctctctctctctcttgtcaagcgtgaggtgaggacaggagggagagaggaaactgaactgaactggattgtctctggatggagaagaggaccacgcaccaccaccaccacagccactgcaaaggcacacaccagttgatgtttaagtaaggccgggtgcgtgtctcgagagagagacctacgagtaatatatatagataggagcggtacacacgcagccgctgctgtgtgcatgcctcccccgtttgttgctttctcatccagatcgatcacccaaaagctagcaacgactcacgatcaaattctgatccatcgatcgctaaaaaagacgttatgttcattgctgaacgtagtatataacgcaaggccagttgatgactgggcattgctgtttatctggttgtgatcatgagcactagtgctgctagtgttaccgtagtcatgccgaccgacaaaaagttagcttgttatccccttggaatggatactctgtctgacactgtcacacgcacacttactttggtgaagtaggggccggatgggtgcacgcatgaatgcatgtgtcagtgcataattttgggattagtgggggtagagaatgcacgacgatctaggccagcaagagcacagcacaaagagcggccggccggctcgacaaggtggcacttgcccctggaaagggctctcgctttctttgaaaagatcggggagaggaggagctttggctatagctagatgagattctcgcctgagtcggtagcatgttaattgttcgatccatggctgactgtactagtactaccactagctaactagccaactatttatcctcttttgaattgtactacctccgtcccatattacttgtctttttgaatttttgtttgtcactgtttgatcattcgtcttattcaaaaaattttagaattattatttattttatttatcatttgctttattatcaaaagtactttacatatgacttatcttttttttatatttacactaatttttcaaataaaacgaatggtcaaactttacaaataaaaagtaaaaaacatcacctattatgcgacggagagagtagaaagcttgctgctccatcgataatcggatctagtaccatcgcatataagcactattgttttgagagaggagtagagagagagagggagagagagaactgctgaattatctgagttcgagcacgtacatacgcagctttgatctgaaacatctgttcagaaaatcataccgtacgtgcactcataataaccatacgatgcggtgcgtgcactgtatctgaatttcgaattttcgatcgatcagcagtctgcacgtacggtttaccgcgtcgtcgtgtgtggtgtagcacactgcagatataaggaatatccggagcgatcatgtgtgtcatacgatgatccgatcctatgcgccgagaaccagaagaaggcagatacaaaaccgtgtactggatcagtcagaatgtaggcacacaagtaaagatagctgccatgcaatgcatgcagagagatgggatgagatggtcctggataggggttcggatcgtgcgtcttccaggtagccggaaagaaagcaacagagctagtccgcgcaagtgtgtatgcgagaggaaaggaagcgtcaggtagcgcgagaggagggccgggggcgttggtggtggcgcgcgcgtcgctgtgggtgtgggtgtggggagtagctagcccgggagacaaggggaggaggcacatgggctgcacccgcgcgcgtcccccgtccccgcgggggcgcgcacacgcgtcgagcggcgcggggcttcacaaccgcgggaccgcatgccccttcgcgccgtgacgtgtcgcccgcaccggcaccgcccccccgggcgcctctcccacacaccacccgcggatcgcgaggcgacgaagaagaattaccaccgcgcgcgctcgggtctcggctcgatcgatctcgcggctcgaccaccacacgcgcacgcagcgcctccgctccggggtgggattccgaaggcgccacctgcgctctgctatagctaacgaaaacggtcggagaactcccaaactaaccgataatctttttttcgtacgtgtaaataatatgtttccgaccatttccaatttcttttcttaaacacaataaaaaacatgagttcataatgtgtgcgtactcagctatatataaatacacacgcacagacactattcccatgagcaccttcaaaagagtggagtgatatatctaaagattgatgacgatatcaatatggatgcatcgttgtcgattaatatgtcatctaccactggaaaattagccataaatatgacgattgtttctaattctaaccatatattaaagttatgtttttttcaatttctttcaacgttgtatcagtgtcactactaaatgtttaaattgataaatatggttaattttccaagcgaccaaccgagaatcgtatcgtaagaagcgctactactgttttcatccttacctattgcagcatgctcactgttgccgagagtggatcccactatcagcagggaccatagtaaaaaatcataacaaaattttaatttttagagcttctttggacgcaggattctcaaacacatatgaatagaaaaacctgcaggattaatatgtcaatgcaatcctaagaaatggaaaacgtacacaggaaaccgtttggatgaaacacggaaaaaaaacataggatttagaagagagagatagcacaaaggaaaaaaatctatgagcttggagcttatgctagaaattctccaaaattccatgaaacatgcaatttcattgaaattttaaagaaattatagatacccaatccttttctttcaaaagggcttctacaggatttaaatcctttgaaattaatttctctatttttttctttattttaaaggggtccttaagcatttataatccctgtctcgctgacatgttggtccattttaacgaactactcctcaccgaggatggcatcgtcgtgtgagacagtatcggatcgaaggtcagtacgtgtaaaggcactgtctcctgtgaacataactgcacgctgaaggtattgtcttattggagtttcaggccatgcagtgcattttgatcatcacactgatcagacttttctccgcacaggagatcgaccaaagattacttgtaaaagctccaggcttatcgtcgattcgatcgcaaccagagcccggccggttgcttatctagtcagcaactagtcgccgccggcctatttacggtctcagccgatgccaaattctcccatctgaactgtaaaggttacagtcacaactaggccggatcttggttgatctgttcgaatccaactcatccccaggccgacggacagccgagatctgctcattcatgcacatgccacgaagcatttcttgcagcattttcccctgatttgtatctgaatcctatcagctgtcgacgttacatgcactgacgcagtgagtcatctactcccgtattaggaagctcgcggcactgttcatccgatttttgaccctggctttgcgcatttctggtaagagttatccagttgttccctgtttactttgtttagcaggtcggggcagctgagctgtgcaaaagattagccgccattggtgttcttggcaaaatgtgtaggggccttagtttgttgatgtgtatagctagctatagcagctactggtccacgagaagaaaccggagttgttgggtgcaagcaacacacagcatgtacacgttgtagagtcgtagcttgactgacttttcgatccaaacgatatcgatccatgcatgttcagtgttgtcaaacgtcttggtgtacagtgaattgcaccagtagtgaaggtgtatttggtgaggagaagaagaagctaagaaaactttgacttagctagcttagctaagcattttgctcacacatggtgttacacgaactacatgtgagataatgctgagaaaactaacttacccaatctggctagtcccttttaaattagctgttgatatccttgcaagaaagatctgtttctgcatcttcagaaactttattagtgttctggcaaatttgtaatcctaatttaatgttgttaaattatattaattaattagttaacaatgtagtgtgtatatctatctagccatcctgtgctgcacttcggtgctcacatgggtcattctgataggaaactggccaaccgtatcaagctaggttttaaaagaagagaggcaattctcggtggatatacatgcatgctggggttaaggaaggagaagttatcaatagacctcattagctgagcctagctgtattaaggctgtataatcatgatcctttacactcacatctaggctggtttcaataaagtatagcaatagtactagtattaattggttaactagagatcaaagctaagtaaggacacagttgtccaagtcagagagatcaacatgatggctaggagataaacccaaattctgatgatcatgtgctcgattccctcgcatgctccatgatctccacttgctttatgttaatgcacttactaactacaaaagctgattaaacaaatggaagaacccttactcccggacaagccatgctcctgcttcccaacttccaactaatctccttggatctgcccaaaacctgcaatgatcgtcttaaatgattgtataaagaagattatacatgagattaatcaatggcaaaatttgctgttaagcacaaattaatggccgtctttgtatgactttattcatcaagaattttatatatgctcccgtggaagttgccttaatgcggttgcaaatgcagccttggacacacatggaaagagaaaaagttagcacccattaatctgcttgtaacaaggaacataaggtcgatcattaatttctcctcccaataacagttcaagtcaaagctccatgacaagaacatagttttcacccacaactttaatctttaattactaccctcatgaagaactcatcacctttatccaaactaatctttcacctttccttgaattacgccactaaccatgtgacatgacccactaaaataacaccatttcaatgcctaagcttgataggatgcctgctaaaaaaggtgattactgattagccactagcctgcaggtagtactaagcagcagtagacagtacgttgcccatggcacggcgaaacgtggcagtcatgtagccattccctgcaatctctttgcttgagccgtaaggatgatggagcaattgatttcctttactctccgtacattttgatgttgtctaggccaatggttcagcgataagcaagcgaatcaatcgactaattaagtaattagctacactgatccatgcatacctggtgccaattggaaacctagcaaataaagttgtgtacttgtagaatctttccaataaataattatgtaagaataaccgtctgcagagccggagggcacgctgacatttgcaatgtttaaatttgacggaccatgggtgcttttgaagtgttaggctaactagctctttggagtaaagatcaaccggtgcaagaaaaaggacaggttaattatgtttttgttgaataaagttgtttgcttttagtatggcatattgcaaatactattatgatagcattggctgctataaattaaagaagagtgtttttttttaggaaaaggacccatccaaagttaaaagatagttctcacctttcatcaccatctcaagtttttctgtgaactacttattccaggaaaaaaatatttgtgaactgttcaattaattgagttgatctgctacccaacacattgttagatagaattgttttctaatgttatactgttcaatacaagcatcaaagtagctagggagagttaaaacatttcacatataattactttgaattaattcaattcatcttgtatccccattaagattttttacatggttttggaacgtcatatcatgtgatatacatggttctggattggggttttcaccaacgttaggttcccaccgtatatttacccaaaatcgaaccacttctttctttattgtactgaggaacatacatataaaagcacacaacttgtttttaatgaaattaggcacattgctagctggtactaagttcacacactacacccacacccatctggctcaaaagaaactgcaggaccacacatgaattaagctgcatgatgctactaatttgcaccaaaccaccgccaagaaaacagaccaaagaacacgcaaaacttgcggccatcaatccacatcgtcaccaatagtaaagacgaagaactgaagaagccattaagataagcgagttgcaaacctgaggataacattgattaatccgggagcttagctgtggtcgccacgcgattgattccctaacaaccgaatctttttccaaatccaaatgggtttagttaatctgaagacaaccgtgacagaatccatacatgggaatagttcaagtgacatgtgtcaggacacccgacaccgtcacagctctgggctactttgagcccaaaactaacaccgctaatttgggttttctttagctgcagcatatgggctggaacctgggagaagtttaagcctgtgggatccaaggtccatgtggagttgccgatgcattactactttcctttttttttttcagtgaagtgtagtttgggccatgttttgttacccaagtttcaccttggactatctctaaaccattttttttcctttggattggataattttattgtttttgtagtttggacaactaaggaccccctcatttcgattatgcttatgcttattagctaaaatttgaatttttaaccttaaatttgaagctgattttaaggttttttcatcgaagtttttttttcagcatttgcttttggatcgctaagaacacgcatagaaagttttattcaaaaattactattcgtttgcaaatatatcgttgctgtaactctcttttctatccatgtctaacctttattctggtaaagatatagcctacacatgatagggaagttcgcctgaacttacttgatgtcgctgatgtgtactgaaaaagttattatttgtggtggtccaaattgcaaaagtagtaaaattaccggtccaaaacaataaagattggttaatgatgatacaaagtaaaacttgagcaataaaatgtggtcaaaattactaatgcattatacaaccttaactacttagttatttaacataaactttaatatatcatttttatgtaccaaaaacatatatctataatgatttttatggtcaaagttaacttgcgttgaccatacgtattttaaagagaaaatccataaaatgccattgacaagcactctaatcccagaaattccattgacaagcataacttcctcaaaatgccatcgtacaagcgtttttctcctagaaatgccatcatagccatactgttgttaactcctctccattaagttctccattaagttgtatgaaaatacaatcttacccctgggcaaactttttgctcaaacaacatcattttgtattgtttgctcacacaatatcatttcgaattgatgcatatttaaattcacagacgtgtattattttgctatcaatcaaattatttcaaaattaaattcacaaattttgacatcaaaattatttcagaaattttgctatcaattatttcagcctggggccgacggtcgccgcccggagttgccgtgccgccgcctgggagcaccacatcgcagtcgaggtccgtcgcaccgccgcttggaatccccgcaccgtcacctgggagccccacgccgtcgcctagggccgccgcgccgccgcctgagggccgtgcgccgtcgccgggggccacggcgccgccacctgagggccgcgcgccgctgccgggggcccccacaccgcctgcaagtgccgccgcgccgccgccggggaccctagcgccggcgcccgg

SEQ ID NO: 75516 - DNA, 2656 bp, Oryza sativa
actgtgatggtatgtcagggagaaaaacacttgtacgatggcattttgagaaagttgggcttgtcaatggcatttctgggattagagtgcttgccaatagtatttcatggattttctctattttaaaatgacttgttttcaaaatcagagactgtgtttaaagaactgattattcagactcagccggtgacgcaattggtgggtgacgcgagaaaccacaggtgcacagagcctgaatattcaggctcattcaggttcagcgtaggcagaaaccacaattgcagtcactagtcactactaagatgagatgacgactggatcggataagatgtgcgaaatggattgctgggaaaatggctgcgcaaatggcaaatgtgcatgcatgcacaaggagcggcaatcagacagtcacgatcagacgtatggttccggtgtatgagtagctacagtacatgggtgctcttggttggctgcagcgctggctagcctgtgttttcagctatagcccgtcttcaatactgggccaacgtacttatttctggataagatggtgatattacttcattaactccagcatctgaccagcaagacagcaatgtactccctccattaaaaaaacaacttttatatatatgtacaaaagttttctgaatgcataacttgttcatggataaagatttccttttcctacgatgaagaaagcatgggcggatacagtgtattagcactggtacctcagggtattccagtcaactcatcctaatttatagcaagtgacaccaaaagattaagccttatgacacatgtcaatattgttttttttggctttggctacataagttgaatatagatagctacagcctacagcatcaggtgcatgtcttcctaactctttgccttccgcaagacaacgccaatgcaacgttcaactgtactccatgcttctaaaatagcgtttgtgagttattttttcttgccattaatagccaaagaaatagtcaatttccgatttgattttcatcttaattttgttctaacccatttaccaagttgtccacataattaatttcttcaaacactatgattaataaggtttttttatttgagaacaacaattacttaggctttggcctttcaagttctagagatttgagcatttgggattattctcatgacatatacttggatggcatttttttatcatttggttataagcgatgatacgttgccaagttctgtgggctgaagacttctattttgtccataatgttagcctgttaggttcttctaacaaactagtggtgctatttacttgtgcacgtgtacttttagtaactttagtttagttctttacaatttcgtttcaccaattagatcgataaatataaatatatggtgaaaatatgatatttttttaaaaaaatcaatttcatcttgttgcatagtactattctattacttttcatactcattataagtttgctagatgatgcaattgttgctatgagttaacagtgacaccctcgacctaaaatcctgaatccgctcttggaagagcgtgtatatctatatatatttatatatagatatatatatgtatacatatacatatatatctacatacatacatacatacatacatacatatgtatgtatgtatgtatgtatgtatgtatatatgtatgtatatatgtatgtatgtatatatgtatgtatatatatatatatgtatgtatatatgtatatatatatatatatatgtatgtatatatatatatatatatatatatatatatatatatatatatatatgtgtgtgtgtgtatgtgtatgtatgtatgtatgtatgcatgtatgtatgtacgtacgtacgtacgtatgtatgtatatgtacgtacgtacgtaagtatacatatgtatatgtatatatgtatgtatgtacatatgtatatgtatatatgtatgtatgtacatatatatatgtatatgtatgtatatgtatatatatatatatatatatcatatggggcaccatggtgcccgggcaccatggtatctaatgcacaaaatcactcaaattttttaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttaatatatatatatagagagagagagagagagagagagagagagagaacggttctacgtcgaattcgctaatatacgatagggacccggttcctggatggataacaagttcatctttttttaagataatgcacacagcaagttcatgatgcattgggtacacaaaatctaagataagcatatgatacctttctgcttttctttggtcaaaaacagttcgaagatactgaaacagcatggctacatcactattg

SEQ ID NO: 75517 - DNA, 23251 bp, Oryza sativa
  unsure (1)..(23251): unsure at all n locations
ataccactcaaacatgttagcaaatcaatcttctcttctttcgagagagtgtagcaggctggaggaaggtaaaccctgccggattccgtagttatgggatgtagttccgagtgaacacttatttcttccagatctcgtcgggcgttgagaccatcctttgtagtacctgggttaagcagtaatcccgttaaactctcgcatacattcttctcgacatgcatcaaatctatgcagtggcgaacttcaagatccttccagtatggtagtctccaaaatattgacttctttttccacatgctcctctcttttgtcttttgtttttccacatgttcctctgttttttccttcgacatgctcttctcttttgtctttccaattttcctcttttttccaaactcgttggttattcccatcactaagttgtgcacctctgtccctgttagctctgtcgggggtccggctgtatctctgtgtccattgaaattctttctcatattcctatacgggtaataccttgggagaaatctcctgtgacccatgtagaccgtcttgtgtgaatgcttcaaccatttgcttcttgtttcttccatacactccgaacacgcccatttccctttcacagtttagccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcgatccttgaatgagcatggtaagcataatatagtactgaatctgctgggtgcctcaacacactattgactttccgttcttcggcattccagcgcactagcttagcttgttccttattcgcaaacattctcttcatgcgctccgcaattgggagataccacaccacctttgtcggggcttcccctctttgacttacttccttcaccttcactatttgctcgtttgtatcttgatgccccacagacagggcagacatccaagtcagcgtattccttgtaatacaaaatgcagtcgttcggacatgcatgaattcttctgacctccaggcccaacggacataatacttgcttcgcttcatatgtcgtctgcggtaaattgttcgcctctggcaacaggtcctttaacagctcaagaagttctctaaaactcttgttcgaccagccattactagccttaaacttcatgagttccaacacgcataacaacttgctgtcttgcatccatcatacaagggtatctaacaatcttccaccaaaatactaaacttctcaaaatctctatcgttgtcctctgcgtcttcaatgtcatgcaacattgtagatagacattgagtgtccaaatatatggtctctccacctaaaggagaaggtacgaacatgccttctcgagctgcggcggtgttctctacatcctgatccaacacttcttctgctgcgatatcaggcgcctcttgctctccatgcttagtccagcaggtatatttcttcatgaatccattcattatcaaatgagcatgcacttcatcgctattaacgatcatttgttcattcttacagttcctacatagacacaacatgtgcatgctcatcctactttttctgtcatttttcgcaaatgtgacaaattcagtgaccccctctctatactcggtagatgaacaatgcgcatagtacatccatctacgatccatctgaaatcaacaacatacgaagaaaaatatatgatgatcgatatattaagaatgaatggagaataatgtgttttttaccttaaattttagcaaaaatttaccccccttgccctcccaaccgatttgtgaatagtgaactggtcgggatgaaaagcagttggcggtttgtggggtatttatagacccaacacacctcaaacaggttagattaaaaaatcccgtccaaggtgttggtcatacctttgacgggcttcaattgagttgtccgtcaaaggtattgacctacatatgacgggtcgtaaaaaaaatcgatctgtcacaggtggtggaccaccacctgtgacggctcataatgctactgcccgtcacaggtgagaggataccagtgacgggttggaaggaaaacccgtcacttcctcacctgtgacggcttttccttccggcccgtcacaggtgaggggatacctgtgacgggccgtggccggatgccccaccgatgacggcaaaggtgacggtcatctgtgaccaattcataagcccgtcactggtataccgtcacagatgtagagttgtggcgtagtgtatagaggtgctggttctttggtaaaaaccagcacctatataggtgttggttttatcaccggcactaataacctgggataatcagtcctacttgactggtgtcgactgatcaatctagcaactacggacgattctgatcagccagcaccaactgtcttttttgttgtaatagtgagtgctgcttccggtaaaaaaaaaagaattactgatggtaatttttttctcaagtaagaatttgttctttgttgcagggaaaagtaataatttgttttgcatagcttttatctctcacacagccttgaacgctgtgtcctctttaattgtaatatacatttgttttgaatttcttgctctaatcggttttgtttggtacacctcccttccgatctgcggtttggttcttcatttaatttgttctatttaatagttttccctttagctgtatccacttgctgctaatttactcctagcagttctgtgcgaaatatttgattttctctagaataaattcttcagtagtttagcgtgaccatgtcaatatggatattctttctctaaacaatgggcgaatccccgtgtaaagatatactccctacgtcctacagtataaggaattttgagtttttacttgtaaagtttgaccaatcgtcttattcaattttttttcaaatataaaaaacgaaaagttgtgtttaaagtactgtgaataataaagtaagtcacaaataaaataaataataattttaaaaaaaattgaataagacgagtggtaaaacgttgcatgcatttcaggcagaggatagcacagatgacggggaatggcctacaccgatccatccgttggtacttggtatactggaattgtggcccaaaatctaatatggagcatactctacatttctacaagtacttattttttctttttagatatatacatggtttttacagggaaaaagttcacgtaagatctctcaacttgttgatcatctctgaactgaaatatcggatataacatattcttaatgctataaaatcagatcgtctcaaacgcagtattgctcccggttttgactgatgtgacggctgagacagcgtgagacccatgtgaactcacatgtcaagcgaagcaatcaactcgattgccacggcaactaatgatgccgtcaaacaataggtgtaccacatgattctgttctataagaacgttgcacttgcagttgcagccgttccagctggggatgaatcgctgccatgcctagctagagcggcctggaggacgacagtgggctcgctgagttgttcgtcctgacacttcccacccatgtcgtctcgtcatcatcgtgcaagtgcagggggttctctccgtggcacgtcgtccagcgtgatcgaattaaatttgaaaatatactgtttattcaatttcttctaataaatattcgggatgtaaaattttttgcctaaatataccgtcgatttcgtacaaccgttgcgcgagaatgatacgggaataacgtcgtgggtggtatcacgcagtgaaggcgcgagaccgcacggtctcgtggaaaggtacagcgaggcagaacagtctcgcgcaagcactgagcgagaccggtgccatgctgactcaattagcgactaattatcttgattagcgattaattaataatttattaatttgctaattagaataattagttactaattattattagttaattactaattaagtaattaagcactaattaaatggagccggtggacagtttcgctgtttaattccgcgagaccgaacggcctcgctcttccattgcgcgaaaccgtgcgctctcgtgccttcgccgcgcgagaccgtgcgctctcgcactttcaacgcgcccatgacgtcacacccatctcgatttcgcgcaaccggttgtacgagatcgacggtatatttatagaannaaatttacatctcaaatattcatgagaaaaaattgaatgaaaagtatatttttaaaatttaattccagcgtgatctcccatccagatcctacttttgccatgtctccctgttcttggtcgctgaaaatggcggcgggaagaggtgcggcgtggtccagaagggcggcggccaccctccttttttcctctcttcatcatcgtttcataggataaaaggtgcccagcggaggccgggagacacccgattgacagcggagagaagggcccgtggcgcgcgacggcacaataggttgcttgtcccctgcgctcgatgtcagcgcggtcgccggttccggcaacgtctcctgctcccatacgccatgtgctcgcacgcagaggccactgtgtctccacctcccacgcctcacagtgcgccgatactgttggcccagccactcacttgcacacacggctctctctccctctctctcagtcgatggaactcacacacacacacaaagaagatgcactgacggaggaagaagatgaataaacaagaaatttccgtgttgtacaccagcgcacacaacacaggcactagtatttcacttttggcactgctaacaaatgctaattacattggttaaatagaccacacacacaggttaagccacgtctggccgcacaactcggacagtcactccatcacttaatcgccactaatcacgtctctatacatgcagcccatatctccttacatgcatatcactaacacaaacatgcaacacagctagcagatccactatccatgccactattgcagctacttaactcggccactactccaagccgatatccaccttagctccctacatgcaagcaccaacaggcagattatggactttcttgaccaagctaactcgtgcacgcactaattacaactcacaccaaagataaacaacaagattaagtctaacaccgatctcatcatggcctctctcctcaccggtaccccacctgacccacatgtccagtcgggtgccaccccttcgccctattccagtgccgtgctctgttttcctgctctagatgcacaaccccgaatcgttgccaatcttagagccaccgcacctctccctacctgcctttcgacctttgtcacccgtcgcctgctcccgtcctggatagagagagaaggaaaatgggttggctactggcatgttgggctcacgtgggtataccacgctgactcagtcgggttaacttcaatccagctaatcatgtcagttaaaaccgagaaccaaactagactttcggtaaacggttttgtaagttgagagatatgttatatctggtactgtggttcgaggatgtaattttaacctgacgtcaagatgagggaccataagtgaacttattcctttttgcaaccattaggcaatggctggccaggcctgagatttgtgatccatgattccacgtaatgcatatgggtctccagcttgctgtttaatcgccatcagccgggagcccgggaaaatttgttcggcccaatagaatagtttacggcatggggcagacatcagtgattttggtaaattggtccttttaaagaaacttatttataaaaaccatgttaaaaacgtatttcaaaaattgagcacaacctcaacaccatgtccgatgacgctgagatctaactaatcaacaccatactcggtgatgcagcatgctaaacccccgctgtcactgtaacaccgtgggcgacatcaacgctaacccagctggctgacatgcacctttagttaacataaacattataggcgtattgtgcagccactagtaaaaaaagcatcataggtgccggttcccaattggctattccaaccggcacctattggtcggcactaatacaagcaaccggcacctataggtttgcacgagccaaaaaaaagagccggctcgaatcgagccgaactaataatcaccttcactgcgccatgccccacatctagttgtttgaaatccccaaatccccacatcacagatcatccacaaatcacatttgaaatccacaaatcaccacatcacagatcatccacaaatcacagatcgaaatatattaaaaaaatcatccataaatgaaaaaatatcttaaaagaatctacaaatcatcccaaaaaaatcctcgggcaccgctgcctgcccaccacctcccctcccaccggatccgacggaggggagtgcgcggccgccgccgttgccgtccctgaggtccgccgtctcccatccagtcggatctagaggaggggaggacacgcgcggcggctgccgccgcctccaccggaccgccgccggctatcgccagaggtccaccacctcccctccggccggatccagtaaaggggagggcgccaccgccaccagccgctgccgccgcctctgctaggccactgccgaagcccaccgactcccaaatgccgtcccccacaagctcccctccacgccgccgcctcgcccgtggggtgcccgctgcctcccctcccgccggatctggcggaggggcgggcgtggctgccgcctccggttgccagccgagggggctcgccgtcttcgccgctcagccactgccgagacgcgagagagagaggggagggagagcgtgagagagagaggggagacgcgaaagctgagagagaggagagaggtacgagtagatggataaggcgcatatatatgagttgataaggacgtgcggtaggtgcggtgcttgtagactcggctgtccggttcggctcaaagctataggtgccgggttttttgctagaactggcacctataatgtttaaaggtgtcggttctatgtttttccatcgtatggaggtgggaaaagctccgacacctatgagctgttctctatgaaggtttttgtagtagtgagcggtagtgcatctgtgttgctaaccttgagcgcagggttaagccaaacggtatatttgtaaacgaaaaataatttgtgaataaaatttcacaggctgaaaataaacttccatgaaaaaactcctaaaatcaactctaaatttagaattgaaaatttaaattttgactgataaggataagcataagcaaaaaaagataaagctgctagttcagttgtttttgttttagcaggaaagctactgccacactcaactacgctagggttttgatgcaagacacccaaaacaaaaaggagtatcaacgaaactgccgtatgttttttgagtaaaaaactttcagatgtaattatagtataattgtagtgtaattacatatgtggtttactatattgtaactgcaatatactccttccgtcccataatataagggatttaagagggatgtgacacaaagtgtgtccagattcattgtactagattatgtcacatccctccaaaattaagggagtaacttatataaaacttacattcaactaaaatttggttagctagcactgagatcttatgcaacacttgtaaaaatttctttctagcaatttttctcccttcatgcataaatctcgaggtgatccgatggtttcaaatctgaaagttttgggggcaaaacaaacttggtagcacatccaaacataaaaactcatatttttgttaattattaagaaaccacatccttactgtcgggcctcttttccttcttttttttttaatttttttccctccagcccaccacaccatctcagtccaacccaccccttccacctccagaagctagcccagccagccgctactgcctactcctgcttcggttttctgctgttattttctctgataagttgtagctatgataactctaattgtggagattatggataccccatacccgcatggcgtgtatatctgactgggtatggggtgccatgtatcgatagaatatattcaaagggactcgggttaaattccaaacttgtatgtcaaggaaatactcgggatcctaatcggttacgattgtatcttatctgtaactacctattccgttagggatatgggctgtactttgtaatacggaccctttcccctatataaggaggggtccgggtgcctcttggggacacgatttttctcccagatcatacgatcaattatacactcggcggatcaatccccggacaggtgtagggtattacttcttattaagaaggcctgaacctgtataacattccttgtctctaaacctatccacttttccagcttgatagccaccccttttagtaatgccgaaatcttgtttcgacagttgacgcgccaagtaggggtagcgtcaagttcttcgccgactagggcaatgggtttcgtctccggcatcaacgacttcgtcttccctcctgggcaggcattctggttcggcagcctcaacttcatcaccaacgacttcggcaagatttctatccttgactcggatccgaaccagtcggggagaggccaggtctccgctctgttcgatatcctgaactcggccgaaatctactccaagatcatctcaaccgagtcggcttcaaaccacttggacgagatccaatctactccaacatgacctgatcaagacgatgaggcctatccctcaatcctgatgaaactccccgacgatttggctgctgtcttcaccacaagggtgtcttctccccgtaggtctaggcgggatccagcctcggctccgatccagtctagctccagggaagtcggtgtcatactccaacctcacgggacagtttcgacagaagaattggatggctatcttagctccccaggtgtcgattctcgaccgacagatatcctcgagtacgatgacttcggctaccactacgactaccacaacctcgacgacttcgacgaaggctacgaagacaactacacgcctctcttctttggcgttttcatggccgacaatgagacggaagaatagcgtcaagcctgagaagcagaagaacagcgcacacaacaagaagccgcgcgtcgccgactggaggaggagcgttaagcacaagagcgagaacggctgcagcgtgagcaacaggagcgcgaacaggccgcgaaggaggctgaggaccggcgacagcgcgccttggaggctgggcaacgagcacgagaacttattggacaacaagacgttgaagggacggcggtttttcgcaccccgcagcagaacgcggttgcagcgatcacccttcttgacactctactctaggaagacgcacccaatcacgtcgtcaacatcttaaaccagaccaagaccatgatcgccgcctcagttccagtgaactcctcaagcgtccgtacaccgactggcagccgagttccgcctctttcatctcaagactatcaccaaccaagcctcagcattgccggcgcaggatctagtcgcaggagcagcaatcacggtgaatgatctgttcactcgcctcccgaccgacacagggagcgttgggtcgaatagccgcgctctccacgtcgaaggcgtcccgtcgatcttcgtgatactatcaaccagcgacgtgcggagagaggccacatcccccaccattcactagatcgttacaacgacgatgtggatggagttgccgccttcacaagtgacctgcgttgagtggattggccggccggcttcaaaccgactggaattgagaagtatgacggcacgacaaatcctaagtcaccgtctatggtcttgcaattcgcgcagcaggaggagatagcaaagccatggctaattatctgcccgtggccctagcggactctgcccggtcctggcttcacgggctaccccgtggcacgatcgggtcctgggcggagtttcacgaccacttcatcgccaacttccagggcacttttgaacgccctggtacccagtttgatctttacaacgttatccagaagtccagagaatcccttcgagattacatccgacgtttctctgagcaacgtaacaagatctctgacatcaccggcaacgttatcatcgccgcctttactaagggcattcgccatgaactcttagtcggcaagtttggctttaagcctcccaagacggtcaagcagatgtttgaaaaagccaatgagtacgccaaagcagaagacgctgtcattgcatccaagcagtcgggcagcacctggaagccaaagaaagatgtgccgactacagggggagtggaagtgccaatcacaaggatcgcaagcataagcccgaggaacttgtggcaactactacaccatcctcccgacagcattcacgcgtcaagacattcgacaagatcatgaactcccaatgcccgcatcatccgaattcaaatcacgcggccaaagattgcttcgtctacaaatagttcacagagcaatacgccaagaatgcacgcaagacgactgacggagatcaaagtacgtcgaagaaaaaggatgatgaagatgatgcctcgactagttttcaagactcccgtaaagaactcaaccacatgtttggtggacccctggcttatgaatccaagcgaaagcaaaagctgaccgaacgggagatcaatgctgttcagcctgatacgccccaatatcttcagtggtcagagactgctatcaagtttgaccactcggatcatcctgaccgagtggtccacccggggcggtacccttggtactagacctagtggttcgcaacgtcaagctccgacgatccctcatcgatggtggcagcgcactcaatatccttttcgccaagactctggacgacatgcagatcccttggacagaactaaagccgagtagtgcgccctttcacggagtcatccccgggctatcttctactccactcagccagatcactttgccggttaccttcggtacacgggagaacttccgcacagagaacatttgcttcgaagttgctgatttcgagacagcgtaccacgctatactcggacgcccggcgttacccaagttcatggccgtcccgcactatacctacatgatgatgaagatgccaggtcctcgaggagtcatatccctgcggagcgacatcaagcaagccgtcacctgcgacaaggaaagctgcgagatggcacagactcgcgagatcacgctcgctcgagaggagatccgactagctgcatcaatagcaacagaagaagaagtgcctgcaaccaagatgccaaagagcggagaaggcgacgccaagactaaagccgagtagtgcgccctttcacggagtcatccccgggctatcttctactccactcagccagatcactttgccggttgccttcggttcacgggagaacttccgcacagagaacatttgcttcgaagttgctgatttcgagacagcgtaccacgctatactcagacgcccggcgttacccaagttcatggccgtcccgcactatacctacatgatgatgaagatgccaggtcctcgaggagtcatatccctgcggagcgacatcaagcaagtcgtcacctgcgacaaggaaagttgcgagatggcacagactcgcaagatcacgctcgctcgagaggagatccgactggctgcatcaatagcaacagaagaagaagtgcttgcaaccaagatgccaaagagcggagaaggcgacgccaagactaagaaaaatcctctagatccctcttatcccactaagactgctgtaataggtgctgagttagattgcaaataggaaagcgcgcttatcacctttcttcaaaataataaagatatctttgcgtggaaaccatctgatatgcctagtattcctagagaggtgattgagcactctttacatgttaaggaagacgctaaacccattaagcaatgactctgccctttcgcacaggataggaaggatgcgatcaaggaggaattgaccaagctgttagcagcaggcttcaccaaggaagtcctacatcccgactggctggcaaacccggtcctggttcggaagaagacggcacaatggcgtatgtgtgttgattacaccgacctcaacaaatcttgtcccaaagatcccttcgggttacctcgcattgaccaggtagttgactcaacggccggctgcgagctactcagtttcctgaattgttactcaggatatcatcagatccgtttaaaagagtccgactgcttgaagacttcattcatcatgcccttcggggcttactgctacatcaccatgccttttgcattgaagaacgcatgagcaacttatcaacgcatgatctagaaatgtttttcaactcagattggtcgcaacgttgaagcttatgttgatgacgtagttgtcaagaccaagcagaagaataatttgattgcggatctaaaagagacctttgcaagcatccgtgccttcaggatgaagttaaatcctgaaaagtgcatcttcggagtatcgtcagggaagttgcttggctttatggtatcccataggggcatacaggccaacccggagaagatcaacgctatcctcaacatgaaaccgccgagttcccaaaaagacattcaaaagttaactggatgcatggtggcactcagccggtttatctcacgactcggcgagcgggggatgcgctttttcaagttactaaagaaaaccgacaatttccagtggggacccgaagcgcaaaaagcctttgaagacttcaagaaacttctcactactccaccggtcttagcttcaccacatctgcaagagccgctgttgttatatgtgtcggcaacatttcaggttgtgagcacggtcatggttgtcgagcgtgaagaagatggccatgtttatttcgtcagcgaggttttgaccaactccaagacaagatatcatcaggtgcaaaagttgttatatggtgttttaattaccgtcaggaaattatctcactattttcaaggtcattcggtcacggtggtcacatcgtttccactcggggacatacttcataatggcgaggcaaatggacggattgcaaagtgggccttagagttgatgtctttggatctatccttcaagccgcgaacttcgatcaagtcccaagccctagcagattttgtcgccgagtggactgagtgccaagaagacatgcctttagagaagatggagtattggactatgcattttgacgggtcaaagaggctttcaggcaccggagcaggagttgtcctgatttccccaactggagaaaggctaaactacgtattgtggatacacttttctgcgtcccataatatggcagaatatgaggcgcttcttcatggattaaggatcgcgatatctttggggatccggcatctgatagttcgtggagattctcagttggttgttaatcaagtcatgaaagagtggtcctgcctcgatgataatatggctgcttatcggctggaggtacgcaagttagaagataagtttgatggcctcgagctaacccatgttcttcgacataataatgaggcagccgacagattggccaattttggttcgaaacgagaaataactccttctgatgtgtttgttgagcatttttatgaaccaactgtaccaaggaaagaaacaaccgaggctgtggacactcaagaagtaagcatgatcaaagccgactagagagagtcccttatcaagtttttgaccaagcaagaactccctcaggataaagacgaagccgagcggatctccaggcgcaacattacgtcatacatgagaccgagctatacaagaaaagtccatcagggattctgcaacgctgtgtgcctttggaggagggaaggcaattgctaaaagatatacactcgggcatctgcggcaatcacgctgccgcatgaaccattgttggcaaggcctatcggcagggttttttctggcctactgcggtatccgacgccgataaaattgtgcgaacatgcgaaggttgtcaattttttgcccgacagactcatttaccaactcaggagttgcaaaccatcccgttatcctggtcgttcgccgtttgggggctcgacatggtcggcccattcaaaagggctaccggtggtttcactcatctttttgtagctattaacaaattctcaaagtggattgaggccaaaccagtcgtcacgattacagcagacaaggctagagattttttcatcaacatcgtgcaccggttcggggtacccaatcgaatcatcacagataatggtactcaattcactagcagtgtgtttaaagatttttgtgaagacttcggcatcaaaatttgctatgcctccgtagcgcatcctatgagcaatggacaagtcgaacgcgccaatggtatggtacttcaaggaatcaaagcgcgagtcttcgaccgactgcatccctatgctgctaaatgggtagatcagctgccatccgtactttggtctctgcgtactacgcccagtcgggccacgggtcagtcaccgtttttcctggtatatggtgcggaagcaatgttgtcaagcgaggtagaattcgaatctttgcgatttctcaacttcaaggaggagcgctacggagaagactgagttaacgatctcaaccgactggaagaagcccgtgaggcagccttaattcagtcggctcggtatttacaagggttgcgacgttatcacaaccgcaatgttcgatcgcgggctttcttagtcggagacctggttttgaggaaaattcaaactacacgagatcggcacaacttgtctccattatgggagggaccgtttataatttctgaagttactcggccaggttcttatcgactcaagcgtgaagacggcactcacatcgacaactcttggaatattgagcatcttcgtcatttttatgcttaggcattacttttgtatcttttctccctctttgactgctaacatcaagttgctccttgagttaccagtcgggggctactataatattaatggagcgtgattcttatcaattcaatttgcttacttgatttatcattgccttgttcgattttttggcctagtcaatgaggactgaaagttttcaagaacttttacgggttttaggctcaataaggtttgacaaaaacttttaagaaatcaggagttgagtttaaattatcaaacacagcataaattcatcagtattgtacaaattgtgcctccatcatcataagttacactatacaatgtcaatcagactcaatttttccattatcagaatcatcagacacagtcggcctgagattgttgtctagaaacctctcaactgcatcaacaacgatcttgtcagcagccttctgtgcatcattgatgaggtcaagggcgtcttcttcacttgtcccgtctgcaaagcattcgacagcgtcaatatcgatcctcgggtttaaggacttggtcattgccaataccatgctcgcccccatgcatccagcttccttgatgtttttaaagtatgtatccggagcagctcttagcttgtcgaagatttcaacagcatcgaacgaactcggaccattattattaaaaaacatggcttggatgagtggtgtagcggcgttggcaacttcatccctagctccttcaagcttcttaattttgttgaccaagacgtcgaattgagcctgagatttaattttgcgatctgcataaatggttcacatcaataactgggcacgaagacaagagtggttctggagtttcaactatgaatacattcgacgtctttcagggctgagtcccactgtttggtcaattcacctttgtctttttccagagctttgattcgcttttctaactcagtgatcttggcagcttgcactataatattttccattggtcaattacatacggatagcagcttggggtaagtcaaacaggaataaaggttacctttggatgaaccactcagctcgaaattggaatcttggagctcggcgattcggtcccgaagatcatgtttggttttcctggcaagctccctggtttcacgaagttgggatctggtcgcttccagggttccaaggtgaggaaccagtttctcgagggttgcagtttttgcttcattcctaagatggattctctgcattgcaaattcatctctatttagtaaagtggccgacaggatgagtaaagctatgtgcaaagagacatacatttacaagacgagtggcctgattgagcgtctttgcaagcaaagacccttcctcgtcttctttctgcttatttattacaatcccttgtggctgcatttcgtcatcccaccatttgactaagataggtgggcgagaatcttcagccgactgaatccgaagaacttcttcttcatcaccgatcattgggcctttacatattcacagatgatgataaagcaatcgaagaggatttgtcagagcaaaatgaatttagaagagttgattacctgttatgatctttggttgaggacgagcaggcccttgcaccctatcggatgaactagacttcgggtcggtgtcggtatctttttggggagggctgcttgctcgggcctctgtttccgggatgtcctcatttcattctgtacccaactggtttccagtcgggggctcctgatcagcttcggccgactggttcccggttgggggctcgttgctggcctctatattatcggttgctggttgattactactcgggcgattttcggcggtcagcccagtttctgttgtaggaccagtctccatgctagtcggttcagagtcttttccagaaggatcgatgtcagatggcttcctacagatttgagatatgctattaacactactttgatggtgtatgtttagcgatacagggaagattattaaatgacttgtacctggatgacttcctgatttttggtattggacgactggatgttttcttcttcgggttagcttgctttggttgttttccagtcacctctttgttgccagctttttcaacattgtcaccctcatcgtcactcagtattaatttcctttttcgagagttagactagttagttggctttgagatgcttggctgagcatcagactagattttcggccctccactggcttgacctgcttgccggtggggtgagcggcgttgagcgattgggggatcagatttcatcaaagaaagttcctatgcatgatatttcaagttttcagccaaccttgcaaaagacaaaaggataccatcagaaaggccgagatgtctgttacatactggtggaggagggttgaaagcattgtatggcactactggaagcaggtgtgagtagctaactgcgatagcgttagagaagattttgtacattctctccttcatgattttaaactcaagagattctggatcttcacggttggggtcattcttgccatcaaattcgaaggtagtgcgagatctttctttgattggtgccagccggctcttgatgaaatgccgagtgatttgttccccttgcagaccctgttctttaagtttcaacatgcgttccattagagaaagagcttgggcagcctcatctcccattggaagcgagttccaggtgtgttggtatgttggatgaaggcaggagtactcggggagcgctcgctcaggattttgcccataaaaccagtttgcatgccagcccttgttcgaggttttgaagggcatggagaagtatttctggcttaaggttccccttaactgaaaacctgcccccccaacgacgcatggcttgctcttgtttggctgggacttcaggaagaagatgcggcggaataaggcaaaatgtggcctaatccctagaaaagcttcgcaaacatggatgaaattggcgatgtgaactatggaattggagtttaggtgatgcaaactaatcccgtaaaactccaggatcccccggaagaatcttgaggttggtagagaaaaaccaccatagaagaaatgagaaaataccacgacctcgtgtgtgtcaggggtcggaaatgcttcgccatatgccagacgccacccgataatctccttagccggaagaacgccatgtgctaccatctccttcaaattctcctctgttacatcggagggagcccattgactttcgaagctttctctctcctcagccatgggtgcgagatggatgatgagatttggggcgaggacggcagcgagtgaagaggagattggtgcggtggatgtgcggaagatctatgcaagagcactaagcttcgagaagggtggaatggtgtggatttgcgaaccctagtctccgtcggcgcagtgtttgtactgtagcgggaagtggggaaaatggagaggatcgcggcggggaagacgaaacggcgccctattttagcattttttttcgctagggtatcgggaggtgctaatgggcctgggcctaagcagtaccttcagcccaattttattgtctgcgtggttggttgtgatccttagggacttaggcatatgtttttgctttggcaaaatttgctcacgacagaatagcccagtgctgctcaaatcctttttgatgcagttagataattctttggaatttctacaatgcaaataaaaaggtgcccaacagaaaagtattatattaattttgttggcctttttaggctacaaagctattcgggtcttaatgagatgactgattttaaatggtcattctcttagcatgttatatgcttaccttgataatggtgtgagtcatagcttaggctatttagactcgtcatttatcatgcttcataccacatttgatggatcttttttagagtttttactcggatttttatcatgtgtgttgatttatagagctttagagtgtttctcactcgggcctcttctatatttcttttttggcgcattaaagctaaagcagtcggctggatgttttatcagatgccgcatatgcttagctatatgatcccttgggtgatttggttgagaaaccactcggatggatgttttgatgcattttgactatatgtttagtttttatttaactaatcacatagttgggggttacacctaattaggtgcatctagtcgatgcacctaattttttctattttcagcccttcacagtctttgactttagtactcgggagaccaaggcagaagaagttgaaacactcggattatcgttttgaattacgagagaagactatttcgtcgcctgtaaaggtctcaggggctacggtggagattatggataccccatacctgcatggcgtgtatatctgactgaatatggggtgccatgtatagatagaatatcttcaaagggactcgggttaaattccaaacttgtatgtcaaggaaatacgcaggatcctagtcggttacgattgtatcttatctgtaactacctattccgttagggatatgggctgtactttgtaatacggaccccttcccctatataaggaggggtccgggtgcctcttggggacacgatttttctcccagatcatacgatcaattatacactcagcggatcaatccccggacaggagtagggtattacttcttattaagaaggcctgaacctgtataaaattccttgtctctaaacccatccacttttctagcttgatagccaccccctcttagtaataccgaaatcttgtttcggcactaataaagacataaataattttttagcttttattactatctctattccaaaatatagcaacttttagctatgaatctggacacacagttatccagatttatagctaaaaatgcttatattttgggatggagggggtatacaatgtatcaactatgcatatgtgtactaactactaatatagaaattgatactgcaaaaatacattacgtttccgatcgacaaaaccgggtgccaagaggcacccaccgtgacctttcttaatttttgtttgacaatttacatgtcttaagacttctctctgagtattgaatgacttaattagacgaaagtctttcaacatggcaattaagtcgacaagttgtcacatgcactagctactggttttgttctcaacgttttcacgaccaataactcctccgcttttactgttaatggcagcatgatgtatcgtagaataaatgtatctattaattttatagtttttttagataataattttatggttatttaaaacatttaaatttgagactcgaatatactgtatcataaaatatggctacattttcaagtttagtctagctatattttgagacaaagatagtatatataacttgtaaatacatcctacaatcatgcattttaatttcaaatttatttctatatgtacaaccagacaagtagcaggtatagtacattatatatgatcgattggattcaacggatccaaagcaatagatcacccctaattacaatagagtactgtaaaagggaaatgtttcatatccacacaacccttctcgtctcgtgtatacaatgtatgtacctattaaaaaaacatcaccaaaaattgtagaaaaagttgtatatgtacttttagtagtatcatatttatgaatagagtctcatcttcaaattcattccatatatggtgttaaacaaagataaaattttgatcgatttatacacttaaaactattaaggattttatcttttacattacggctaaaatataataaatttgagattaagactttatacattaagtgtaatgctattaaagtacatgttaaatttatttttagatttgttgatgaaatttgttagttgatgtgcacggtatgtatatgatacattcccctataaaacaagccttactaaattgcaatatgcactggcggcgtcgtcagcactattcttaaaaacgtggtcaacttgactaatcataattccaaattgtctagaaattccatgcatgttatcttagattgatcacatggcttcttaattttcaacgtttcaaaatgaccgtcactgtttgtgatataaactgctaagacttttactcttaaatttctagagacctatcaagtatgaagtatcaagcaataggtaagtcgcatattcccacagagttttagctcaagacgatgacgttcgtggtaaccaagtcgtcgccgtcggtgctcgtccgcccgtcggagccgacgccggcggcgaccatccggccaacctccactgacatgacacgcctgggcatgtcgttcacgtcgttccacgtgttcgagcgcggcgtcgacgagccggcggagaccatcaggcgcgcgctgtcgcgtgccctggtccactactaccccttcgccggccgcctcgccggcagcggcgacgacgtcgtgttctcgtgcaccggcgagggcgtggtgttcgtccgcgcgacggcgaactgcaccctggaggacgtgaacttcctcggagcaccggtggtcatgtcgctcgccgacctcgccgtccggtacggcgggccatgccgggcggcgtccgacccgctgatgatgatgcaggtgacggagttcgcgtgcggcgggttcgtcgtcgcggcgacgtggaaccacggcgtcgccgacgcgtgcgggttggcgcagtttctacgcgccgtcggcgagctcgcccgcggtctccactcgccgtccgtcgtgccggtcaggtacgacgagtcgctgcctgacatcccgcagcttgccaccatcctcctcaagcggctagccgccggcgtaaaatttgagcacgtcgacttcgcctactgcgacgtcatcatcccgtggagcttcgtcaaccgcgtcaaggccgagttcgggagcaggcacgccggcgaccggccttgctccgtgttcgaggcggtcaccgcggcgatgtggcagtgccggacccgcgccatcaatggccacggcggcggcgccctcgcgccgctcgtgttcgcggcgaacgtgcggaagcacgtcggagccaaggacgggtactacggcaactgcatcatgtcgcaggtggtggtcgccacggccgacgcggtggcgaacggcgacgtcgtcgacttggtgaagctgatcaaggacgccaaggagcggatcccggtgctcctcagcaccaagacgcttgggctcgacgacagcggcggcggcgagctcgtcgccgcgctgtgcgggtacggcgcgctgtacgcgtcgagctgggcggggctcgggctcgacggcgtcgacttcggcggcgggaggccggcgcgggtgatcccctactcggaggtgaagatgctgccgtccatctccccgggcgcgccgtgctcgatgatggacggccatggcgtcaacgtggtggcgtcgtgcgtaacagacgaacacctcgaggggttccgggcacaattggcgaggctctagtgatctgccctatttcaaagagtatcctaaagcgatttcaaattttcaaatctttacttttatgaattaagttttgcagatactttttatgtctttgctccagtgaaccgctcgctttatgaaagaagaagaagaggggggggggggggggcttttaactatttgtcactcttacgagtggttcttaacgatttgccactaggcccacatgtcatagacatataagggcccgcatgtcatagacacagtgtggcaaatcgttaattgccatgtcacaagagtggcaaatagggcggcgggctaatgggcgatcgctcgatcccaatccccccatacgctctctccccctttcctcctcccattcttctcttcctactacaccatacatttaaaaaaataaaaaaacaaagttgaaaaaaattatatatagaaatactatattaaaaaatatttgaatttaaattcaaatttgaaacgggtaggtaaacttttgacttataaactttgggtgtacaaagtaagagataatctctgatatgccactgaaaattggtctgatcccttatatgccactgaaaattggctcttcccttatatgtcattggtccaaatttgcgcaccctctcaagccactactgtcagttgaccgtgtgtt

SEQ ID NO: 75518 - DNA, 10126 bp, Oryza sativa
atttggatcaatggcatataagggaagagccaattttcaatggcatataagggatcagaccaattttcagtggcatataagggattctctcaagtaagagagataattgaattcaaattcaaatttaaatcgggtatgtaaacttttgacttataaactttgggtctataaactttaggtgtataaactttagatgtatagaaatactatatataaataatatttgaattcaaattcaaatttgaatcggatataattcatattcaaatttaaatcggatatgcaaacttttgacttataaactttgggtctataaactttaggtgtatgaactttagatgtatagaaataatatatataatatttgaattcaaattcaaatttgaatcaggtgtataaacttttgacttataaactttgggtctattaaaatttaggtgtatgaactttagatgtatagaaatactatatataaaaaatatttgaatttaaattcaaatttgaatcggatatataaacttataacttataaactttggatctaaactttagatgtgtaaacttgaggtgtacaaactttaggtgcataaatttactaaaataggaaagtaatacggtgcctaaaaaggaaaccacgtggaggagagggggtatcagttgatccgatctctaggggcgatcgatcgccccatagccttttcgagaagatcatggattgacatgtgggccggcccaacttatacaattttgttttactagcaaaagtgcccgtgcgttgcaacgggaagcgtacagataagaaaaatatgcaatcaattaaaatacaaattcgttgaaaatttttggtatttttaagtagatatgtgtataattaaataaatttacaagtaaagaaaatttgagaaataaaataacatggttgaatttaattttattaaattctccatgattagttacgctctttagaattttattggaatttttagagcttaattgctaattttaataatacaaacatcatttaacaattatttaatttgaaaaagaaaaataatccttcattttaggtttgattcgaaataaacacattaagtaactataatagtaaatgctactgaaaaaatgaagtactaaaatgaacttcttctctttttcttcggcctgaggggcctaaaatagacttatttttcggtccttgccggtcggcccacggccttttcctcatgcgcgggcgcacttcccctccccaggccgcaacctggggttgggccggaaaagtggcctcgctctcgatccctcttgggccgattttgacccggccaacgccggccgtccgatctctagggttttgatcggacggccaagcgtcgagatcagggaaacaaaaccccctccctctccgcagccaccgaaaaccctagcccatttgcttctctcccttctctctcttcgacgccctccctccgcgcccccgatgctcccgtgcccaagcggcggcggcggcacctctctccccaagcgactgcggcggcggcgacgcctctctccccgagcgactgcggcggcggcgacgcctcaacccccgtgcccaagcggcagcggcggcgcctctcccccagagcccaagcggcagtggcggcgccctcccctcgagcagcggcggcggcggcgccctccctccacgagcggcgacggcggcttcaccaccaccagcggcgcggcggcgtcctcccctaccactggcggcggcgggggcggtagcgctcggggaggcgtcggtggcccgctggcgtccagcggcggcggtgcccctcccctctgccggatccaacgggaggggagctgcggcggcctggcgtccctgcgacggcggcggcggctgcggttcgacggtgacctctcctttgatctttttttttggatatatttgtgtgtataatgcttcctccgattttattttatttgtatgattgattgaattccgattgggatttttttgggtgggagtgatggaattccgattgggatttgggggaggcgagggggacgaaaatcaccatacctatgaggtgacgaacggaaaaatacgaatatctatattagttatagatatggacttggctgactggattgcactgggaccaaaactactttatatggtgtttatcggtaatttatcttgtttaaaaagtttagtggcgaatatcagttaagtggttaaattggaatgctaaatcaatatttagcgactagcctcgtgccccccctctctcccccacgtggttcgtggttagttccgtgcagtacgagaatacatgtatgtaaaaaagaaatgtttatatgtatataaaatatatacgtatgatttttttacatgtatatataatattttttatacgtatgaaatttttacgtgtatatataatatttttatacattgaatatctatttcctactatcgggagtagttatcccctggtagtctaacgttcatctgcttcacaatatatcttataccggatatggtttatgggaatctatactttatataaagttgtagcaccactaagtgtaaagctcaacatgtaactatactacatcatcacccactaacaataattacatatttagcctcatgcaaacatacaacatcttctacaatttatttgattgggaaaattgcatccatgcctccactttcagccccaactgttgttttacctccactttttaaggtttaaacttttattgaaaacgaactagacatttgccctcacttttgacaactagtttgatggtgttagttttagggcaaaagcacatttatacccttggctatttgttgtattttttgcccttacaataaaccataatacatagaaatcatagatatagtagcaagcattacttagtgtcacatagtcccaaataacgaatgtaatttatccaacgaatcaaactgaatcaagggagaaccacaatgataagaatagatcaaattacatgttaatctcttcaagtatgctccattgaaaggatttcctccattgatgcccttcccctaacctttacctcacatacaccgagcctctgttcttcctgcctccaacagagcccaaccgccgccgctgcctgctgcgtcagaaggcctggggcagatgcctgccttgctgcgccggaagccctggtggcccctgccaccgctgcgttggaagccccgccgccgcttgccttaccgcaccggaagccctgccgccgtctgccttcgctgtgccagaacccccgtggccgccgcccgccccgccggaaacctgtcgtcgactcgagccatcatcgcacatgccagaaccgccagtgcctggccgctgctcgccgcgcacgctagaactgccaccgccttgctcccgccccacggccgccacctggctgctgtctcgacggagcgctgtccgacgctcgccaccgccttgcgcatgcctgcaccaccgccaccgcctctaggtctagggtggtctgggtgttcataggcacaaccacagtcggtggggaggagagggattccatctatatccattcattcagggtagaatggtaaattgatatttcataaatctttttttaatttccatttgtaattctaaacacttaaacgtgggacccaccaaacatgcgttacaagtgggggtaaacggctggttcgttattaaaaattggggataaaattgcaaaccctaaaacgtaggggtaaaacaacagttggggttgaaagtaggggcatagatgcaattgtccttatttaattctacaaatcgtagatgcaattgtccttatttaattctacaaatcgatatgtaagtatatccaatcatcacccctcacattatttgcacaatattttcacaaatctatctatcatttttatttttatgatatttaacatatacttatcaatatgctttatattaaagcgtaagtatcatttatttgttttataataagtgctgataaatcctgatgttttgtttttttttctttttactaatagcttgattctcgaaaaaaatatattaaaaattgtttagtaattcctgcagtaaagcgtaggtaatcacgatacaatgaccggttagcatgcagacccggtcatccaactaaataaatttagaacatagtttgtcagtttattaaattgtttggttaatgcaattaaccaagtcacgtaattgggaaatggtttttccaacttcatgattagcgggctacatgcaaaacagaattttaaacttagtgggaaaggaatatggtgaccgatttataatttcttctcttccgctatagaacaattcagttattttattgcgaaactcataacatgcaaaacttatgggttggtactacactttcggcagcaacataccgaggaaattatagtaacgtaaagcatgcagtagtaacggtattgctacagtacttgtgcatagataaaattttaagtcttaatctcgtgcaaagtacatgtgctaaaaagtgcatgtgtatggtcacaagttgacacaggggctaaagtacttctctttgtccacacaaagacacatacaaagacacatagtagcaagtttttcaaactgcttaacggtgggtttcatgagaaaactttttatatggaagttgctctaaaataccagataaatatattttccaactttgtaataattaaaaacataattaattatacgttaataccacctcatatttcgtaaaacacttaatcttcatcttcatctatatgagtttaaacaccacctaaatactattgatatttttagaattctaatcttttaaacaataatatctctgacaccatatcttatatttgatggtggaaatgttatatttttttagaattctaatcttttaaacaataatatctctcacaccatcaaaatttgaattcgttttcgttttttgaactttctcgaaaaaattccattcgacactttccatttctgaaaatatgttcggaatccgaaaacgtttcggaccgttttcatcccatcggtgtgatgtaatcacatattgtatgttttgtatgacctaggagtcgaaatgctttttgttcgtgtgattaactggtggaaaaagttcaaaaacgctatcgcacgagcggtcgtgtgcggcgctcaagggatcacttctgttttccaattttggccagtggtccgatccctctcttttcctatttaggccgtgttggtttccttctgaaattccttcccggcttggcatgtgtttggtttctttattgggcttggccttagtttttctagagtgagctgaatctaagtgggtgtactatgggcctgtttggggagcttctagtagctgcagtttctcctagaatctccagttaccagaaactcctccaaacaatctagctttttacctagattctgagaatatgtagttgtagaatctgaaaaatgaactagaagcctgaactgggtttcccagcttctccaaattctcactagctagctagcttctcagcagctgcttcttaaaattttaagctctctaaacaggtcctatatatccatgtgcatcgcctagtatcgggtggaaggtcggacaaagccaaaattcttttattccattttttaatttggtattaaatttatacaggcaaagtatatatacgcacatgtgcagaacatctacttatcagtaaaaccacctccacaaccacccaggacattatttgcaccggtcttattagttggaggagttgatatagctggttttgtggatggtggacgggaatcgtactaaagcaatagttgagggagtcaaagtatactttttccttttttttttaagccagtataatgcttgtgggcttaaaggcacatgggctacttggcctgcttaggcacacatggatgggctcaaaggcacatgagctgctttccgttttgggagcacttggatatgctctttttcatttagaaaccgcacatctctgcacgcgcgtgatcagtcgcgtcgcgcatcagacgcccctaaaaaagttggcttcgtttggtgatgggcttttcaacaatgataacgtggaatagtctacacaatcacatcagaattgaaatattgtttggattattggaattgaaatatagtctacacacaatcacaaccgttaattgtcgcccggtactgtgccatccacctttgctggctttctctgcggtgagcaaaggaagagaggagaggggggagaggaaaaagtggaaaagtgaaaaaatgtggtataggtgggatttactttaagcaatttgtatcgtggaacatgtgttgatgaaaaacacgaggcctgggagatcttcttaactccagtgcaggtccaaaactcaccttcgggtatgctagcatgccagttgatttgatcctgcaatcagcaagaaataaaggcaaagaaaccgcggttaaatccataaatgacagccgatcggctaggtgccgatgatatatcatttatctttgagccgatgtcatatatgtatcgatcggcagccatgagtaaataagaaggaactaaatctactcgatcggctgtagatattaacaatatatactccttatatcgatatatacttaaatcaaatgattgggatatatcggtcgccatgccgagacagtataaatcacttagattgaaatatatattaataataagactatatatgtttatagcatagccgatcagatagatctagcatgtatcggctaatactccgatactactctatattaagatattaaagcaagcagaatatatcaaacaaaagcctaatacacttaaatgccacaaaatcttaatataaagggcagatttaacatgtcagtaaagcatatataacaagtatagttaaatcaggtaagatcggctgaaaccccgatactaccctaatcggcaaccaagaagcaggctagagattgagattctaatcacgactcataagatcaaacaactgatgcagctataagtatgaaaagaaggacaatatctagacaatcaagccattggaagtttcatagagtggtagatatcatgtacaatctaaaccaacatcgatatttaacctaatcggctgacctctactagtagatgttagctgattgtaggttagatgatgatattgctatagattatataagatatatgacaactcgacggattacataaacaagattagagtattataaagatggaagcactaatcctgagaacgcaagccgacaaaatcagttttacctcttgttgaaaatcgaaaccgatgcagctcaacccgaaagtaagaactcgtcgaaataaaacgaaagtaaaaagggtggcgatgcgccgagattgtattgaacgtgtgtgttaattgattacatggggtacggggtctatttatacccgagaattacaaactatgtccatatcggacacgactcctatctctaacaaactctaagatatcataagtctttgcagacttttgcccaaacatatctctaaggaaattacataaaatatcctaattaatagatacaattaccttctcaagactctatccatgcgtggcaatcatcttgaagcatatcaactcaacccgatgatgtacaccaagttgtattgttggatttagctaaatcggctaacctcgtccgactcgaaatccgccgatcttagccgtagccgattcggacttcagccgatcttactctgttccccgatcgatttccatctcggattctacttttattccatctctatctccgatacttagattaccaaatttggtcgttaacaacatgtagctaacattgttttttttcttaggtgaagggttccgcaaaatttcgtttcacattgtgaacgtcctgaaaaagttggcttgtttggtgaagctaaggtgcttttcgacaatgacaacgtggaatagtctacacaatcacatcatgaattgaaatattaattatttggatctttgtattattctcctaattctgtccaggtacatagaatgatgtcactagcttcagtgcacgacatcaactaattaataaatgtcaggctactttttaaaataatattgcacatataactttcatatttccttacctgtacatacaagtgtaaattaatttttgtgaaaactattatcaaactatagcaaaacaacgtatccaacaaatttcatcataaaggcacaagcatcttattattagattatcaattatatatataacacaaataggagcttgccgcggtggttggtgcggaggtggtgaagcgacgacggtgcccttgccgactgacgcctccaattccaagaaccgccgagctcctgtcgtcccccactaccgcaccgttgacctcaccgtcctccactactaaccatgccgtccgccggtaccacgtcaccgacctcgttgtatcccactaacagccactgacctcactgctgtactggggtgcgggaggggaggggtgatgcatcgacgagtgctaggccccaccgccgcttttctcggtgccatcgccgcttgggccgctcggctcggcactatctctgcccagctttctctgcaatggggaaaggaagagaggagagaggcgagagaaaaaaaagagaaaagtaaaaaaaaaggtattgataggacctactataagcaacttacattgtggaatatgtagctaacattgttcttcttttggtggcatgtgaggttcagaaaatttcgtgtcgcactataaacgtcctaaaaaagtacaaaatcttattattagatttatcatatatatatatatatattcaaaacatattatcgcaaaaacactagctgcaggctgtggctgtgctgccctgctagctagctgtggttgggctagcacgaaaccatagagctggttgtggctgtgctgcaacaatgtcagcgagcacgtgaataattaatatccatacgttcaccatccttgtgtcgccaatcgccattgctgtccaattgaacgaaaaaaaaatgcttgtctccacgtcgaaacaaacacggcatcgaaaccttgtagaagcatcgctatacaaccaacaacacaaacaaaactgtcctcgtaggaacaaccatcacttaaaatttgttgatattggatatccatttgttgatattggatagttgggttaaaacgaaaataaaggcaccggccagggaggaatcgatggatattcaaatttctgcatgcatgtccggccggtactctattttcaaacttttgcatgcatgcacaccagccggtgaggatttgtttgaagatttggagatgttctgtaatatgtaatgatttggatatgggaggggatggtgtgaaatcaatattcaatattaaaagcagaaaaaaaagaaaaaatatctttagtcccggttggtgatgggagcatgacaccaaccgggactaaagattgatttttagtcccggttatttgaaccgggactaaagatagcgatctttagtcctggatttgtagtcccggttggaaaaccgggactacaggggggttacgaaccgggactaaaaagcatttctccaccagtgtgccatgccacgttaaaaatttcagatatactgttttcttagttagtagaagtatatactcttttcactaactattagtatttgttttgtcactatatactctactttgtttagtagtagtatatactatttttttcaatatatactattctttacttaatagtatacactatattgtcaatgcacaactgcacagatttggtgcacaattgaaggaggccatgcatttggtttcaaaattgacaatgtacctatctaactttcctcttttttcaaatactagtacagattagtactagtatatgcagtatttgtttttgtattggtatatactgttttttttgttactagcagtatatattatttttaaagttacggtatatactatttgtcagttagtagtagtatatgctctttttaaagtagtatcggtatatactggctatatttagttgcagaacatactccctccgttttttataaaagaagacgccg

SEQ ID NO: 75519 - DNA, 6934 bp, Oryza sativa
cggcgtcatctatttaaaaaacggaggtagtagtattttaaaagttcattgcagtatatactatttttcagttagtagtagcatatgctgtttttttaagttagtatcggtatatactagttttactcagtaattcaaaagctaactgcagtatatacttattttcagttagtatcggtatatacttcattttaagttagtggtaggtatggggttgatatatagttatgaatcagaacacactgagtatgactgcgaaagaagtatcaattcgctgattaagatttacaaacaacatcactgttacattcagaattatgcaaaacaaatttaatgctctggccgtatactgaatgaacagtatcagtacttcttttccagatcaaaaccaggagaacaagaacgaaacataatactcctacatcgattttaaaatgatttcttgttgcctgacaacatcaatcacccgggtgccgtacgtggccgtcgacgccgccaccaacagataggcagccgtggagcagcagttatgccatggcattcactgaaattcatgagtcgttcgagtcgacgctgcactgcacatcgatatactctgctatcggccaccatctgcatacaaaagaaatcatgtgcttaatcattcaaggaaagaaagccagaaaggcagtatatactatacgtgaatagcagcacggacaagcagaaaaaaggagttcaattaacagatgcatcacgtacgtacgtgtttttaccggacgccggcgttgatgcgttgtcagatttcatcggctggggcaaaaccatagcttaagggaagaggatgaccttacaggggctgccgtctctgatgacgattcgcttccagcaagcgacgtacgaataggccaggggatttgcaattataacactgtaaacattaacctttgctataatggtactggacccacattttatagacacagatagatccatttgtcatccactcgaaatgtcccaatattgtaattttcaggaataggccatagggctagcgaaatcaatcttccgccgcctgctgggaacgacgaagtcgccgtgcccgagagttgaagcacgttgtgcctgccggtgaagcgcgccaggaacgcgccggccgtggtgccgccatctacgcttctccgatggggtggatctgtcagcacgccgaatctccgatgagcatgttgcccctgccgccggctggatagaaccggaatatatatgcgagcagttctacaccgatgccagatccgatcatcaagggataatcaaatattccagcttttctttttagaaaattcaaaatcggtctgctgggatccgatacgcaggaacatgtgtgcaatcgatcgataaggtacgcggatggacggtggatgcggaccaggagtacgtactcccgggagtacataaacatttttcatatatatatatatatatatatatatatatatatatatatatatatatatatatatataaaatcatgagcagcacttaagagtccggtcgtctcaagttagcatgcgagtttttttaaacaaatttcttatatggttccttctgtattaccaaaagtaaacgatgttaaaaaccgactcaaatacggatatgtattttcaaaagcaaacgaacttaaaacccgctcatacatagatgatatcaaaaaattccggcaaaaacatcttcaatttttacaatagtagagatagatttatatccaaaagtattttttcataaggcgttaatgttgtggctattgataatatatatactatgtgaataatcaaagtacaatattaaagatagtataaaaagacaacacgctataattttttccgagcgggtatatttgtgttaatttacctttatatatgaacagccaatatgcttagcatacgtgagtagggatgaaaacggatcagatacggtcagaaactagctctatcatattcgttttcacattttttttaaatcggaatcggaatcggaaacccggatatgaaaacgaaatcgaatattgtcggatacagatatggtgcgaatacgaagcgaaacgaataaggtgacgaatattaatcggaacataaaacccctcaaactaagcatcacaactcaaaaaagaaatataacccgttattttttctaatataacatatcaacttttccaaattttagtgttaataattttgttatatccgattttgtggttgagggagaacgattcaatagtttatcgcactcatatgggcgtcttaaggagctgtatgtgaaaataatatttaaaactagtttatcgcactcatatgaacactaaattggatgattctttttcataaatatttctaaaatcatgctctaacgtgttattgtgttcttactgctattattttggccatagtttcttgtgactttgttttatcaatttaaaatttgaatttcaaaaaatagcaacttcagataatattttgaagcagtaaataattttagctgaaaaagtcatgaacataagagttgtagaattcatcaaaagctacaacttttattttggtcatttcttcatccgataaagggatagtaacattgttcacagaatttatatatctctcttacagcttatgaaaccatatgtgtgatatgtacattttgtaaacaatgttactatcgctttgtcggatgaacaaatgactaaaataaaagttatagatcttgatgagttatataactttgttcttgatgactttttcagttgaaatcattcaatatttgaaaatattgtttgaagttatcatattttaaaattcaaattcaaattgtttaaacaaagtaatatatttgaaaaatgacccaaacaaaagttgttgatcttgatgcgttgtacaactttgttgttgacaatttttccatttgaaatcatttactactcgaaaaattatttgaacttcttatattttaaaattcaaaatttatatagttcaatcaaactcgtatagagaaatgactaaaagaaaattggtagatcttaataaattctacaagtttgtttttgacaacttttttcatatgagttcatttagtattataaaatttaattcgaagttaagggagtacatacagacttattagctaattcttaggcccgttggcccatttagatagagggatatataaacctaaccctacccggccactcccacagtaccactctcccagccgccacccttcctcccatgacagcgtgcgccggatggcatggcgacaccagccttggggtggccgacgtcgtgggctccgcggcgcgaggcgacggcgtgcgacggatggcggcgagcggattcgacggtgccggccccggagcggcccaatctgacgtcgtgagacgatggtgacgactggggcttggctgcgcgaggcgacggcgtgcggcggacggcgacaccagcctcggggtggccggatccggggtcggcggtcccggagctgcaggatccgacgtcgtgaggcgacggcgacggtaggggctcggcggcgcgaggcgacgacgtgcggctgacggcgacgagcgaatccggcggcgccggccttcgggtggccgggtcacgacgacgggctgcggcggcgggctcgactgcggcgacaactacgatgcgcggcgatggcgtcggtgggcggcagcggcaggcggcggatccggtggcgccgccctcaggaggggtcggatccgccgccctacggaggtgttcagctctcggccccgcgacggccagcggcgggcagcagcagcggcgcggatctggcgccggccacgcggcggccggcagtgggcagcgcgaaggtggccggctaaggttttaagggtttcttttttttttttgttgaaaaatctttcttttgctaaaataccggaaatccgatgaaaaatcccgcatagtttccgtcggatatcaaccttactatattagttttggtatccgagaaaaaaaaatccgaattcgtttccgaatccgaaaaatcctggatagttccgaccgaatttttttgaatctaaaaattggttcggacagacggaaacaatccgaaccagtttcatccctaacgtgtgttagagggtgatctcctccttcatggacgcgggaggcccccctttttttggttcggccgggggcagctgtaacatcttgaaaattcccaacaataaaaatcactgaaatttcgaactttttaaaactctttgcatcatgctggaagttatggttgttattgcttgccaaaccataaatcgacgcaatggaaaaaaaatcaatctaaagatttatacccgagcaatagttacgatttacaacgatacgatatttattatcaatcccataaaatatttatgcacatgaaagccaggccaaataaagtacaagtcaattattaaaccctgtggtataaatcacaaatcaaatattaaataatcaaaccatgttgatagcctgatttcatatttaacaaaaggaaacaacatagttgaatataattcacttgaatccaatctcacatgaaatatataagtacacatgaaatgatgatcacatcaatggccccatctataatagagtatctcactagaatatataattaatatttgaaacaccttattaagctcctcatagcatgaaaatcactcatataaaataatggtcatataaataaactaggctttatacataaataagaatatgtgagtgtttaattaaacaattagattaatgttgtactaagtctcaatttatatttatagaatgagtagacccacgtaaaatgcattgttatacaaataagttcattcaatgtgctattgtaataataatggccacattaggatattttaaattaattttagaaccctcaaagcctccaaaattatctaggttaattttagatttaaacctcatttaaataatacaataggaaaatatataaaatatgggtaatattaaattttggtcaactttcatctaaaataaaacatatattgggtaaaactctaattgtgtgaaatctagaaattatgggacaagttttaatagaaaataggcctcaaaagtggataattaggaaaaagtcactgtgcctcgccgccgctgagccgacgcgccccgccgccgcgatgtgcctcgtcgccgcgccgtgctccgccgtcgaccccgccgctgcgtctccgtcgaccccgccgccgaaccagtgagcctccccctcccccaccgcttgccgtcgcgccgtgccgcccgccggttctagccgaggccgtgagagagagaagaaaacagagaggagagagagaaaagagaatggaggagagaggttagagtgggccccacctgtcattaattccatccaatttcccttagaaaaataattctgtagaaaagaaattcaagaccttgaccccacctgtcagtcactatagcttgtggataaggttgtattataaataaatgaattaggaacagtaccattttgcaattattagaactaattcaaatttgaatctttatactagcataacttattcatttcagctccgatttgagtgaaacttgaatctaaattcatctaaattcataagctttccaatgatatataattcactatttgataaaatatatttataaatattaaataattaatatcaagatgatgcataatagtcaacttaaaaatatgctaataaataaaattagtattgtacagtagggtggatgtaataatatttgtctctaacatgtttgcactgtaacaaccacacaaactaattttatgtgatgtctcaaatgaatggatgtataggaaaatactagtacttatttaatattcgatggccatataattaaatccatggcttataggttatttaaatcaagtatagccttatgattatgtaactaaaatataaacacacatagatgaatctttaacctgtttaggagaataataacagagctagatgtggaggaatcactaagtaaattaatcgatgcaataccatatagaatagcatatatatgcctaaattgattaccacttattagtaacccaatagaaccagtgcttaaacttgtcgtatcacatatacaatatcactcatagaaactagctaatgtataattaaactacaatatattcaggaatcacttggagcattgggtagtacactttctaaataagctcatgtacagtaggcgaccaaaaccttatacgttgttgcacacatatattgtacatcccattatagttacacaattaatttatctttttcatatattaaactggggagtatataacaaacatgaatagtagataagtactaattataaatcttgacctcatatgttcatagttcaattgtaactccggattgttcattaagagataatctgtaactataatattataaacttcccgaatttaacatatagagcatggataattattagcccttttataatttgtaatggcaagtaaaatatgttcataattaaagtaaagcttccatcaataaaataataatacaaataattcactgtaattgtttgattgatcctaaatccatctaacaacagaacctctagtatataactgtcctatttatatagatgcatacatagccataatccttcaatagccatttgatagactaaaccaccgattagccaaatatatatgtatcccataaatgctatgttggttaagtcctaaataggccacgatgacaatagaaagattaagaaactttagccttagcatgattgggatccattagcaaacacgaatagtacattttgttgcgcatatttgattgttgtttgaatattggtttttctcgcgtattatagaccttgtgtatcggttagtcgtgaggcaacgt

SEQ ID NO: 75520 - DNA, 1322 bp, Oryza sativa
tatagacctagcggattagatagccgagcggaggcagtatccctgcatagatggttcacccctgagtgaggcaggtgcgctatgatgggacagccgttgaggtagggccgagaggcgtgccctacatcggtgtcgccattggtaggactgccatgagtgtgtgagagagagaacttaacttgaaccataatttaatatgtgtgagacttctctttcccggaagcgccagaactcctcacactgctagaaacatggacgcctagagtgcatgaggatttaagttcatggagcgggtactgccagtgcaagcttatctaaaagctttgccgtgacgtgtctcatgtgttgggacgaggctcatgtgttgggcagtcacggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgatggagccacattctgagaggagggaaggtggacatcctcagaaaaccatgacgattcaatggcgggaagctatccttgggatcacaatggatggtggacagaaccgtcgttgtttaaagtgaacactggtgctaaaatttgatcagtctatgctaggttttaggcttgtgaaaagaattgtaaaattagctttatgcaaaagaacctgaagccattccttgaaataccctctatcatatgcattgttgttgtggtggcttgctgagtacggttggtactcacccttgataattatatatcttttaggagagtgttgaagagaagcccttgtcggtacgcttgcgtatccaacaagatgatcggagtgcggtcttgttctaggtctcgttccccagtcgactgcttgtggcatgttaaccgggcccttatattatttggtcttctggtgttgttctctgatagttattggcctacctggccctaatgtaagtatttaactcttttagcctgaattcattcgtgatatgttgtgattcaactatgtatgtgtgtatcaactactgatccagggattggtacggataaacacagatgatttccgatttccaaaatcgggggtccacagcagcgggtgagatccgaggttttcgagacaaaagagacacaaggaatttatacaggttcgggccgctatgaagcgtaataccctactcctgtgtgtatgatgattcttctgtgcttgcaaaagcctctgaatctccgatgtacaagctagggttagag

SEQ ID NO: 75521 - DNA, 818 bp, Oryza sativa
ataggccatagggctagcgaaatcaatcttccgccgcctgctgggaacgacgaagtcgccgtgcccgagagttaagcacgttgtgcctgccggtgagcgcgccaggaacgtggtgccgccatctacgcttctccgatggggtggatctgtcagcacgccgaatctccgatgagcatgttgcccctgccgccggctggatagaaccggaatatatatgcgagcagttctacaccgatgccagatccgatcatcaagggataatcaaatattccagcttttctttttagaaaattcaaaatcggtctgctgggatccgatacgcaggaacatgtgtgcaatcgatcgataaggtacgcggatggacggtggatgcggaccaggagtacgtactcccgggagtacataaacatttttcatatatatatatatatatatatatatatatatatatatatatatatatatatatatataaaatcatgagcagcacttaagagtccggtcgtctcaagttagcatgcgagtttttttaaacaaatttcttatatggttccttctgtattaccaaaagtaaacgatgttaaaaaccgactcaaatacggatatgtattttcaaaagcaaacgaacttaaaaaccgactcatacatagatgatatacaaaaaataccggcaaaaacatcttcaatttttacaatagtagagatagatttatatccaaaagtattttttcataaggcgttaatgttggggctattgataatatatatactatgtgaataatcaaagtacaatattaaagatagtataaaaagacaac

SEQ ID NO: 75522 - DNA, 41107 bp, Oryza sativa
  unsure (1)..(41107): unsure at all n locations
gtagccgatgactggaggggttaatccaccaccatttggcaagaggcctggagaaaactctatatccctgccactgttgcttttgtgtggaggagaagattctgttgtctgcaagacaaagaaaagtcagtcaagatttaagttggctaacaattattcaagcgaaattaataaagtaaaggtgtacccgagggacaacatcagagaacagatctgtcatatacatagaagccgactgatggaatatatgttgtttccacgctccccaccacctgtcaaagtttctgctcctaaaccttgccagctctatgctctcaatgctgcccaaaggaggccctgggatattgagtagccgattcatcatcagggttgatgaaatttctcctcagcattggattttatcggcaaagaacaagccgattggtagctgtcccattccaaactgtctagcagagctcattgggtggtaaaactcataaaaaacctgtatgtttcttccttgatgaatgccaataggaaggatgcatgggctgatagcaactgagaagacttctctggacttttggtatctctcatgattgatgccttcaaatctgaaatctgctaggagttcaagacttactgagtcttcataagggaaccaaacccaagcatctttctaaaacccttcataaaagctgcggaaccaatccttgagcaactcagccgataattttgctccagcatcggctggtgtggatgcatactctccgtaggacatacacctgtgatgggtgcgttcttctccatcattgtctgtaatcggctccaatcttgggaattcagcttttgtcacagatggtcgattgacagctttcatggctaccagatttagccaagtttgcagcagccatcatggtcctcctgcaccaacgattgagccgacagcaatcttggctgatgcattgttcagtgtttgatataggtagccgagaaggatcttgcgtagaggaaattgcctttttgattctagggcttcggctaaaaactgctaattggttgtagggccgcaactagatccacagaaaaggaacttttcaagtcacatcagtaggaaggccacatgttctgggggagtgacaggtcctttgcccatatatgctgccacataaccagaccaaccacctatgctctaggtcctgaagacgaattggttcttggtgttcaggctcataggattagccgatgaagttacatctaatccagtaatcatggttatgtcgatcagagttggggtcatcggcccttggttggacatgaaggcattgatggtgttggacccgaaataggtgacagcggccatcaagggttcatccttggctgaatttgctatagtgagggcgagtgcctggctgattcgattttatcccagtgagcctgtttgctagccgatacccgtttgaaccaccagcccaacttttttcgggtgaagttttctcaagagatggccaagacttgaaagtgtttttccagtgacctagattggggttggctaatctaaaggcgattctgttggttccggcaatgatgaattcagtggggtcgagctcgccaatcaaaccaagaaagtagtggttctcgtgtgatagactgggaattgctactagattggacaagtgctgcagacgcagatgagaatagagaagaagaaaacaagatgagaacaaggagaaaatgatctacagcatgagagaaggggatctagccgatggatacttacctctacctactcggccgacggcgtggtcgacgggctggcggaagtcgacatcaccgggagcggaaatctggtcggaaggggaattgcctcgaaatcgcgtggtgcgtcaaggggatcgccggagagagagaagacggagttggcttgagcggtgtaaacggaagtgacggtgtgaagtttctcgggggcaactgttagtatttaaagcagagcgataacggtcgaagaaacggcaagtgcgatattctctcggagtggagatatggcaaatccgaaacactatcaaatattccggacatggggggcatgtgttaacgaccaaatttggtaatccaagtatcggagatgaagatgggatcaaagaataattcgagatggagatcgctccagaagcaaagaagggatcggctgaagtccgaatcggctgcgaccaggatcggtagagtccgagttggacaaggttagccgattgagccgaatccgacaatatgacatggcatacgtcgtcgggttgagttgatgtgcttcatgaggattgccacgtatggatagagtcctaagaaggcaattgtatctattaattaggatatttcatgtaatttccttagagatatgtttgggcaaaagtctgccgtaaaaacttatagtatcttagagtttgttagagataagagtcgtgtctgacatggacatattttgtaatctcgggtataaatagaccccgagccccatgtaatcaatctaacacacgttcaatataatctcggcgcatcgccaccctcttactttcgttttgtttcgacaagttcttgctttcgggttgtgctgcattggtttcgatcttcaactagaggtaaaacttgttatggcggcttgcgttctcgggattagtgcttccatctttatgatactctaatcttgtttatgtaattcgtcgagttatcatatatcttatataatctctggcaatatcgttatctaaccaccaatcagctaacgtctgttactagaaagcagccgattaggttaaatatcgatgttgacttagattatataggatatctaccactctatgaaacatccaacggcttgattgtctagatattgtccttcttttcatacctatagctgcatcagttgagtttgatcttatgagtcgtgattagaatctcaatctctagcctgcttttggttgccgattaggatagcatcagggtttcagccgatctgacctgatttaactactttttctttatatgctcgattgacatgttaaatccgccctttatgttaagatcttgttgcatttaagtatattaggctttcgtttggtatattctgcttgctctaatatcttaatatagagtgatatcggagtattagccgatacatgctagatttatctgatcggctatgctatgaatatatatagtcttgttgttagtatatatttcgatctaagtgatttatactgtctcggcaaggcgatcgatctttcccaatcacttgatttaagtatatattgacataaggattatctacagccgatcgagtagatttagttctttcttacttattcatgactgccgatcgatctacatatgacatcagctcaaacataaatgtaacgtcatctgcaactaaccgatcggctatcatttatggatttaaccgcggtttcttttactttatttcttgttgattgtggaatcaaatcaactggcacgctcatacacctaaaggcaagcttttggacctgtactggagttaagcagatctcccaggcctcgtgtttttacatcaacaattacatatgtgattgttgttgttgaccaaggaattattttttgttgatttgtgattggattgcacatgacgaatggagctggctcggcttgaagctggcatctctatttttttttaatcgggaagagtacaaatatgtctgttctaggttattggtgctgaccaattagtgctggctgagaaaccgacaactattgccggttctcaaccggcacctatgaaagtttttgtattagtgttcataccgtattttttggagtaaggacaaaaatcctatagcctttggctgataagtacacccagatatatgtcagatcttctttccgaactcttcctctagcttggcaatgccagcagtagagggcgacggcggctgcagggacatattattcaattccgcgggagttttaaaatttaaaaggggtggaaacatgatttcggcaataataaaaaggggtagcacacgagacctaaaagtggatggatgcacagacaaaggatttagacaggttcaggccctctcgatgagaggtaataccctactcctgtttggagatttgaatccaccgggtgtaatatagatctgacgatctagttgtctcatgccccctagagggcctcctgcccaccttatataggatggggggcaggattacaagatagaaaccttaaccaacacggtatcggtttcctaaatctactttacaatcttatcaagccaggactttaggccgttccataatatacagggaaacgtaatacccaagtcatgatctgttacatatttcatagatataagttatcccatataactagtcggataaccatgccgtgtgggtatggggtacccataatctccacagtagcccctgagaccttcacagtcgaaaagataatcttttctcgaactagattactccaaagccgagtgcttcaatcatctttgccatgacttcccgagtacttttaccaaatctgaagactgtggagggctgaaaaataaagtcaggtgcatcgactagatgcacctaataggtgtagcccccgactatgtggttaattgaacaaaccaaacatattgtcaaggaataaataatctaaccaaccgagtggtttcgataatagcatatgatgtgtgaatccctgaataatatgatccaagtgatataccgactgctttgtaaaatatgatgcgtgcaacttaaagtcgactacattattgaaaattcacatagcaaaacagctataaagaagcttgtatgttgtgaataaagaaatttccaaagtattgggcatacgccatgcgcacactgctttaacagatgtgcttaagtccctaaaagacacatggtttcaccacacctgaaaatatatggcatatgtggtgtaaaatccgagtaaataaactcataaaggatttaccaactgcctagaaaatgaccaaaatatataatcagcccaagccataatattggtcaataaaagtgcacacttacgtggcaaaaaacaatgatattttatccaatcaattgctttatgaacccaaacagcacctcgacttatataaaaaaagtcagcgggcagctatataaaacattactgtttggcaccttttaaaatgcattgtaccaactcctaaaaagttgagtaacggcggtataaaaggattttaaggtattgggcacataatcacgcgcacttttgcctaagcaaaaagatgcctaagtccctaaaagaacgtgacaggccacacctgaaaatatgggctgcagacatattaggcctaggccaaaacatatgccctcgacaccctttaaaggatgacgcatgtaacatgctcccgagtaataaatcttccgggtaatatagaccaagcgtagctcatatgaatagcttctgatctgagtgattatcccttatgggatactccaaaatagatataaaaattgaatcccgactggcgcaagtattcggttgataacccttacggagaataataaatagtccagtctttgagcatagaaaatagacccatgatcatgaattcatgttgcatgtaaccggaacaagtccaaattgaaggtatgatacttgtgtttgaactagtaagcccctgagcatatagcttgtccttctgtcgtagtcacaattgtccattgatggtagctgacgcagttggcatagagacaagacgaccaatatagagataatattgcccaccagaggtggcaaaaatattggtggtagtgaagataatgataccaatcaaaagtgatgaagttgcacagccgtggaagcgaagaaaccagtcggcagtagtcaggtcagccattaatgaagatgaaagcgcccagcgataaagttgtgtagccatggcagcgaaataatcagtcggtgacagacgaggcaaatcaaaggcgatgacgaaatccaccaatcatgaagatgaagaaacattatgggtacaatccaccaatcatgaagatgaagaaaatagtcggcgacgacaaacgcaactgttgtccaactcgtctaaaccgaaatatttgaagttgttgaagtagaatgtctgctccgaagcaaagatgaagataatgactcctggagttgactcgttggctgattaattgatttcttcagcttgacataaaatttgtcaaattttgagccttgtatttgtgtagcccccgactctttgattagttgggaaacaactgaacatagagtcgagaactgtagcttcttgtcgttgaatagttattgcttgattgaagatatgtgttgaagatgtccaagtagaaatcatgaatgttggagagccacttgttgtagtaaaataacacagcatcgcatgccgagatgtcgagattcacaaagacgtcatggttggtgaagtagcaaaacttgtgaagtagcagcaatagagtttgctggtaccgaagataataaagatgaagtcgctccaccatgatgacaaagttgcgttgccgtgatgaagtgaacacgagtcggcggcaacagaagcaaaccggtagtgaagacgcgcagttgtgaagataaaagcaccagtcggcggcggcataaccagtcggcgacggaagacgatgatttccatcagtagtggtagctgtataaacaagacgtagaggcgagggcactagtcagcagtagacgagacgaccggcgatgaagaagataaagccaatcaacactggcggaatcatgcagccatggaagtgaataaactagtcggcagcagatgtagacagcttgcgttgaagatgataacgcctattagcggtgacggcgacgtggccagccgtgaagaagatagcatcagttggcgtcataacaggctagccgtgcaggcggtgacaccagtcaacaccagtcggcggcggacgaggcggccggtcggtgaaaacgtagacgcccaacaacggcggcataataggccaaccgtgcaggcggaaacaccagtcgccggcggacgaggcggccggtcggtgaagacatagacgcccaacaacggcggcataataagccagccgtgcaggcggaaacaccagtcagcggcggacgaggcggccggtcggtgaagacgtagacgcccaacaacggcggtcataataggccagccgtgcaggcggaaacaccagtcgacggcggacgaggcggccggtcggtgaagacgtagacgcccaacaacggtggtgtgaccaaacaaccgtataggcgaagacaccagtcggcggcgatgacggcaagccggtggtgatgttctgactgatccattcctggagcgtaagagataagcttaaagccatgaatcccttttgtgcatatctggatctggatcctgcagaacaaacatataggatgagtaatatctgatataaatataatactcgagaaaaaaatcaagtatttaaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgactgacatgagttcgtcattaatggaacaaagtttcgcggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggccagtcgtgtaagcggaaacactagtcgacggcaacgaaggtgagccaacggtgaagatgtagacatccaacaacggcggcataataggccagccgtgcaggcggaaacaccagtcggcgaaggccagccggtcagtgaagacgtggacgcccatgaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcagcggcataataggccagccgtgcaggcggaaacaccagtcggcgaaggccagccggtcggtgaagacgtggacacccatcaacagcggcataatagaccagccgtgtaggtcgaggcaccagtcggcggcggggaaggcaagccggctgtgaagatgaagatgcctagcaatggttggaaaatgctaggatatgtcctcacacatgtttgctcccaatctgctcgcacgcgtgtatatatgtgcatacggcagagtgcaaattatgagtgtgagcagctcgctccagccagatcagggcgacgtcagccggatggataggccaacgatgattaatttgcatgtccatgcatctgaaagtattgcactccactgtgcttgcatctgcccctgtaaccaacagtccttcagcatgatgccgtcgtcggaggtaatcatggagccgtcaaacgccagtatatgcacgcgagagaaaacgaagaatcaaagggcagatcaatctatgattaaaaaaatcataattataataatagattggaacgataaattagccgatgccggatagcagtttttatccatgcatgcatgtgtttatgcgtgtagatgcagagccgatccttgcgtgtccaagtgcatgtgcggacggatgattgctatcccggcgagtagctgtcttcacacggctgatagatggctgcggtggatgacgcactgctacacgcctccgccgaggcgccgagtccgcgtcgaactcgaagcgtccagtttgatctcagcaatcaatctcaccgagcataacagaaaacggcgatgacgacgacgactggatcggaggctcgattgctatccggtgcgtgtgaacatccatcgctccagcatgcctgtccagatagcagtggtgactcccgtggccgacctccatgcagagcagtacgatcaagcagggttttgcaggctggtagctggagacgtggccgatgatctcttggatacagatgatttttttttggctacggactgtatagcagctccagccggcatcttggcgagctgcatcttgaggattcaccaccattggtgacgtcggagattggagtgatccaacttgctgaggttgattttccttgctagattgaatctgattcggcgccttctaattggttccatctcacttctcgtagataactcgacgcacccctacctggcgcgccaactgtcgaaacatgatttcggcaataataaaaaggggtagcacacgagacctaaaagtggatggatgcagagacaaaggatttagacaggttcaggccctctcgatgagaggtaataccctactcctgtttggagatttgaatccaccgggtgtaatatagatctgacgatctagttgtctcatgccccctagagggcctcctgcccaccttatataggatggggggcaggattacaagatagaaaccttaaccaacacggtatcggtttcctaaatctactttacaatttatcaagccaggactttaggccgttctataatatacagggaaacgtaatacccaagtcatgatctgttacatatttcatagatataagttatcccatataactagtcggataaccatgccgtgtgggtatggggtacccataatctccacaagaggtaccttaaaacaccactgaataaaaattaatttaaggggcatccacatttattcaattttggaaattacaatcgtctaccgtacgtctacgtgccctgtcctgggccatgcgtgctgcacgtggatttaaccatttcctagtttaattacttcggaattagtgcaagaaattagttatcgttcccggcctgaattggttaaatatgcaactctagaggaattgggaattgggatcacctgcagtggctatagccactacaacctaagcacttttgcagccaccattggattagaaaatgatgttgtagatctaatttggagtactgtttacagaagatgatacaaagctttctcctgtagcaggcactatagccgttactgtttatagcggtaagccggtatccgacaaggtgataaggtggactgctccaccattaatgttattactagtagcaaagaatactttgttgacagattaacctacttgcacagaaaacggagctacgaggtggtatgcaatgcaccagaacacgtatgctggatgaatatatatcatgttacctgtgtatcctttattagtttctccctccattctaaaatataaaacattttcagacttcgacgtagtctttaagatagtactagtttaatcaacaatatctacaaaaataagatattttaaataaaaagaattgcatattatgatagtttgtttaatgataaatctagtagcattaattttacgattgatcttttttatatttttgctattaatagtcaaagttaaaaatgtttgatttgacactatgctaaaaatgcttatattttgtgacggagggagtataaactatgtactagttttttttcggtattcaaaatggaactttgttacccatgttgaattattttttcatttttctttttgatattgtaatggttgtatgcgtctgtagttggtgcgcgtacgtgtgcataatgcatgtaccatgtatgtggttacactttatattatatatggatcaatgtcttatgtgcacgtttggattttattgatcattatttttcatggtaacacataagattaaatctacagttattatattgtaatccatctaatcgatgccatctttctagttgttatgagagccctacaggagacgtgtaattagaataggtatttatatactgaatatataatatttgctcgacatataaaaccttagaaatggaaccacatttggtccaaattcgatgaaaggattttgttgtgtttgaaagcaataagacgtacagtactcctatattttttgtgtgcgaatcatgaacagaaaaaatatacgaggcgacaaagcatctattgatctactaccgagttttaaagttgttttcacctaacgacgtcgaagatgggaactgttgcgtcagaaatttagagtcacacttgtgaacttcaagggaaaaaatatactttcgtcaataaatgtatgcatggggtagtcatgggggaagatggatgcatgactgtatggatccgagaagagtgagcaaggatcacgttgaggtccgtccaaagtcgaatggctcagcgctgcagcagctcagatatcagtacgccggcaggttacccattgccgatctgctggcaaccacactagctagcatccagtactatcctttcgatagcatgcacagcatcccgagagacccacaagagtgttcactgttcattaggctgttctctgctcaactgaccacgtgatgtgcacgggacagaattaaaacacaaatgcatgtttattatatgatttatttacgatgttcgatgacatgcctatttcccacagttaaaactgttgagttgtgatccaaatttatttacctttaaaataggccagcttctgttggagcgaaataaaggtatagatcgtaatacattttagggtttcaccttttatatatatatatatatatacatctcgtaagctgccatgcagcgttgtaacatcacctgatatagtgaaaaattttgttggctggcacacgtggttttttctcctgctttcgcagggttttccacgttaaatctcgtgtcttctatgatcgatctattgttttttatcgtttgtttgcctatcgtttcctaacaagtggtatcagagcttattctcatattagggtttcgcgatggcatcgatgaagtatgatctagcgctgctagactacaagatgagattctcgctttggcaagttaagatgcgggctgttctggcgcaatctttggatcttgatgaggcgctggaaagcttcgggaagatgaagaatactgaatggaccactgaggagaagcggaaagatcgtcaagctctgtcgctgatccaacttcatctatctaatgatattttgcaagaagtgttgtaggaaaaaactgctgcagaactttggctcaaactggaatcgatctgtatgtctaaggatctaaccagtaagatgcatatgaagatgaagttgctcaagcacaagttgtaggagagtggttctatgttgaaccacatatcggtcttcatggagatcgttgccgacctagtatcgatggaggtacagtttgatgatgaagatttaggtcctctaatgttatgctcactgcctagttcatatgcaaattttcgtgacacctgttggcaacttttttgacaagttgacaagcacgatcgtagcacctaaagctttgtggtgacagtagaatcgccaatcaccctaatctagcaaacactagattaagatgggttttgatatgctaaattggctagcggagccggtctagatgaaaccatggataactacacgtctcgtgggcaaaacggaaggttttcaggacaaatctacaaagaggtgtcgcactctcgcaacggcggtggacgatttacagcgcaaatcgacaaagatggacaaactaaactagaactagaagcaaaagtaaagaacgattcgattgattgatttttacaatgaacaagccttgtcccttatataggggttggtcttgccctctacaggtcctcctccatgtccaactcgggatagaaaccaaaggaaacccgagacataacttcccaagcaaggaaaactcgagacccaacgaaacagtctcgggctcggactctgccggtcagaccgtccacatgccggtggtctaactggggttcaagccgcggtctgaccggcctatacacggcggtcagaccggcctcccagaggaaacaccggtagatcgtccaactttggcaatttccctattttaatcntaggtgccaaatttgggtgtaaacaacaccatactataaagccgtgatgatctaacccttgcggaagtttatgaggtactccaaaacagggagaagatgaaaggtatggtttagtctcatgcatcgttctccaagggcgaagcattgcagattagtggcagatctgagcagagaacctacaacgacagcaatgatcgtgacaagagccagaacggtagaggccgttcgaagtccagaggtaaaaagttctgtaagtattgcaaaaagaaaaatcacttcattgaagaacgtaggaagctgcagaataaggagaaaaggaaatctgatggtaaggcctctgtcgttaccggtcctgaaaactctgattcaggagattgtcttgtcatttttgctggttgcgttgctggtcatgatgaatggatacttgatactgtatgttcatttcatatctacattaatagagattggtttagttcttacaagtatgtgcagaatggagatgttctgcgtatcggagatgataacccacgtgagattatgggcattgtctccgtttagatcaagacacatgatggcacgacacacacgctgaaagatgtgagacacataccagggatggcgagaaatctcatctctcccagcacacttgatgcagaaggatacaaatactctggttcaggtggagttgtaaaggtataataggtgatatgaattctgctaacttatatgtcctcaggggaagtacattacatagttctgttaccactgctgctgtttctaaaaatgaacctagtaaaactaacctgtggcatatgtgtcttggacgtatgagtgaacttggtatggcagaattgatgaagaggaacctgctgaatggctgcactcagggtaacatgaagttctgtgagcactgtgtttttggtaagcataagagggtaaaattcaatacctcaattcatcgcaccaaaggtatacttgattatgtacaagctgatttgtgggggccttcacgtaagccctctcttagtggtgctcgttatatgcttaccattatcgatgattactctagaaaagtgtggccttatttcctgaaacataaagatgatacttttgttgcttttaaagagtggaaagttacgatagaaaggcaaactaaaaaggaggtaaaagtacttcgcactgacaatggtggtgaattttgtttggatgcttttcatgattactgtaggaaggaaggcatggttaggcatcacaccatctcatgcactccacaacagaatggtgtggctgagcgcatgaacagaaccatcatctccaaagctcgttgtatgctgtccaacgctcacatgaacaagcgtttttgggcagaggccgctaacaccatctgctatttgatcaacaggtcacctactatcccaattagtaagaaaactcccattgacgtatggtttggtatgcctgctgattattcacagatgagagtttttggatgcactgcttatgctcatgttgataatggaaaattagagcctagagttattaagtttttgttccttggttatggttcaggagtaaaaggatacaagctatggaatcctgaaactaataaggccttcatgagcagaagtgttgttttcaatgaatctgttatatttaatgacagcttgtctacagatgtcataccaggtggttctgatgaggagcagcaatatgttagcatgcaggtggagcacgtggatgatcaggaaactaaaattgttgataataatgttcatgatactgttcagcactcacctcctgttttgtagccacaagatgaacctattgcacatcgcagaacaaagaggagttatggagctccaatccgtcttattgaggaatgtgatatggtttattatacttttagttgtggtgaacaggtggagaatattcttgagccggctacatacactgaagatgttttttttgcggggatacacttaagatgttgtttcttgtgatcgtgagaagtggatctaagctatgcaggaggagatgcagtctcttgagaagaattacacatgggagcttgtgcacttgccaaaatagaagaaaactgtccgttgtaaatggatcttcaagaaaaaggagggtttatctctcagcgagcctccgagagttaaggcaaggttagtagcaaaaggtttcagtcagattgctggtgttgtttataatgatgtgttctctcgtaaagaatagttcaattcgcacattctctagtattgtttgtatgcatgatcttgagcttgagcagttagatgtgaagacagcattttcacatggagagcttgaggaggaaatatacatggaccagccagaagggttcatagtaccttctaagcaggattatgtttgtaagttgaaaagatccttatatggtttgaaacagtctcctcgtcaatagtataaaaggtttggttcatttatattgtcacatggctttaagagatctgaatttgatagctgtgtgtacattaaatttgttaatggagcacctatatacttgttgttatatgttgatgatatgctgattgctgcccagagcaaggaagaaatcagtacattgaagaaaccaactgagtagtgagtttcatataaaggatcttggtgctgctaagaaaattctagatatggaaatcactagagacagaaattctggtttattatttcttagtcagcaaagttacattaagaatgttcttcagcgttttaacatgcatgatacaaagcctgttagtactcctactgcacttcattttaaatcatcagctttacaatgtgctagtactgatgaggatgtagaatacatgtcaagagttccatattctagtgcggttggttttttgatgtttggcatggtttgctcccgtccagatttatctcatgctatgagtttggttagtagatacatggctaatcctgacaaagaacattggaaagctgttcagtggatttttaggtacgtcagaggcacaactggtacttgcttgaagtttgtcagaactgataaggggcttgttggctatgtggattcagattttaatgccgatttggataagacaaggtcactcacaggttaggtgtttactattggcagttgtgctgtgagttggaaggcaacattgcagcctgttgttgctcagtctaccactaaagtagaatacagggctattactgaagcatataaatattcagtttggctgaaaggattgtttttgctgagctttgtggagttgattcttgcattaacatgttttgcgacagtcaaagtgccatatacctcactaaagatcagatgttttataagaggacaaagcacattgatatcaagtaccattatgttcgtgatgtagtcgcgcaaggtaagcttaaggtatgcaagacaagcactcatgataatcatgcttgtcggtgatataggcctgggggtatgcgaaatacgggggagttaccttcccgtccagccacgaggccctacagcctggccctccccccacacctcggaagacgtagaggcagccagggggcctcggggtgccacgtcacgcccctcgggccctcgcgctacctcgccccgaggccctcgcccagctaccacatggcgaggggagcgagtgcggcggagactcaggctgaaccgccatcaatgcgcggcgccccaaccgtccctcaccgcatttaatgtagtaagggcggacgtgcggtgctgcccgattgacccacgtcaatttggcgtgattagactgtgatcggcctgtcgccagtcacatccgatcggacgggcggccgtgcccccacgttccaccctgtacccggcggagtgggggcaggtatgccccgtcccattgaagcgtcatccagagctccacccacgtgagaaggactgccacaagtcttcattcatttaagagggaatgacagggctgtcccccgtgtcaggcggcgggcagcgctgggccctactcgaggatggacggctgcttagcttccgggcgaaggcacggatcgtggtctggtctaggtagagtgggtccccctcccgtgaaagagtaggtagaggtggtgcatgtggtatccccttgaactataaaaggagaaccttgcccgccgagaaaggggacgactctcagtaagcttagacccgaggagaggaagagcgagagtggtccctggagtttaggaacctttgtaacactcaaccataaatcacacgcaggagtagggtattacgcttgatagcggcccgaacctgtataatcttggcacccgcacgcggtctcaaagatctccaggcggatacacgatctcgacaagcgtgccttttccccccggccgaactcacaaaagggggatctcacgatcacccgctagagaggatccgtcctcgacaatgctgatatgatgacaaagcctgttcctgttgctaagtttgagctttgctcaagctaagttggtagagtggtttagcccaagaggctatttggcaccgaaagtgtttttgtctttgttgtgttcagggtaaaggattgattcatgctgcaagaaggaatttgtctcaaggtgtagtttgctgggttgtgatccaaattcatttgcacttaataaatgcacttaataaaggccagcttctgccggagcgaagtgaaggtacggattgtaatacattttagggtttcacctcatatatatatttacatcttataagccgccatgcggcgttataacctcaccccgatatagtggagatattttgctggctggtgcccgtggttttttctctcctgctttggaatggttttccatgttaaatcttatgttttctatgattgatctatcttttatttgcctatcgtctcctaacgaaaacaaatcgactcatatgatgtgattaacgactatatgcagacaggctaccgcatatatagcagataatgacatatatttcatgcaccaatgagctagttagtagctacgggcttccacaacacattgttacattgctgatccatacatcgatcccaaagctagctagctcaccttcagaaactacaactcctcccggccggactctgttggtgcgagctaggcagcagctcaggctcagcccctttatttattcagatgagcaactacgtacacaacactgctctgcatgtcgatcgccatgatcagtgattttattgaaaggcagctaagctgaaaagccctgtacgccgagaggcatacaaagcagaaaacgctcatggcgacgatcgactcatcgatctacacaagctcagccactgactcgatgatcccttcgaaagagacgctctggttgttagccaggatggccgccatgccgtcgccacccttgtagcagccgccgctctggcagccggagccgcagtagttgccgccgaggccgcagtagccgccggcactgcagcagaagttgttggggcacttgtccccgccggcctgcttgccgcaccgcttctccgggcagcacgcgccgctctggcatccgttgccgcagaactcgctgccgaggccgcagtatccccactggctgcagcacatgttgttggggcagagctcgccgttggcgttgcggccgcacttgatgtcggcgcggcacggcccgttctggcacccggagccgcagtactcggagccgaagccgcagtagccgtactggctgcagcactggttgttggagcaggtggcgccgccgccctggctgccgcagcgctggctggagcagcaggcgccgctctggcaccccgtgccgcagtagtcgcggccgaggccgcagtacccgaactggctgcagcacaggttgtgcgggcagatcatgccgtcgttctgcttcccgcacgtctgcgcgttcgtcgccgcgacggcggcggcggcgaggaccgccgccgccatcgccatggccttcgtcgtcgtcgacgtcatggtcatcgtacgtctcttccttgcagctccgttcttggtactggatagttagcaaaatgtagctcgatgagtgcctgagtggagtagctgagagtgaggcctctttatatatacaggcggcgagagatgagacgatgaaattaatcgatggatagctaccacgtgtaagatcgatcgatgagctgcaggggggccgggttgcacatcacatgcgagcttgactgctcgtgatttcatgtggtatattctacggctgcagcgaggcatatccgttgcgttacgtggcgttcatgcgtgatcaaagtcagacaacgcctacgattgtggatcggatgcaccgagatccatgacaacgtgtttcttgtgtctctttgcatgcatctccatgcaacggtgtcggttttctgcgtgcatgccattcatgagcatatattttattatattaagtctgccagtgtatttatgaaacttcatttgatttcattttatagtagtatagtatagccaactactagcttcaatttatttataactaaactaatagcttattaataaaactaggaagttagcccgcgcattcgcgcgggcgggcatcataggctacggttgagacacttatgagtgcggaatactaatcaaagaatatctggcatgcttcaaaagtataatttctccataaattttcttctcagcattgcttaggtaaaatttctaacctattagttagttgtttcaattatctaacgcaattgttatggcagtagccttttcaatctaagtgaaatgtaagaagcaaaattttctaacttttttctccaattggttagatttactctctaataatatttttctattttatttaatacaactgcaaatataagttcaaaatttgtgatattatgaataatgatagagcattacacctttcatctcaactttgagaaaatttcaatcacccttggtgatatattaagtagttaagactgatgtgggtcctcattctttattaacaataaacacatgaattggatggtatggatttcttcaataagattccgtgctgtgaaacacatctatgaatgtatcatgtagagtatgcggggcttcacgcaccgatcgtaaacacaatcgtacaactaaatatatctaactgtgcatgcatcattatattggaatgtaatgtattacatgcttctatgatttgtttggttactattgatttagtttagctatatatgtttatagagtgacttataatgatataatatatgctggcaattttttttctcgtatttcattgctatttggatgacatgcaaagtgcatgggtcaactgtggatcgtgatgtgcacatgtgaggggagcagaatgtgaaggggactttgcgtttctaatttttagtatacgagtgaaaactaatgattaggtgctttattttttcttagtttgacggtttaaggttttcctcaaaatatatctaattgctgaaaataattgatcgctcgaaaatgattagaaaatagatgtagtaagtgaaaactgatgctaagatgattttcttttaatcttttcttagattttttttctaatttaacgtgagatgtcttaagagttatttagatggtttttaatgtatctttattacatataatgatttaagattatatatgtaacctttttttgttaatcattcactgttatttggttgtcgtataaaggataaggatctgtgatgtaattcatttttatatactatggtaatatagatctggatttatttatttaattataaataatataccagtttaaaccaatcgaatgttatatattagtttccatgcaaattaaggatatggatctataatttattccaaattttgtatagtaaaatatgagtaatatgagtattggattatttagctaccaaattataaattagtagttcaaatgaataaaaaattagatcgattgtttttatattaatgtgttagttagaaaataggaaaaaagagatcaactgaaaagtagagaggtactcaggagaatcgcatatatgcatgcatacgtacggcagtcgacaggaggatacgtacatgcgtttgttttgtttgcagatgtattcaatcggtccactatcaggacaaatagaggaagagcgtgtatatgtttaggtgggctggtgtgggagaggaaaaggacgcgaattgtggagtctttttaaggataaatctaatattctatgggtccaccagtttattttattagattgccacttgtcagtttaggagcgtttataggagaccatgtggtggcttgagagcgtttataggaagtttaatagactttcagtatataatagatgatagatagttacctataaacatatcttaaaacattaatatatggtcccacctcccatacactcataatgtattggagtccgtgctaagctggctgtaaatttatagctcgctttccttctctatcttgtcatctctcctccacatgtgcttacagctgacttgtagcctactattgtactcgctctaaacccatgcaagtaaaatcagtattagagctatccttacaattaatacgtttcttacaaaccgagctaatctagtcttgagttatttccccaactttcggaactcatattcctcgagttccacgcgcatgtttttttaaacggctaaccattgagttttttttaaaaaaactttctatacgaaagttgtttaaaaaaatcatattgatccattttttaaaaaaattagctaataattaattaatcacgcgctaattaatagaccgctttgtttttcgtgcgccgaaaatatgttcccaacactagaaaacaaacacagcctatgagtttatttgttttaaccgtaggaaataggcatatcaaacatcgtaaataactcatataataacctgcatttgtgttttgtgtccggtgcacatcacacgtggtcagttgagcagagaagcctaatgaactgtgaacactcttgtgggtctctcgggatgctacgctgtccaaaggatagagtactgggtgctagctagtggttgccagcagctcggcaatgcgcaacctgccggcaataagcagttgcagcgctgagccatggtgactttggacggatctcaacgtgatccttgatcacttctcggatccatacaatcatgcatcaactcccccataaccccatacatttattgaagaaagtatattttttcccttgaagttcacaaagtgactctaaaaattatttctgactcaaacagttcccatcctcgacggtgttaggtgaaaacaactttaaaactcgttagtacatagatgctttgtcgcctcttatattttctgttcatgaatcacacacaaaaaaaaaatgagtacgtcttattgccttcaaacacaacaaaatcctttcatcaaacttggaccaaatgttgttgcatttctaaggttttatatgtcgagcaaatagtatatattcactatataaatacctattctatctaattacacgtctcctagggctctcataataactataaagatctgggcatcgattagatggactataatataataactgtagatttaatcttatgtgtttccatgaaaaatagtgatcaataaaatccaaacgtgaacatgagagattgatccatatataatataaagtgtaatcacatacatgatacatgcattatgcccacgtacgcgcaccaactacagacgcatacaaccattacaatatatatcaaaaataaaaaagaacaaataattcaaacatgggtaacaaagttccattttgaaattaccaacaaagaaaaaaaactatataggagtagtttatactaatcaaggatagataacatgatattcatccaacatatgtgttctggtgcattgcataccacgtcgcagctccgttttctgtgcatgtaggttaatctgccaacaaagtattctttgctagtagtattaatggtggagcagtccatcttatcaccttactatgtgtttaccgctataaacagtaaccgctatatagtgcctgctacaggagaaaactttgtatggtcttctgtaaacagtattccaaaagatctacaccatcaatttctaaggttgtgtatagatccagaggtaaatttttttaccgtgtcacataggatacatagacacacatttgaagcattaaacgtagtttaataataaaacaaactgctgaatctgcctgtaaactgcgagacgaatttattaaacctaattaatccgtcattagcaaatgtttactgtagcaccacattatcaaatcatgtaactattaggcttaaaagattcatctcgtaatttacacgcaatctgttaattagtttttttttctatatttaatacttcatacatgtccttagcgatactttttatgtcttcactccagtgaaacgctcgctttatggaagaaggtcatgattgacatgtgggccgggcaaacttattcagttttgttttattcacttggctgactggattgcactaggaccaaaaccactagtactttatatggtgtttagcggtaattcaccttgtctaaaaagtttagtggcgaatatcagttaattaaggggttaaattggaatgcaatgcaaaatcactatttagcgactagctagccttgtgtctaggggtggatagcaagccagcttggctcggttcggtaaagctctttaggataacgagctggctcggctcagcttgttatcccaacaagctaaaaacccagctatgtgcttcaacttcgggaattccagtagtacatctcttggatatttgttagatatttatggtcaaagcaactggctccacagggaagatctgtctgaattcactacaacagatgatgtcaaggatctctaaggcaggcaagtgcgagtctggagcaggccactataatggaagcacaaacatgagccttgggcatgagtgcaggtgtatactccatagctttgcaaaggagaccatgtcccaaccaggacttgttcttcctctgctccaaatacaagttgccatcatgagctcagatgctgaaaaggcctccagtgctcggaaggtatccaaaacataatctggggagaagattgtgcctaatttgcagaatctctccgcttgacacatccttagacgagaccttcctgttgctcttgtcaacgttagtctttcagggataactttggagattgaagaattgtcatgcgtttgcaatgactcaacatagtccatcacaaatgctatagcgttgattacctgtggactgactgcattgacataactttctattccctccccaatctccacatgaagatcttgtggcttaagctgtggtgcataaatgccactgtagttagaagtttttcctcaatgttgacatcactatagctatagtaagtcttgatgattgatgacctttgtgaagctgatccgacaatatgttgagtacttgagtgctagaagggcccattatccccttgttttgagttgtatctttgagggcaggagagatgcggcctctcccctctacccgtcggcgcctctccacttccgaacgctgcttgacctctcccatattccccgccccggcgatgatatcctatcgcatctcccctcccactgccaggagctccgcggcagctatgcaaatcgagtggcaagctccacattgggcagagcggtgatggcagcgacatcctctccccttccccatcccacggtgacgagctcggtgcagttgccacatctagcccggtgtgaggcggtgggggcgaagttggagctcggtggtgcatatcgggtcggcgggttgacgagctacttggcggcggcaaggagcgggggctgcagccaacatcgagcgttgagctatttcgcagcggtcaaggagggtttgttcccgttctcctcctccttgctgcttcttccgatccggcgaccttggtggtggatgtgctcagagcggcgtccttgacggtggagcagctgcgcgtggtgagggactaggcatggcgaggggcgggggagctgctttcgaggaccgatctatgatttcatgtactatgctactcccttttctagtttttgcaggcgaggaactcgccccttagttgagggacgagaacctctacaaaggtctaggggcccacaccctctctcccccatggcatcaagtagcctacgtggcgcaatgaatccacgcgacatggtggtgcactgtgaacggcctaaatagaatatacacatgattttgcttgaaattgatcgtttagagacacctagctacagaaagaaaaccatacaaatcttggatgaggttgcctttccacaatgcacaaggtaaagttcaatataagattttaccttacagttaaaattgtcaataattgccgatggctaacaatgaatgactttgggaagagccctaggtttaccatctccatatgttccgttggtgttgacatcgctcttataagccactatatgctctatttgggcttaagaagattccatggtattgtcagtagtcatatacgcgtttcattagtccatctctaggaaataagttttcataagatttcattctatgggattctagaaaaactctccgttccatatatcacacccatttgaagaggatatcttctcatagttagaaaatctagaatactagaccaaagtacaaatattttgcctcctaaacatacacatcacttgctagcagtacctatggaatttcgaccatcgccatccctatggatctactccctccatcccattttaagtgaagccataagtttccatgtctaaatttgattgtccgtcttatttgaaatttttttatgattcgtatttttgttgttattatatgataaaacatgcatagcactttatgcatgacttatgctttttttattttttttaaaaaaaaattcaaagaagatggacaattaaagttggatacgaaaactcatggctgcacttaaaatgagacggaggtagtactatggtaccaatattatgtttggggttcctctccctctgctttggcaaccgggtgatggtgagctcaaacaggccaagaatcctaatttgtgcgtgcgcgctggcagcgcgcactctcggcccatacggcccacgcggcgcgcgcgtgcaattttttcttcgctaaccaccaccattttcttttttttcgctttcttttttttccgtgatttttttcgctttcctttttttttttgcgttttttcctgattactttttaatcttccagcagcaagtgttttcaattttttttgttgaaagatgaattaaaaattttcaaatctcgagttgaaagttttcaaatccgagttgaaagtttttaaatccgagttgaaagttttcaaatttcgagttgaaagttttcaaatccgagttgaaagttttcaaatcttgagttgaaagttttcaaatctgggttgatagttttcaaatctgggttgaaagttttcaaagttgagttgaaagtttttcaaatttgacttaaaaaaatttaaatttcgagttgaaagttttcaaatctaggtttaaaattttgaaactggacttcatatgtagatttctttttaatttgttagttaaaaaaatcttatctactaccatcattatcctaaattgttattatctaatatactagtagattagtataactacttaggccgaaaaaacgagcgtcagccagctagccatgccctagacaggctcggtgttaatggcaaactggttccatttatcaaatctataagagacttatagatacactaattagtgtagctagaagataattcactgagttttgaatatgtgtagctgacaagcgacaagtgaatctcaatcaagcaatcgattgaaatatagctgaaatcctctatatattttcaactcacagtgaatgacagatgggcccctcttatcagtaaaagagaccttatacctagcaacatttttggcctgcagataagcagcagagagaaggaatctttcatgtcgcaccatctatcatcattattgcaaggataagataagtagagaaaaactccaaacgcaatgagagatgagacatgagagattagccacgcttggtccccatgcaaagcacaatcgtccttgcgcgctctaatcatgcatgttactagctatagcctctatcaattaaacaaacaccgatcagaaaagaaaaggggatcatgatatttaaacaaagctagcagctagcagcagtagaaacaagaacaaaaacaaacgtctcgatccaggacaggaatgaaatctatcaatccatcggacatatcattcaggcctgggcatcgatcgatcgactgatcatcctcgtcgtctatctcgttggattcatgctactaatattattcagagctttgctccatcactattctttcagagtttcagacaacagcaggtgatgcagtacagttaattaacgatgtaatagcttaggcatcagtgcagttgtatactccgcagcttttttgcatttcagtatacaagctagtatgcaagacattcttttttgcacttcagtagatatacaagtgcaaacaaatttcgacgtttcttacccttcgtctaccttgttctccagtatagctttgtacttaataacgtactccctccggttctataattcctgatattttgaacaatgatatggtctcccaaatatatcattaactttgtttttattataatatataatgcatgtttacttttcttacaacactttgaatgacaaatctatatatgttgttatagttcctttaaacaaaataattttaaagttattgataatcaaagttacaaaagtttgatctcaatattgtccaaaacgttaagaaatatgaaaccggagcgagtattatacaacccctactacagagtactccaacagggttgtataatctaaaagtaaagtggagatactgagatttaggctctgttcggcaacttgggttgggaacccatgtcccccgcacgaaaaacagagaggtccattagcgcgtaattaattaagtattagctattttttttcaaaaatggatcaatatgattttttaagcaattttcgtatagaaactttttgcaaagaaacacaccatttattagtttgaaaaacacgcgcgcggcaaacgagaaggggagttgggaaccggggcaacaaacaaagccttttattttgcatcacaagttttcgcaaaccacttctattttgcaaacatgccaacactacgtgttggattttaaaatggtttcgcaaccaatttttccacatcgacaaacaagtttggtgtgagtgggatcattggtactaagcccgagagcatggcttccgtggaaccacggggtgaagcatcatcaacatcctacatgagtaatgcaattattgggtagatctgtcggttcgtcacacgaaccgaggccagtcaagttaacatgcacactagcaatgcaattttgcaataagacattttggaaagtagaagcaatatgatcaaatggtaacttacatctgtcctcatctttaaaatctttaaaaatcctcatccaaaataaattctgttgtagtcaactattcgcaaaagagaaaaaccaagcaaactactaaaatgaaaatagtattattaataactactagtccattaggtagatctcaatttagaaaaaaaataaagacttgaacggagtagatcagagttacggataggaaattatgaattttttaatttaaaaataatttctagatttaaaatgggatttatttaaaactggaaaggaacatgtgtcctcaccttagagagggttttttggctttaatgaagatagttttgggcgcaacgtcttgctcatgctgattgtgcagattggatcttgcgaaggttatggtatagttactatcaatctatgtctaagtttccatgttcgaaaatgaatagtaattggcgtcaatcatttggaaacgattatggagcgctcctttttttacaagacatttctgaatgaacatttaaatggaagaacaaaaacgagccccacttgtgcagatggattctaatcactcaggtggatgtccacccgtttattgcatgtcaactaaatgattgaaaaaaattcaaaaaaaattgacaaggtagatttatatgaatagagttgaattcaactgtgagtatatgtatactaattagagttaaaaatttgttatttttgttacaacttgtagaagttgaatttaatgtcgcttgtttgtggcgtgacatattacatatcaatctatcttgtcattttttttgaaatttttgaaaagagggtattttaaggggaactatttaatttgctgatctgcaagaaggaatttgatgtagctagtagctactgaacttgtgttgaagatatgcattggtctttgctcttttgttcttcgcttgagcctggagctaacgaataaagatgaaagctaggaaatgtactcttgccacacacacccaaagaaaaggtgaatccattaacttatcgatgatcaaatggttcagatcagtaacttcttcatcgttagacactgagggcttgttcggatcacaggataggaaaaacataggaataggaaaaacacatgaataatataggattgcatatgcaaaacgtaggattgaaaaacaaaggaatttgatggtaataagcattcggaacactacaagaaacttgttaatccatgacgaattctcggtgacggatttacagatcgtcactgacaaacgtaatccgtgacaatattttgttttttgtcacggatgagcccagtggatattcatggcacactaactcgtgacagttttatcaggactgtcacaatgtatgattttaaattcgtcatactctaggtagcccaaaacaataaaaaaataaaacatatttagcgcaaagaaaaataaaaaatgtgattgcaagaagaatcaaacccaaaatacgatttgttaaatttgaacaaaatagttttgttaatatgttatatgtatatgatgcataatatggcaaactaaaaaaatatggtgcgcatgggtaaaaatctgcaacatgtgggatttgaacccacactaagctgaaggtaggaatgtgtcttaccatttgaaccacttgttctattggtcccaatgtgtacttaaaatatttttatttgccttttatttgtcccaatgtcactcgagttggcccaggatgttgcccatagcgtggcccagcaactcagagttggcgtttcaaaaaggaaaaaagaactcgaattggtaaaatagaagttcaaaaaggaaatattttttaaatattctacgtgatctaaattattctttgaaatttaccgtgaattttcgaagctcaataactaattttaataccacaaagttcatttactctattaaaataaatagaaaacaaattaaaatttctctctctgcacttgggccttttttggctcaagtattaaaatagaaaacaacttttgttttggtcattttgttatatgactttgtttcaataaattgaatttgaatttcaaattatgacaacttcaaacaacattttcaaatactaaatgatttcaactgaaaaagttatcaacaacaaaattgtatagttcattaatatctataacttttattttggtcatttctttatccgacaaagtgatattaatattgttcacaaattttacatatgtctcttatagtttatgaaaccatatgggagatgtgtaaattttgtgaacaatgttactatcactttattggatgaagaaatggctaaaataaaagttatagatattgataagttatacaactttgttgttgatgatattttcagttgaaatcatttagtatttgaaaatgttatttgaagttgtcataatttgaaattggaattcaaattattgaaacaaagtcatatagcaaaatgaccaaaacaaaatttgtaggtattgatgagctatacaactttgttgttgatgactttttcagttaaaatcatttagtatttgaaaatattatttgaagttgtcataatttgaaattgaaattcaaattattgaaacaaagtcatatagcaaaatgaccaaaacaaaagttatagatcttgataagttatacaactttgtttttaataattttttcacataaattcatttaatatgataaaattcgattcaaagttttaatactttgaaatttccaggttaaatgaccattttgtccaagtaacttgtataataggttttcagataccagggttattctagtaaaatcgcatcaaaattgctactcccctcaaccctagccgattccaaatctgagtccaaatctctttccgcaaaccctcgcgctcgcggctctgatccagcgcttgccaacagctgcgtcggcctcggcctcctcggcggcggcggcgacgggcgtgggtggggtggagcctgctgtgacgctcgaccaggtgccgcggtggagcgaccccgaccagcgcctctcctcctccttttcccgcaccgccgccggattcgacgagagccccgcctcgtccttcctctcgttcaccgacgacggcacgaccgatgtggtcgggggccgtggcgtgtcgcggttccccgtcgaccacgagatcaactcgaagatccacccgtggaaccttgaggtcgatttccacccgtggattctagcatgctttcccctactgatctacattctgtacttgtaatttgtatatgtagttcttttctctacaaattgacattcagatcaaaacattgtaacaaacatgcatgctaggaacacttcatttgtgcacttctgctgggagaggcagctaggattatcagtttattaccaaatatagtgcatctaataagacaccatatgaagtaataaattaaacatattgcttatcatttgttgccttctgcttgtacatgtgtttttttaggtaaatctgcttgtacatgtgtagaagcatcacatgatttctgccgtataggaagttaggaactgtctatatactcagtggaacggactattaattagtataccatgctatcatccatgaccaatattctcatctttatggtcatgcatacaaatctatatgtttaagtactatatgcctatatgcctatagtccgtagaaatgaagcatgcataggaagttactcgtatcataactttagtgtctaaatttagtgctatgctcctatgcattctagttcactttcctgtaccactttacttgctctcatattttttttggtttagtctagcgtcagttgcttgtttgcttggccaatgaaatgaggtgggttggggatagggacattgagttctgttagcgcaatatattatggggacacagattggtgttgcaaagtagccctatcattcaaaaactaatatcttgtctgtagattgtttcttgttgtttctctagctcataaaaaaaaatctaacatttggtattgtactatcaggttgctgggctgaaactttgatggagtggccaaaatgctttggtggctgctgggaattgtcatgtgcttttgaacaggttttaattatgttgtatgagatatgctaaaaaaatgttgtatgagatgtgaaggttgtaatgtgtttttagaatatttatgtgccgctgatgatgagagaatgtaaattgatgataggtaattgattttgctaaaattatggatgaaatatttgtattttgctaaatttagcatcagccgaattttagttgggctgaaatattgcagtagcccaatttgaactgggctgaatgataattaaaaggccgtaaaaacaccacaaaaaaacaaagtggcccaaaacaaaaaaaatccagttggtcataaatgggccgaaagctccaggaacccgaattggaccaaaaacacatgggctaaatcntacgtggcatcaatgacacatcattgtccaccttggcgaacatgtggcacatacgtggtgattcgaatccgtgatcctacgtggcagataatctgtgacggaaaaacatcctatgtgtcagctatccgtgacggttatttttcgtcacaggaaatgggcttggctggactaactaggcctcgggctctatcgtgacggtttaaaaccgtcaccgattctgttaatctgtgatggttttcgacaaaccgtcacgcaagtcaatccatgacgctcaatccgtgatgatttctgaaaccatcatagatgttgtttggtgacgatttttcagtgatccgtgacggaaattttccatcacggatcaacaagattcttgtagtggaatacaggaatatataaaccataggaattttctaattaatattgatctcatatattatagtataattatagtataattaagcaataaaatattagttcccatctagtcactccaacgtgattagcatctaccctgtggtagctaatgataaaaatgaagtgtgagtggatgttcagaatcccgtgaaattcttgcattttcacagggttgctacagtattcgtacaaaattcctacgcgtgcttcctatgaaccgaatgcatgaacatagccaaatccaaaggatttgccaatcctaaaaaaaatcctgtgtaatccctccattccgaaaaaaccctgaagttgtaaagaaatttaattactctcaataaggaggtgtttatattcggtcggtcatgtgctttttagtttgagaggatgttggattgaaaattatcaaatactactcctttcatttaatttaaatgtagagggaaaaacattttccgcacaaaacgtttacacatatctgttaaaaaaaaagctcttgcttttataatagtaggtagttcattattctcacttggtaatacgatataaattcttgagaagcaccattagagcgaactaggaaggtaggcaggtagcccgcacattcgcacgggcatgtaccgtatgtaggatagatttgagaaacttataagggtggtatactagcgaaccaatacctgcaacgattcaaaattgtgattttttcatgaattttcttcattaccattgcatgacaaatttaattggtatttataaaataacatactggaaattggggttggtaacttatggtatctaaatggtacctaagacacataactcttgaagttccataagaaaagagagaaaacttaagttataaaagacattacatatagaaccatatataattaatagctctaccgatttatgtagaaaaatcgacaattaatttattatttgatggataattcctcataggaaattatgaatatgtgtaaagtatagggatacaaattagagaaaatagtggaagttacgaaaaaaaatctgacctttggatatttagatgatctaatatattgtgcacattccaactaaccaatattcgccttccctcaccacagatggtggacatgccaattcgtgcctctagtagcatgctcgcatcattatatcgagaagacaaaaaagtgtcttgcatgtataggcataatatatgtaactatctcatgcccctcttttcatccaagaaaaaaattatatacccagcatgcatgtacactgggatgcacctggctagccccccaatttgtttactccatggatctaatgattagataatttaataaaaaacatacaattaagtatctgaaataaatttttattagtacaatatccataaggacaccccctgtagaccccccctcttcccttcttcttttcttggtgaattatttaatttaatgtccaacttccatggtattaaggtttcccaaccatcagcaccgaacatagcctaagattgttcatttacccataaaaaatcatatctttatgaaagcataaagcatcaggattaagtaaatagcctccacatacatgttgagagatataattaagttggttgagagtcaataggtccattgatgctataattatggttaacacggtttataggtatgggtccattgattttattaaaacaaataaggtggatattttgacttttagtgagatttttttaggatttctttaagtatacaatggttcaaacagatcataaattgaatatataatttaatattcacaactaatgaagattctttatttatttataaaacataccaagatcaacatgcatgagggatattatcttgtccatatttgcaagtgcatgcagtctttggagtgcgatgaaattaagttagtaatatagaagatattagatacccgtaagcctttacttaatttccatagagaaaaaagggaacacaacaaggaaaaagcttgcttgcccttttcatgcttgtggatggaaaaatgtccggccgttgggcaaactcgtccggtctgatggtttttaagttctttttttttaaaaataaatgtaccggtttttgatggtaaaaaattttgggtcccccaattaattaaacccaaggtctttttttttccttaaattttttaggatttacctaaagccccccttgtctttttaaaagcgttttaccttatttaagggctttttagtttttattattggatggatggatttatttttttaggctggggaaattaactttgtaatatatacggccattttaaaggtttggtcctttttgggtggtcaaccaaagaaaaatgatctatattcaaagttaggaaagtgtttttcttatatatagatttgatgggttcaccggtttaaaccatccaaatacgtaaactaatagttggtgtacatgtcggagttatacttttttctatgacaaagtctctcgaccccaatatataaacttctagtaagtggggacaactctcttgttaaatttgttccaacgtcgtcggcgcaagtgtggcgccagctttgtggttctggtcatgtctgatccatgcttgcaagggagagtccttctctgccatggaggatgccggaaaccccacaaccgactccaagttggcagtggtgctcttcgtctagagtcacaaaaacggaacgagaacgatgctcctcaaaggcttctcccggcgggtaaagacagagaagtgcggcgaggaatttgtcgactcagtagtatagccccgatcgagagatggttttgacctcagtgcggggggtagaggtgagattgaagttgccgagtactcgctttatttagctgtcgcagcgcccctgtaagttcgaaaaaagctgcctcaacataggcagctatgtgcttaggcggtggggcttataattgtagtaaaaacggtggcgacaccgatcagctgtatgacccactgtagtgcaaatctggcacacagggttctcagtagacttatcagtatcagtgaagtcataagtattggtacgcccccctgtctaacttagtagctgacacagcattgttccaagatgcaagaaattattttctttacacttcagtatacaagcgcaaacatattttgacgtttcttacccttcttctaccttgatctctagtaaagcttcatgcttaataatgtactcactctggttccataattcttgacattttcgacaatgatacggtcaccaaaatatatcttttactatgtttttattataatatatagtgcatgtttacttttcttatattactttgaaggacaaatctatatgtgctgttctagttcctttaaagaaaatacttttaaagttattaataatcaaagttacaattgtttgacctcaatcttgtccaaaacgtcaagaaatataaaagcggatggagtattatacaacccctacagccttgctacagagtagtctgacgaggttgtataatctaatagtaaagtagagactctgagatttaggatgagactctctttcttataccaatccttggaatcggtccatatatgcgagtacaaagggtctcgctttatatcgcaagttttcgcaaaccacttttattttgcgaacatgcaaacactacgtgttggattttaaaatggtttcacaacccattttcccgcatcgacaaacaaatttggtgtgagtgggaccattggtactacgcctgaaagcgacaaagggttggggttatcaacatcctacagtagtaatgcatatattgggtacatctgttgatttgtcacatgaacaaaggccagtcaaattaacatacgcactagcaatgtaatttcgcaaagaaaccattttggaaagtagaagcaatatgatcacatggtaacttacttctgtcctcatcttcaaaatcttcaaaaatcctcatccaaaataaattccgtcggtgtcaactatgcgcaaaacagaaaaaaccaaataaactcctaaaaagaaaatattattattaatataactactagggccatttggtagatctcaattcagaaaaaataaagacttgaacggagtagatcagagtcatggatagaaaattatgaatttttgaagttaaaaaataatttatagatttgaaaaaggatttatttaaaactggaaaagaacatgtgtcctcaccttagagaggttttttttggctttaatgaagatagtcttgggtatgacgtcttcctcatgctgattgtgcagattggatgttgtgaaagttgtgatgtattactatcaatctatgtctagtttccatgttagaatattcaaatggaagaaaaaaaatgagccccacatgtggagatggattttaattacttggatgaatgtccacccggattttacatatcaactaaatgattatgaaaacaattcaaaaaatcgacaaagtagattaatatgaaatatatcactccacagacatcggctcggctcgtttaaaagcttgagctagctcgttaagctcgcaagccaaaccatccaaaaaagctaccattattgcccctagctctcaggaacaaccaacatcaagcatgcataatgatagtatgataaattgttacatgaaaatatcaaagcaacaaatcacattcacatataagtaatctaccaaaagtctaggattaaacacatttcacaagtacataaaccacagtcacaataacacatactgagttactgacatacatcatcagttcatcacatattgacatcacattatcacatattcatagtccacagtccacactcacaagttacaagacataggcagccacatgcacacagtccaaactcgcaattaactttgaaatagttcaacaaaagattgtaattaaacataggtttagtccagtacaaatgtacaataatccatacttcaagttcaatagttcaatacaccaatatttagcataagtgcgtaactagtaaagctgcagcctgcaaggttcatcattttcatccaacacaattgcacataaacacaaaacacaaatagcctggcagctccctttccctcatagtcccacactccctttctcccatagggtgtaggcttgtagcctgcaggtaaacagattgtagagtatgatataaatgggtgaaagtcagaaacttattagatgaatataaattgtccttactagttgcttgccaccacacaattggggaagtccactatttcgatgccatcatctccattttttccctgtcaaaacagtccaaagtgaacaatttatataaaagacttgacacaaataaagaagcaaaaataatcattacattacataccacactattgtcattttgagaggctcttatccagcttgaagcacaaaccaaagcctgaactgcttctggcttcaaagaactccggtagtcatcaagaattcttcccctagtgctaaaagtggactctgatgacaaactgctagctggaacagccaagaacctctttgccatgttggacacaacaggaaacctttggtcatttaccttccaataattgagtaagttgaaagtgctatcatcgagggacacatttggttcatctagatagatgactaactcagactttgaggattctttagcatttgactgcaaaaaggactagaatcgacttggaataattgaagccaatgaggtggttgtagagcttgaggatgaggccgagcgaccattgtgtgggctgttcccaccttggttgtggcgacatgtcacctcataatttttgcagagtttttccatctcatcaactatggcagcaacctctgttacacaccttgtctcatgaaaaagttcactgaagcaccatttgatgtacctcatttagaacctagggtcaaggattgtagcaatggtgatgatattgtttgtgttctcccaatatttattgaatttttcaaacattgcattagccatagtcaccagcaatacaacattaggatcaggttcataatgtccagactgttgccgtaaccttgcagcttctaacagtgcagattatgcttgtgctctagatgctaatattgcaatcttaactttagctatgtatggatagaaaatattggcagtggggtaggttgatagtggggtaggttgatcctgaaaatgcagtggttgcactagacattgttcctaagattagctgaattttctcaaacaaatcccattcagattgtataggtagccactcatatttggtgtctgattcagcataataatgaaaagcatttctatactcaatgcatgtctgtagcatccgataggtcgaactccaacttgttttaacatcaatagacaaccctctaccaactttaattgagtaagtgttgcacacacccacaaatttatacatacaggctagagacttcttaaagtacttcacaatattcctaatattggtaccaaaggttgaattggttgcaggccatcattaacaaccaaattgactatgtgggcagcacaacgaacatggaaataatctggatcaaactgagcattctttctggtagcaagcttagacatcaaatttgaaacagtggtgtcattgtttgaagcattatcaagggttattgtcatgaccttatcctctattttcaattcaaccaagcaatcaaaaatagcctgagctatgacaatagcggtgtgaggaggctccacctcaacaaagtttaggacacggcatagcaaaacccaatgaacatctatgtaatgagccaccaaacacatatactgaaggttttgatttaatgtccacatatatctgtagttaaacttatggtctcagcctccctaagacttttcctgagatgttccttttcagattcatacaatttcatgcattcatttttatggccttgcgactagtgaattcatagcgaggattcatccacttcatcaaggcattaaaccctttatgctcaacaattctaaatgggtaatcatgttgaattatcataagggcaatcaaaagtttagtgtgatcatgatcatactcagtaggatgcaaaaccatagaaccatcagctaaaggaaaataaagtgtaccttgagctttagcctttg

SEQ ID NO: 75523 - DNA, 726 bp, Oryza sativa
ctgtttcctgggactggtatcgattaacaggttaatttggagcgtcacgggctagttccgctcggggctagttcggggcgtgacaatatgtgtctgcatagtctccaatattatactttgtctaagttttaaacaaactttataatttgatcattattttttataatatattatcaatagtgtgaaatatcatatgaattgtccaattagattttgtatctattgaatttgtgttgtatccgctttacgcgatgtgttacttacgtgtgtgggaatggaggccatcgctcggtcgcacttacaaataaaaaataattgatgtgacgaacggaaagttgcaaattttttaattaactagttaagaagttggattcaacggtacgtaccgtgttcagaaaatggaagcgtgtccataaaaatctaatagagctagtgattaaaaagaacgaggcgaaacttataccctagcactatactgtacgttttgccccttaattaatagaactgaggtacaaacgagggtcagtgtgcaaggtcggaaatgatcctcgcgtgacttcgtcaagtcttcagttcctaattataacatcgggcaaaagttaagagatcgattaggacagtgtgacatcacggcccaatttgaattagaaatgtgtggtacatgcatgtaagctgtgtatgtatgtttcataccacattgctagtttagtaaaagtggaatcaact

SEQ ID NO: 75524 - DNA, 725 bp, Oryza sativa
ctttttaatatatgtcatctaccaaatataatctaatatttttccggaaaatgttttaatcttttctctcaattataaatcatttgtaaattgtttaattaatttggaatagtcttttctttaataggtttaattggaatttaatcttgtaaaatttgtaattaattcatatgaaatcggaatgaggtcgttcaagtctctaaattcatctaaaatcatgatctacatgtttgtttactttatatgtactgtttatttggagtttcttagtctttttcctcgttttgcatgttagcttgtcgtttccgtcgtttcgaaggttcgtgagtgcgtcggaagtattcaagaagattaattgaagaccctttattgcaaggcaagtcacagatcccaaacataattcctttgagcatgttgatcctacatttaaattctctatttattttaattgtgcatttattttcgaatgtcaccgggtggtgagcctttcccatttaattatggccgaagatgactttatttacctatgggttataatttgattagctagaaccttatatattggtttggttcagctagatgcttataatagatgcttagccgtgcttagaaacaatagctcactaatgggataaatcatgcttcactatcacttatggatatttaatggaagctcacgatggttaatcgtgattggttaattaattaatatgccaactaaaact

SEQ ID NO: 75525 - DNA, 754 bp, Oryza sativa
  unsure (1)..(754): unsure at all n locations
atatcaatcctctgtagccccgattgctgcagtacagcacccgcacgatctccagctacacatccatctgcgcacccttacgttggtatactccaccagctcagatcgccggcattgcacctgatcagaagccaagcctccataactgcaggaatcaagcagcaataaaatccggttaaaacacaagaatccaanntttgncccccatcactgcataggaacagtgatcgatactctgcaaacagagctactctcgttctccaaaccgggcgaaatgcttcaggcacctaacaatttggccaagttaagcaccgcgaagacttgggtgacccgagttggagacttggagtcaacaaagcaaaattatcttttctttagcaaaaagaggataagaaaagaatataaacatgataccggtttccttaataaatctggaaattacctttggaatatccctgaagagtgagggaacgagcggtagcactaacctgctagaaaaatccatgtagctattgccggagattatggagggaatcgcctgtattcctccgccccgcccacccattcttctccggcgacggcggcgggggtcgcactcgcagcggtttccccacccgtccagactatggtgggcccaaacctaattttatcttggaataagttcactttgtgaccctgaaaaagtgatcgaaatctaatccgtgaccctaaaccacgaaaccggatatctcgacccccaactctcaaaaccggt

SEQ ID NO: 75526 - DNA, 1250 bp, Oryza sativa
ttctggcacatgcatgaccagctggcaatgacacaacgggagagagcaaggagggcaccttagcttagtgctggccagcctagccctagaggtggctagtcctgctccatcatcggctcgtgcgatgacaacggtggtcatccaccatcgtccccatcattgtcgccgcgtcctcccctgcgttggctaaggctcgagctcttaccgtctcgagctcggcacagaggacagtttcagcgatgcggtcagtaggctagtggtgcgataatggggaagcaacatcccacggcggtgctcaagtgatcgattaccctctgccgctggcctactaggttctacaatattatttttatttaagctaatcataacatgtgggttctgttgagttcttttatttatttttctaatcatattctctcatagacatatagcacgatgaacaatgtcacatagacgccaaatttatagtgaggtaggcagttaaattaatagctacgtggctctcaacggaaagtaagtacggcagacagaaggtgccacatagacgccaaatttatagtgaggtaggcacttaaattaatatctacgtgactctccacggaaagtatgatagacagcaggtgtgacaaccatgtccatcatcccttctatccccacgtttacttacatagatctcttggtagaccagggatgaactggacaccaattgatagatttttatttagtttaagcttagttaattaattcataggaatcccctctagtttaagcctaccatttgtatggtagaatcatgtttgtagatatacacatctattattcgatatccttgaaatactgttaggtggagtgttgcagcggtattcatacacttggatttattggtaactgtaacaaataccaataataaccaactacaaaacccagacatgggtatcctaatatgtttcactctaatatttcacctcaaaacaatattactcagacacatgtttaatttttttttgcggggcagacacatgtttaattaaaaccaatttacactattttggtgtcatgtagagctttctatgattatatacttacgtatttatatggagagatataatatgctagctaagctaatatctatcgataaaggtcaaaagaagaacgatctgcttctttaggagtagtgtatcggccatcaggtcaggatgcaaccaatcccattctagcctaacatgtgtagaactgcatatcaatcaacc

SEQ ID NO: 75527 - DNA, 535 bp, Oryza sativa
tttctgtgcactcgccttgcgaatccggtcgttgccgactcgcattgtcttgatgcattcccaggcttcccgggccgacgctttggtcgccagggtgccaatcatctccggcggcacggcactgcagatagcgtcaagagccatccggtcctcatgcagagggacgtccacgccgtcgggctcgatcgccgcccacaggcagcgagcctgcagcttgatcttcatcagtagcgcccagtcgttgtagttggtcttggtcagcagcgggtagttcaccgagccgcctccttctttcaccacgcggtggatcaccagcccgcggtcacccccgccgctgcccgtggcgcggccgccggagtcatgaggagtgtgcacgatcggtgacgacgagcgacgacgcggcaagaagacgccttccaatgcgcggtcacgagtccacttcctaaaccgtgctctgataccaattgttaggaatttccccagcgatcgctagcaggaaaccagacgaacacaacgcacgcgtactgtggctaaa

SEQ ID NO: 75528 - DNA, 1492 bp, Oryza sativa
  unsure (1)..(1492): unsure at all n locations
aaagtgaaaaccagagttatagatttttttttaaaaaaagtggaatctagtttgatttaatttttttcaatttggctgtttattgagcggtttgtcaacccaagtaggctcgaaatctcaaaaatttgtgaaaaccaagcggtttgttactcaagctggtttgaaacctcaatatttcgtgaaaaccgaatggtttttgtcagttttatggaaccttgagggcaacaagcatgtatttgtacatatacaaatgttttgcagatttagcacatccaccaaaaatattattgtcgtatacaaatatatgtatagaacgatatgacagcaataaattatacaagatataaagtcatttaatgtttcttaaggaagttatgtcatttaatgttggaacatatatctaaaactacaacaataatatgtaaatggaaaaaacaataaaatgtgtaaagatttgggatgtttaatctatctaaaactacaacaataatatgtaaatggaacaaaaacaataaattgtgcaggagatggcataaatgcaagaaaccatcagtacatctccaagattaagttggttgtgcatatatataaacatgagcagagggccatggcaacgagcacagtgaacttgaagagtggaaaatcataaatacatataggaggagaacttaattatcttcttaataatggcagttgcaaggaggatggtgtcctccatctctgtggttttcttcatgcttcttctgatcgtggcagattccaccttctcatcctgctatgcattaacacgtatgcagcaaagctattaattttactctgcattttttaaaaaatatccaaactacactgaatatgttttctctgtataatttgaggggttcatgatatgcctttttcccccctcttttaatttagtttgcaattagtggctcatgaatcatggatggttgaactgaattgcgtttttgcagctagacaaacgtgcaatgacctaggagatttagcgtgcactgacgagacgtgcaagaagatatacggagacagattagaatactactgcaagccaggcgtcacccctacggtatgctgctgtatgaacgtcacagcatcagttcccagtggtgtcaagaatcaaaacggcgatacgcttcttaattagttataattgatcatgttccatgtaaagttcgtcgatatgtttggagtttggtgccaactcaataaataaacatgcatacataatttgggtttgttaataaaccggttactgaattggctttgnnnnnnagtgttgcacaaagtgttcccctccagttaactactccatgattgcgtactagaggcagcagagaagagctttccaatgcaatctgaaacgtacgtgttcttttgccttgttgcttccgacgtacgttacgtgacatgttcaatgtctgaatctccagcaattcagcatgaaacacagcccgttctcgttcatgtagcaacgaag

SEQ ID NO: 75529 - DNA, 17182 bp, Oryza sativa
  unsure (1)..(17182): unsure at all n locations
ccgccatctcccatccaccaccacctccaccgctgccatccaccatccgccaccgccgcgtccccctcattggccggcggcatgccgacgatcccgactccttatcggagtcggagaccggccggatccgaataccgttcccccccacgccgtttggtatcgtgcggctccgggagccgtggggaacagcgatgaacgtatgacggaggccgggacggcgtgcaacggcggctccagcgtggcgatgtgttggagacggtgtaaagagaggcggctcccacgtgcgcaccgccatggttccggtgcggccgaatcctggtgccgcgggagtgggggagcgtcgaaagctaggcgtcggttgcgatgttgatggaggtggggaaggagcggttggtggtgatggagtggcgacgaacggggccaacagcgactccatctccagtgggagttcacacggctcgccgggcattgtcatcaccgccgtccatccatggtaggcacaatactgtaccccttgcacaaggatccagcgaggtgcttcggcaaccggaggcggaggaggtgcgacagggatggggggggggccacaaccggagttgcaggcacacgacgagggtagtggcggcggccaccaaccctagccctgcctccgcgggatccccggcgcgtcctcctcatcgatcgacgaagaagaaggtgaagccggcgtgcgcgctgatggcgagggaggccgaaaacggcatccatgatccaatgaaaggtaggcatcgtaccttctttgttgattcttctgttcgcttttctattagatcaaaagcgatgtttcttcctttcacttcgcgatctccttcgcgagagcgaaagtgatgataacgtgttgtgaatagaattgattgagcgagagagattgagtgagagagagaattgcacacaagaatgtagagaatgaatgagcgatcctttattgataacaatggttacaatatatattcgggagagaggcggcaacagaagacgcgatggtttggaaccagcgcgtccgttgttagaatcgccgtgaggcgagaagaggtgtggggcacgaccaaccgtcgtgtcccagaatttatcgatgctctatccatatagattgatgagatcacccaaatatttcataacaatgggggctcgttggttcaaaaaaagatcagatccggtgttacggagcaaaggtgaagtgggctgccatttcccatgatttctggccagtgaagaataatttttctcttctcttatatttctgagagaaaagatgaacagtgtattttcaaaaaaaaaattctgctgcaacaccaatatcaaaaattcatattgatagtacaaacttgttgcaattttactgttgttttttatgtgcttttatctctcttttttctagagaagcccggcttctatatccaactggatatatgcaatattttttaaattgggaacttcgctcctatgaagatttgaacttaggatcctgggatgctactcaggtcactgcaaccactaggctgctcaggtcactgtaactcaggactttaggatgttactcaggtcactacaaccacttgagaaattgatgcgcttagtttgaggaatccgtagttaatcgctaagcatttaattaaccaccgtatgaacatagaaatgcctccaacacactctatcgggacttcgcattgcaggctggatgggatcataggaggaagatacgcttttgtcttccgcaaaattaaccacggtatctaattaccattttaaccaaccacttttcgtacctggcccaattttttcatacctttttataggtataccttttatttttgtgcgttagagattaagcgtgatcatgagctcaaaccaccgaagaaagtttcgtaagtcgaacaatgaaaacaagaagtttcgtaagtcgaacaatgaaaacaagactgatgagcagttggctcaacttgcatagcgcagatacatatataattacttaacttatgcttcactgctataatgaccgtcacagatataaccttaaaggtttctaataaatcatttgagtttttataatgtgtaacggttcgaagtccatcggattgtgattgtgttgggaactatatagtatgaaccattagtgaatagtcatcattttgaaaagaggttagagatcattagttctcagttcgtagttacgaatgtttgctgcttttatgtaattatatgcacacaatatgaatccttgcaaattaaacaaaatttgcaacaatatcaatccttggaaattaaataaaatttgctactgcctccgttccaaaatattgcaatataggatagaatttaatttatcataaaataatgtaactaaactgaaccgatttaacacattctgtaaccataaatctcgacataggttctatccagattcagtggcggatattgagcctaggcaaacctaataatagagaagaactacaattaaatccatacaaccacgtgcccgatttagcatagatcgagttctaatttatgaagaagacaaccaatgcacgaaattatattgatgaaatgaaactcgttaatggttaatgttgaatacttgacattatatgtatatatagctagtcattttgctagtttatgtgctgatccactgatctgacaaccattattggaactagttaattaaacatgtaatttgctattttactcaaatgtacgtggctgaacgcctgaacttgtatctaagtaattaacgtaaactgataactactgcatagtacggccacatccggcagagcccgggcacctgccgaggctagccgggtcctagctccaccactgtctaaattcgttattttaaaatgggtcaaatcttatcctgaatagcaatattttagaatgatagagtaggtgacactctaaaatatattatttggcgaaggacgatctaaaacgtaaatttgctcatggattaaaaaaaaatatgattctttgctacataacaccaccagcaatattttatcatttttggctacttgtgaaaaaaaaaaagagtaatgaacagaatgcccgggaaaaaaaaaggcttatcttatgtatccagttcgcccaatatgtcaattgtcacctctcttgaatctcttagaactgtaatcataagaaagtagctgtgctaatggctatcacaacgctcgctactacagcttcagtttttccacgtggccaaaatcaatattttcatgcggacgggcggaccgcctacgcccaaaagtctgcaaaattcgtatttttgcatgtggccagcgcaaccgcatgcgggcgcttaagccaacggccggcatgcgaataggaaaaatcgtgaaaggaatagaaattatgaaaaacaaaaactactcagaaactctaaccctagaatcctatcgttgttgctgccaccgtcgtatttgtccttccgtcgtcgccgaaattgtcgtcctcctcccatagccaccgctgacaaatccgcgcgggaataggaggggacgcgtgatccgggctggggagggccgctgccaccatatccaggttggagagagcggctgccgccagatcggcgcggggagggtcaccgccgccggattcaaagggggggggggggggtgtccnncnaccntnnccacncccccgtgtaactgtcacnttgtcccatcgccgttgncttttggggagcgggacccgcccgaagtgggtcgaaccgcccgcacacggccacctctttgtctgttggggaaccgctcgagatctctgagccggccgctgcccgccaccggcccctagaaggagaggagagaaagagagaagagaggaggaggtgaaaataatattaggaggagaggaggtgaaaaaatattaaagttgctgagaggcaaaagagagaggaggggagaaaaatttgtggagagggggtattttcgcacgtggaccatttaagaagcccgcatgtgaaacgtcttaggaggcccgcatgcgaaaataggctcatttttttatgctgccattaaaaggctcatcagagaaaatatgtttttgcatattgtcctcttaatgaagccatatgcgaaaatggaggttgattttttttttgttcagatgagaccaattacgagcccgcacaacttataagggttattggatgatcaatcttctccctaggggcattctggtcattttaaaattttgctctctccaaattaactagccagaaatgataaaatattttatgcggtatatatcttgcagagaaaaccatttcgatcagaatagggagcagccatgtttcttgctgatcaagctcgacagagggtgatttgttgctattttatttaaaattttgggtacttgacgctttccccggctctaaattgtcttcgaaggctagtaacatactccctcctgtttcatcaggttacagcacgttttgactttggtcaaagtcaaattattttacgtttaattaagtttatagataaatatagtaatatttataatattaaattagtttcattaaatcataataaatttgtcttgggtttaaagtgttactacttttttctacaaacttagtcaaacttaaaatagtttgactttgactaaagtcaaaatgtcttatagcctaaaacagagggagtagtagatatcctttactctattgttgtgttaaataatatttcaactatatagaataatcatttttaatcgatatttattttctagatcgaccgtttcacaatataagactttctggtattacccacatttatatagatgttaatgaatctagacatatatatatatatatatatatatatatatatatatatatatatatatatgtctagatgaatataggcaatgctagaaagtcttacaatatgaaacggagggagtaatacgtatttgtctagatatattaatagaattcactttatgtatgcaaattatcgacgggggataccagtagaccggatatagagggtattgaggtacgctggtacaaggatctacgtaatatgacatcaagaaaatagaagacaaggattatactggttcaggctcctcggaaggtagtagccctaatccagttggtatgggattatacagtgaaagccacgaattacaaagggaatagcagaactcgatgataccgacgagatcgtagtcgagttgatccgactagatcacccggtgacttggctcctgtaggttccgacttcatgggttgtggtcgttgtgttaactctgagattccatgccttaggtcatcccggggggtcccttttatatcgcaggttagtggtctccaagtaggactcggagacatcggaccctgcacgatacagtgacgacccagtcctatacgggtaggaatctttccatcagttaacttcgtgaagaatttgcttagcgtatacagagaacgtccgtacacgtgcaggtataccatattgccgcatagcgtatatccaagggtagagggtataccttatccgtaaccctgacacaaataatatattagattttatgcatcaacctaagtaattaaaacatcaatcatggtggatataacttattagtatatgcattaattaagcttctcgtctttcttttttcttttggaatatagatggatcgacgatgtacaattcaaaacgtggtaatgtagagtacattaaaggactcgtaaaatctataacgagaggcctttgatctggtcttacgcagcgacgcctagcacggccatccgatttagtcgagaaacattagagtttagaatttgagagaagcatcagagtgttagacatccatgtctttttcccttctcataaaattgtctctcaaattacttatccgatctacaatccggttacaccattatgttcgttgcaatgtaatctttacaacaagatatcacatgatcatattacgatgaaaaattgcaaattacttttataatatatctaaattacttttagatttcactaaattacttcttagacatattaaaagtaaattcaataaagtctaaaagtaacttacatatatttataagtaacttaagaaaaaaagaaagtaactttgtcatgtcattagaagtaaatatgttgtaggtataaaaacataactctatctagaaactaaattaatcagcagaaattatggaattgactaaaaacaataataaaagtaatcaccacgtaacattatgaatcaaatctaaaagtaatttatatatatgataaaagtaacttagtatataataaaagtaatttacaaacataaatacttttttcttcataatataatcattaagatctcgttgtacagatttaattgtaacgaacacaacggtgtaatcggatcgtagataagataagtaatttaagagaaacttgttttttgaaatttagatgggttacgaggatgcaagtggcaggtgctactgcttttagtaagaagggtaacaagtggatacacactgtactacttttggtaactccctgtagccgtgtcctaaaggactagatgcatttctcatcgcctttgaggaattcaggttgcaagtaaatgcaggcactactagaaaacgcattatcgccggcagtggaaatcggttttcgcaggcagggccgacctctgcttgtaagcaaacgacggtgaagatcatcgatcttcgcaggcggggcgtccgtccgcctgcgaagattattttcacaggtggacgttagctagattgatccgcctgcgaaaatatgtagaagccgactgcaaaaaaaaaacatccgcctatgaagataggtagaaaattttgaaatttgatacaataataatttgcccataaattacttttttattatttaatagaaattcttgcaggaagattattatatacatatattggaaagattatcaagtatttggtactgagaaatctagatatattgcataactgaaaagtgttgccaaaattatatatattacaatatttttttacattgtcacttcaaatacaccatctagttacattatggcatagtagtgctccactctcgaaatttcttgaattcgtcacttgtagatagggcaccctctgggtcgaaaaactctcctttcacatgacaacactcatggtggatgaattggcacagatcgcgctggacattcgtgatgcttgtattgtcaaagctcgttcgacgttctattcttagcaactgcatgcattgaagataaacaatatattagtatcataaatatgtgaagctgtctaatgcatagtatagagacttacatcctccgcgttaaccttgtacctcccattaaccctgaggaattcgtacgcgtaatacccgcaaaagacagttcctataggttgcttgtgacacttcaggacatatcataggaaaaagagttaaattttgcaattagtgaaacaattggaatacattaagtgagtgaagtattaccggccaatatgtatgtactagcagcttctcccttgttcgggtctgttcttcacccttgaacttgtagtagttgtacacactgtatggatgtcgtaccgtttcgcattaaggaggatatttaattataaaacattcatataaaaatgtaagagtcaatcacttactactgtaagattgttagaaattctttgtatgactggtgtatgtaatcgagagggtccaagactaccacggttccatccttctggtggatgattaaatagatataatgatcgctacatattaaaaaacaacttagttagttagtaccggctaaaataagacacatgtgtagaagttaaatgtaccggacttacttaaaattataagcggccatgacgactctcttattttgaaagtgcaagaaggctcgtccaatatactatgcgacaataatcactttctccttgtgcaagcccttcttgtattcagttatctcttgtggagtcttgcccttcagctgatctgaccctggtgctagcctcacggtatgttgtgtttgacagatccgagttggatccaagaagctgataggtttatttttcttcttagcatccatgtattgcatcctacagaagaagtttgttagagtaagttcaatagtatagccaactactagcttcaattcatctatagccaatctaatagctcattcatacaatagttacatactacactattaatacctggtcccacctgtcattcacacactgtgtcttggagtccgtgttacagctggctacaaatctgtagcccgctgcccttctctctcctcgtttatcttcttaaaatttgtttacagctggcttatagcctgctattgtacctactcttagtaataattacatggatttgtattgtacatatttttcatgtaattaattaaaattcatactcacatgcacctaacagcaacatagttgacgttcatcttgtcccgatgatatatggcatggagatcttcgaaatctagccatacgtaacattcgccgccgaaacaatctgccggtgatcgagctgttatattgcccaagcctttcttgctggcatccatgtagaaggtatgtaaccttctcatctcctatggtccttcgtaaagtgcccaatccggcaagagtgctttcccattttcgtatttttccgagcaatcatcagttggcaagtatggcctggctagtgcagcagccttctgggggtcatcatctctgagtttggcacgttccttaccccctctgaagatggttaccatgaacttctcattgttctcatctttagacttggagtcgtggctcataagcactttaggcaccttagaattgtcagtggccttctcagggaccggggtttcttgcacctcggggtctttcgcaggagaagggtcttcaaatatttctggctctgtaccgtcccattccaatcgtactacttcttctatatatgtcccgactgatgccacaatttgcacctctggttctgccactgtaatctccattgggacaacggcactacaatctccatgggcacctccggcactgcaatctccggtggcacttccggcactggattttccttatgcatctcgggttcctccgccttacctgtcacctgcctcttcggaggaggtctcggaggtttttccacccctagttttggcaccatgggttttcgcgtggcattggtgcacaatccaaaggatatgtcattctagtgctagagaattacaagttctgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaatcttctcttactgaagggggaaaagattgagcaagaatgagtacaaccacagtactcagcaagccacaccggcagatgcatgattaatgcaagggggtacaaggggtaataatataggggttaagctttgcagtaaacagcatttaaaagttacttagttgcccaaagccattttataaagacgatcctagagttacacagtattattaatcaaggccgtgaaccctcacgaacctgccttaacctaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtagccacgtgccacataccaccacggtatacagacggaagacgtgacatagtttccaacccatcctagccatagacaagagtaccgacccaatccccctacggccggaacctccgggacaggcaggcgggactgagccccctagcagcagggcaccaaccctgtgccacgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcctgagcttaatccttatagtggccggggtgctacttcccacaactggcatgcacccaaaccccaccgaaaacaggttttaggggttttgaaagaggaagagaggtgtatgtccaattccaccatcatccaacaattccatagtgtccaggtgatatgaaaattcccaaagtctaaagttataaaaccacctaatgttgcctagttaatcagcgaagcatctacctaaattcatacccagcgggcgcgggcggctgacagccgggccccacctggcagccgcggggcgcgcccgaaggcggcctcgccggtacggccgacgggaggcggctcgctcgcgcccctatggtcgccggcggcgaccaccggcacgacggagcagcggccgagagaggggagggaagggggaaaggaggcggcggtcctcggctcaccccgggtcgacggcgacgacggaaacggcggccgaagcgggagaaggcggcggcgcggttcgggtggacggagacggcggcgctccggcggtcggcgggcgaaacggaggagcggacgaggtcgacgaggacgcggcgaagccgatggaggcgatgccgaagcgggagaaggcggcggcgcggttcgggtggacggagacggcggcgctccggcggtcggcgggcgaaacggaggagcggacgaggtcgacgaggacgcggcgaagccgatggaggcgatgccgaagcgggagaggtccggggcgacgacggcggcgaaccggaactcggcggcaacggcggagagagaggacgacggcgcgggcacgattccgacggggagagagggcggcgagcggcggaaacggaggaggggggcgcggggaacgattaaatagagcggggaggggaaagaggcggcccgaaggggaagaaaaccggcgcggcgatctcggctccatcaatggcgccggcgaggattgcgggagtaaatccgaacgaatccgagggagagagagcgggaaaagtggggggaaatggcgagggaatcacggggagtaattccccccacttcaatgcgcgcggggacggcgggatgcggcggattcgtcggcggcggcggcactagggcacgggcgaggcggcgggagcggccggaggacagggatgacaggtgggccccacccgtcagcgagggtggcgggcgggcccgcctgtcagcggcgcgcgcgcgggggaaggccggatgggccgcgggggagaggagagagagggagggagctgggccgagccggcccaagaggggaaggggggaaaacagactttttagggtttttctttttataaaacctttttaactttgtttatttcttaataattattatttgtgctctgaaaattccactaaaatttgagggctgcttttagaccaaggagaatttaacaaaaattctccgggccacatttgaatttttcttgtacgtattttaatgtttgccaatttcttttcgaattttaattaattctagtattccttttagaaaatgatttttaattcgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaaaacttctccactctggactgcttggctcgatctcctgttgcaggtggaatcttcttttcacctgactcgaaccagggtgcacctttcagctgacgcagactaggttgcggtagtttaatgatgcttccgttccagaacttctcacgattcatattttcggcgtcaacctcacacaagttatcaacttcatgtcatgtgtcgtaacctgcttgtcattactaggataccatgcttgtcatcatgagaataccatgcttgccgtttccttccagcttaccaccatatgctttagactatgatatcccgcttactaaggataccatgattgacaacttgccattaactatctcatattagctttcctggtctccggtgctaggtacttctgcgattcgatgcaagggtcaaccactctaactataagttctgcttcccaagagaaccaatttatcccacttgacatgctttgccgtcttcccgaatgactttgctgctggacttgttattgtctgatcgtgatcctgccagatctgaagcttcgttgttaggggtgattttaatctgacctctgtagactatcttcgaacatatcacttggttcataactgggaatagctcccacgaacaagcagctcggattcactttctttacattcagtttacttcccattattatcttcaggttgtcctcagttagcattcaacgtattcctttacacctttaaccttgatgtgttctttcccattggatcatctcccaagacatggcattacctggtaaccggtgcttgcacttttcaccccgtgtagcatctgataccgagttgaagatttcactccttgccttcatagaaacactcttacctaggtcatcttgcttacttaatgacaaggtgactgttgcggggcaattactatcaggggtcttccttgagcgatgcagagcatgtttttgtttatcaatcacctttcagcctacttctttcatgctagagaacatcgttgccaatctcttttatcaatcctctttcggcttatctctaacaggtggtattctttaatggggattgcggacgcttctggggacgatgaggtcctttggcttgctgcctttcagtgaaaccttgatgcggttcgtcaaaaagctgtactgactaccttcagggaaatacattgcttgctatctgtatccatgccactagggtttaattgccgatgatcatctttagtgcttcctcgggatggggagcatccaaattgttcttctgccatatcacctttgacccttttctgatacctgatagactaattaccatccatcgactactatgttctcaaatattgatgtctcctggatcttcttaaccgtttgcaggtatatccgaacttatcaatgtagaggcatggctggtacccttatgggtttcatccaacaatccttatattgatctgtaaaggcgtatccaaactcttatccccaactactgtctcattggctttttaacccaacacagtttaattggttttcttttccatcaacaggttggttattaactcgaggttagaatatagttcctctgacacgagaccctaggtctcctttgtcaataaacaattatacacatgatcacatatccgcatcttccaaaagaatcctcttagaacttgtctgtattacacattcctcccttattacacgaatacaaggcactgccttaaacaaaaagggaagatgcttatcatcggtacattgtatcctcaacatgaatcatccataaacatagcaagctcactgtttacagacatgaatatatttatttattacatgattgctgcaaactttcgattacgcaatgataagtagcgaactgaaaaccacaaacatggctgctcattttgactctggagagatatagctggcattgttctagtgactgcatccttgattggttctgtgatgatgtgataggactgcataatgctatcattcacaggagaagcttccgtctgattgctgtttgaagcggaggacggtcttctgcttggtatcgccctccggaggttgattgccctttgctcggcctggagtaggtcggggagagaaacaacttcttccatcgacgacaattctctgctgaggctgtcggcgcagagaatggttggtgctgaaggtattattgctatgattgattgcagagtcaggtgcagcaggaggagcattggtgctatggatgatatcgtcgatgttgctgttggagctcactagctgatgagacaatcgtagggtggttcgttggatttctgcggtcttggtcaacaacacactaagttggcaatccttgggcacatggtttgtaccttcgcacagaaaacatgtgatcttgcgggtgggacactcccctggtgggtggtcttcttcacaatgagagcagagtgtgagacacatgctagcaacgtgtccaatttctccacaacgggtgcatgcctttgatccgaagaagtcacatctgaaactcttaatccaaacaaatgtctctttggttgaccacttgattttcttcgccctcaatcactaggttattcgattcataacagattatgggtttacggaaatgagaccctaggtctccctaatcagcaacaaaatgtacacaactcacagcacttgcaatcttaacatggatccttcataaacttatcaaactccttcataatctcatgtttctctgttataacatgattgacgggaacaacaataaaacaaaagtatttgaacactgatataagagtattatgtttgcttctgactagcactaggcttagcaggtactgcatttgctccagtgaccacttggcgattggcatgtctgcttccttaacaggtgctaccgtttgtaacagacaataactttcttacgctcgggttcttcatcttgtacttgattttttttttggctgctgtgctggaacatccaaaggtacaatgccgctgtcttgtcaactggtggctggggctgaaattgagcattgacaccttgtggtaatgtactcgctggagttggagctgttgcaacgggggctataggactgcttcgggatgcatggatgacaattcgctgaggagcaagcttctgattgcagggagttgcgtggactgacgtgccggcagctatgtttctcggttttggccacttgtcggcgaaatgacccattccttgacaattgaagcaacagatatcttctcggactcggcattttctttcctcattttgattcctctgtcctggcactgaagttaggctgaaactgtaatcttggcgaggatttgtgttgccttgatgctgctctccgttggaactggcgggttggctggccatcctcttcgtcagcagaaaactgaattgacaatcttttggtacatgatcagttccttgacaaaagaaacaagtgatcctgctcattggacacctgtcgggtggatggtcttcctcacaatgaacgcatgtagtggcacacgagctggcaacatgaccgatttctccacaacgagagcatgccttacgttccattttgttctggttgaaaccttggggagacttctgatcttcatcatctgatgagacttgatctgaatcttcactatcagacactctacctccattagctaaaagatgctctgtcaactgtggtgcaccccggaaggtatttcttctctgacgttttgtcattcctggtggaggccattctgtgctggtaatggtcatcttacgtacttcttcttcagttcgcatcggtgcttttctcctctgattcttactcttcttgcctttggcttgcttagtacgtgaccccacgtggtacgaagggctaggaggaaagcaattcccgggattcaatggattctcttcattgggctctctgctttgcacactaggctgcaagcttgacttggtgcgaagaggctggtttagcgatgtctgcactgttaaaccaagggaaggagcttctttggcatatacccatggacaattcagggcatagtgtccttgctctctacaatcgtgacaaaaggggacatcctcttctggtattggaagctcatcgacctgggtggcaaatgctcgatcaaacacatactgattttggtcttgacttccaaccaatggtagctgtggactaagcagcatgcttggaatggaccaagggtgtgcccttgttaactctcttgaggctagtggtggattgagttgaaaacttgagttactggaggcatacccgctgacattctttcctttttctctgttaaacatctgttacagggattgaggtgagagaggaaacaagccaggaaagaatagaccagaactagggacaggaccttaaaggaactaactcttcttgatgatgtgttgtttgtttcacttattctgcaagttgattaagcaaacaacctagcatggttacatcacaacccaccgatgcaaaccacgcgctacacacacaagcaaggaacacacgactaacaacactaccctatagggtggcttaggttctgcgacgggttctccaagattttcactgcttctacacagctggcttcactgcttcctccacttcgctagcggaccctgcggtcttccggagcttcggcagacaattgacgacatcttcttcttcgcaaagctgaccatctagtactagttgaaatccgaagaaggaagaagggagtaaaccttttgcaaatagcattagggggaggagaaaaaggaactttcgcaaatagttttatttataaaatatgtccttaggttttatcctcttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggcttcatcttcacaggcgctcaactggggtataagccaagactccacctaagacttcttctccaaatcttttcttactgaagggg

SEQ ID NO: 75530 - DNA, 4554 bp, Oryza sativa
tgatcaaactcttgttagatgcctggcctgcccattggcttgtgcataatatggcgaataattcaataacttaattacccatgctatgggcaaaccgaacaaactcataggacacaaagatcgagccttggttcgttgtaatagttgaggaataccaaagcgattaattatatgcttttgaacaaattggatagcatccccagaatcaactttcttcaaaggaatcgcctctacccacttattaaattaatcggttgccaccaatataaacttgtgtcctttgctcgatggtggattaatcataccgatcatatcaattccccaacctctgaatgccatggcttgatgatagggttcatagccgatgctggtgccctttgaattgctccaaacttttgacaatcttgacatcccttgtaatatttgaaacaatcctcgaacatcgtcggccaaaaataccctgcacgccgaagcaaccacttcatcttatgagccgattgatgagttccacaaattccttcatgtacctcgccgattgcaaccttagcttgatcggcactcaaacatttaagcaataccccatcaatcgtccgataataaagctcatcatccaacaaggtatacttcaaagccttatagcgcaatttctgagaagccgattgagatggattctgcaaataatgatgcacatcataccttccaatcatcggctgttaatgtggcaatttctactttgacatccttgttcatcggcttatatcccgatgccccttgggccaaatcattagcctcaacattctgttctcgagatacatgctttaaagtcaccagccgaaatcctttcattaactctcggcacttttcattgaaaccattaatgtatcatttttgcactcgtattctcccgccaattgactgatcgctagcaaagaatcacccataatctcaacccttcgagaaccgcttcatactcagcctgattgttggtcgcatagggtgtaatagtgtaagcaaactcgaaacttgccccctaaggggaaattataaccccgccgataccacaatcatgagtgcatactgacccatcgaaaaacaaagtgcagggcacaatctcaaccgagccgatggagtcatcacgatgatcaacaataaaatatgctatagcctgccccttgatcgccttcggtgactcataccaaagatcaaattccgttaaagaaaatattcactttccaacccttcctttcaaaatcggagccgataacatgtatttaaccacatcggccttgcatattacagggcattcattggacaatagataatgtcttaacctcgtataggaaaaatacaagcacaagcacaacttctccacaggagaatatcttgtttccgcatccaagagccgacgacttaaatagaacaccactctttctttccccttgagctcttgaatcaagaccgagccgattgacttctcaccggccgatagatatagtcaaaactggaggagagctaagatattctttaatactatccaaagccttctgctgctctgccccccaagtaaattttagatcggctttcaaccgcaacaatggtgtaaaaggttctaatcttccaaacaaattagagataaaccttctaacaaaatttatcttgccgatcatctcctgtaattctgtcttgtcttccggaggttgaatcttcttaatcgcattaatgctcctctgagttatttcaatccccctctcatgaacaagaaatcccaaaaactggccaaccgatacgccaaaagcacactttgtcggattcatcttcaggccatacttcctaatcctctcaaaaaccttcatcaaatcggctatgtggtcctctattttcatggacttaacaaccacatcatcaatatagacttcaaccaaccagccgattagatcatggtatatataattcatagcccgttgatatgtagctccagcacttttcaggccgaaagtcattacaacccactcaaacaagccgattgcaccaggacacctgaaagctgtcttatgaatatcttcttcggccataaagatctgattgtagcctgcattaccatccataaaatttaatatcttgtgccctgaagcagcatcaaccaactgatcggctactggcattggatactcatcctttggggtagctttgttcaagtcccggaaatcaatgcacacactgactttgccgttcttcttgataattggaactatattggaaacccactcagcatatcagcagggacgaataaaaccagcatcatataaacgtttaacctcagccttaacaggttcgagcatattggctttgcatcttctcggtggctgcaggtacggtctaaccccctgtttgataggtagccgatgttcaacaattgatcagctgagtcctggcatctcataatactccgaagcaaaacaatctctatattctttcaagagctctatcaacttggttctaaatttcggagataaattcttactgataaatgttggccttggcctatcacccggacttatatcaacttcttctaaatcatcggccgacatgaaaccctgtccttgcttgtcatcgagatcatctactgtgtccttggtgtagacgtttgaaccctccacgacgccctcaaaataacaacttgggttctccatctttaattggctgtatatcacaatcggacacctttagaaaatctcctccccaaacctttctagacaagcaatcaataccgtccatctcctaaagagctaaatcggcactggcaacgttaactgacctgtcggctggcacgatctcaatcttgtcgccttgccattgaatcaagcattgatgcatggttgaaagaatataacaattagcatgaatcaaactccttccaagcaacaagttgtaggagcccttcccatcgatgacaaaaaatgttgtagggacggttttgctgccgactgtcagctacacattcaaaactccttttgtttccgatggattgccaccaaagtctttgagaaccatattcatcttgatgagatcttcagtatttctgcctagcttactgaatgtagcatatggcatcaaattcacagcagctccaccatcaaccatcatcttggacatcggcttcccattgacatagccgttattaatgtataatggcataagatgccgattctctgtcccttccggcttctcaaaaactgcttgttctggtgacaaccaacctagccgaagcttcctcaacttcatcaacaccggcttgtttggctccgaattccgcaggtaacgtgaaaaccatgttaaccgatgcagtcacaacactcttccccttagccaatctttttgcttcattggctttgggttcatcggctacagcagctagattcttaacacgccactcctacctcggctttgtcttctgcagccgatggttgatctcttgctcaacctcctgaaagtgctccctgttcctcaacctttgaacccttctcttctgattctttgtaaaaatactagaaggacaccattgagttttcctgccctcatcgtcctcttggtcacgatcttggttcactgggcccaatctttgatgaacaggaacccttgtttgcctcagccgattgcttctattgtaagattggctcgaactttctacaatattgctgccccaggacaatcttcgatagatggcagcctcataccttcattccagcaaaatctgaaaaattcacaactccagtgggggtcaaagctatcatcatcttcataaaatttctcttcatgccgatcatgtctcttctgatatttgttgataatccttgcagaattgagttgcttggaccgataatccttcttatcggctgtcttcccagttgtatgaaccatgtttacttgaaaaggattacgctcaattttcatcagcctcttggagttatcaaacttgatcttaccatcttgtatagccaactagatttgttgtcagaacagcttgcactcattagtagtatgagatccagtattatgccatttgcagtatttccttttgcctagttcctcagccgatggaataacatgatttgcaggcaattgaatttgtttctcccgaagtagcatatcaaagattttatctgccttggtgatatcaaaatcatatttctcctccttggaagatggcttcacccacagacatgtagtaaccttttgtttctgatccattcggctgctgctacttcggactcatcttcataatcggaatcagaagcataattgtaagaataaacactattcatctttttgacaatcttcttagcttcctaaaaccgttgttcatgcactccaactttctgggccagatgagccaagctttcgaagtcctgagccgaaaaattttctctgatcggatgcaataaaccctggaaagccagatcggctaattgagaatctgaaaaggacaaactatagcatctgttcctcatatctctgaatctctgaatatagtcttgaatagattcatcatgcttc

SEQ ID NO: 75531 - DNA, 2200 bp, Oryza sativa
ccttcttttgttccggtgttagtttgtctatagtgacagaaacgatgtttccctcatggacttcaaacccactaggctttgggatattagtcttggaagggacctccgacttgccacccgaagacggtgacggtggtggtttttcagccatgagagaatgttgttgcaactctaacttctaatcagtcccactgggcgtgccaaaagcgtgttaatgtaaaaacacgaggcctgggagatctacttaactccagtgcaggtccaaaagcttgcctttaggtgtatgagcgtgccagttgatttgatcctgcaatcaacaagaaataaagacaaagaaaccgcggttaaatccataaacgatagccgatcggctagttgccgatgacgtatcatttatctttgagccgatgtcatgtgtagatcgatcggcagtcatgaatacgtaagaaagaactaaatctactcaatcggctgtagatattaacaatatataatccttatgtcgatatatacttaaatcaagtgattgggatagatcgatcgccatgccgagacagtataaatcacttaggtcaaaatatatactaataacaacactatatatgttcatagcatagcagatcagatagatctagtatgtatcggctaatactctgataccaatctatattaagatattagagcaagcagaatataccaaacgaaagcctaatatacttaaatgcaacacgatcttaacataaagggcagatttaacatgtcaatcgataatataaggaaaaagtagttaaatcaggtaagatcggctgaaaccctgatactaccctaatcggcaaccaaaagcaggctagagattgagattctaatcacgactcataagatcaaactcaactgatgcagctataagtatgaaaagaagaacaatatctagacaatcaagccgttggatgtttcatagagtggtagatatcctatataatctaagtcaacatcgatatttaacctaatcggatgccttctagtaactaacagccgattggcggttagataacgatattgccagagattatataagatatatgataactcgacaaattacataaacaagattagagtgacatcaagatggaagcactaatcccgaaaacgcaagccgccataacaagttttacctctagttgaagatcgaaacagatgcagctcaacccgaaagcaagaacttgtcgaaacaaaacaaaagtaagagggtggcgatgcgctgagattacatggggctcggggtctatttatacccgagattagaaaatatgtccatgtcggacacgactcttatctctaataaactctaagataccataagtctttgcggcagacttttgcccaaacatatctctaaggaaatacatgaaatatcctaattaatagatacaattgacttctcaggactatatccatacgtggcaatcctcatgaagcacatcaactcaacccgacaacgtatgccgtgtcatattgtcagattcggttcaatcggctaaccttgtccaactcagactctgccgatcctggttgcagccgattcggacttcagccgatcccttctctgtttccggagcgatctccatctcgaattcctctttgatcccatcttcatctccgatactttgattaccaaatttggtcgttaacagtaatgcatcacaatctccggtcagcaacaacaacaacaatgcatcacagatcaacaacaacaaccacaagtcttgggtcaacaacgatccaatccatcacaaatcaaagatcaacagaagcaagatgcacgtactcactccgccgtccttccttggtcccttggtcacacgccatcgtcgtcgccgccgccgccgccaccaccgtacgtcgccgtcaacccaccaccccaaccagatttgggcgccattggtgggaggccgacagagaaggagaggaggagggagacaggatctgcgccccgtctcccgcgaggaggccgccaaccaccttccttggccaccgctgccaccgcacatcgccgccaccaacccaccaccctgaccaccccctccccagatctggctgcttccgatgaggccgacggagagggagaggaagaggggaccggatctgcgcctccccattcgccatggggaggcccccggtcaccccggccgctacttgccgg

SEQ ID NO: 75532 - DNA, 13270 bp, Oryza sativa
ctttttagggtttttgtttttataaaccctttttaactttgtttatttcttaataattattatttgtgctctgaaaattccactaaaatttgagggctccttttagaccaaggagaatttaacaaaaattctccgggccacatttgaatttttcttgtacgtattttaatgtttgccaatttcttttcgaattttaattaattctagtattccttttagaaaatgatttttaattcgggatgaatttatcaggacgtgacaagttcgaccatatccccaagtacggatacaccatctggagtagggaagtctatgtcgtaggactcaaacccttcgtggaccaattgcggctgcactttggcatatgcatcgggtatgaactctttattatatgttctcccagggatagcaatggttgtagcggcctcaagagttttcccagagcgtcaaatgagaacgtgcaatctgcagggtgtattctccttgaggtcatcgaaggggtaatctggctcaggttgtttggttgcgggggcaggcaaaagcatgtgcttgacgcagaaattcatcatttgcctttcaaaatctgcagccccttcgtctcttagtttatccttgtacgcatcacgcttcttgtggggggtcatgtttgaacccttccttccaactaagcttggacgatgttggtatttcttaacgacattactagaaatataatctccagcaatggtgcagaaatacttctggtatactatggttatagacttcattcgcaagcgcacggatataccattgtagcatttcacccgagagtattccaagggtatcgtatttattttatcccgtgggaagatcatgtagagtgaacttaactaataatttatatattacttgtgacaatcatattctaagcaggggttaagataatccaagggtagagtgacacacaagcattactactaatcctcataataaataatctaagctaggtggaaagaaaagagaaagagaatctattcctatacttctaatatacataacatacatacattctagttaactgatatactagctaataccctctatccgatgccctcctggaacttcgagaagccacccctgactgccgagttccttacgacccccgtcatgaccatccaaccggggctaaatacggaggagtaccctccccaggaaattaacttaggattatatataggcgcggacgaatacccgtactgagctatcaccatcagcggcccacctctcatccgcaatatataaccccaaataaagatatcccgtaatctagacaacacgtctaaactaccagatactactataatatcatcgtcttgacatagagcaattgcataagcaaacactatacccgcaccaaagcatctcccagataagctagcagtatattcagtataacatgaacataatataaagtagatactaatgtactcggaaagtatttcaataccataaatgtatatagaagagtattctaataaaagtgcaaagcttacaaaagaggaaaggaaagctactagagccatacccgaactcttccgaaggcttccggactcctgattacttttctaattatattccaccagctagatactacaaaactaaacttgagaggaatgagagagctcttgcttgaggtgtgtgttgaagtgaagagagtgagctccttatatagaggtaggtatgacggttgtggaaggggaattgtccgaaataccctccaaccgtcattggggtgcaatcttgtacgtccatgccaaaccctagcctcaacggtggagatgggggttcggccgaaccatgggctggcccaaaccagcccatcttcggctggcgacttcctctattgctccactccacagacttgtgaattttggcccaatccatcgtgtcaattctgagttcttggcccattcatgcataagtctggttctcgacatcgtcgattgatttatcgtttgtgttgatgttgattctccaccactttattgtcattctctgcaaaaggttagtaaacctaatactagtggaatattattattctaacaaacatatgcattgcaagcatcactatttctcctctattttggtaatattgatggtcgaaactgatcgataacgaccgtcaacagacgacacacctcgaaccctaccctctatgctcaggagtacctagtgccgtacttagcacatctttctccctcttaggcttgaaagatcctttcttctgtgcactggataaattctctcttttatcggcaacgccctgcagcttcggatcttcaaacgatactttgcctttatccgtgatcttaggagttccagctcttacccagttcctagatctctatgaccattcctccattggtaccggaaggcccgccttccttatttcgtcctcctcttttgtccactgtgtcagggttatggatatcacatacctaatagtagttgactaaatctcggcaggacttaccacataccatgtcttatacggaaactaacctcggatatggatggagttccagataaggaaagacaaccagagttccacatggaaatgacaaggactacttggattgtatccatattagtttccctagttctacttagaaaaggggacacctatgggtataaatacaaggcccctaggaggagaggagagacaatcaacatacacggacatacacggaataatagatcaagatacgagatcaacatacaaggtaacatatgccaagacaagccgccggatatcgacttcagagataggtatggctagtcccctacggtgtctccggatactgtcaggagagacatagcgctgtctctgatctcgctgggcacggattcgaggaggaagactaccctgttgtcaactatgagtcagatcttcagaccgccatgtcgacaacagttagataggctaccccaaatattgtactggtgtgattatggcgaataagagcaacaaccggcttcggccaacaggatgtagggctattacctgacaatccaggggcccgaacctgtataaaaatccttgtctccatctcttttacctcagtctcgcttatatcctagtaccaacgatcctcatactatgtaaataccggaatcgcgacatcaaacgtcgacagtggcgcgccaggtaggggatcttttggtgcttcaaggtttcgacgagatgggtttaagagatggattctccgacaacatactactcgataacttcggctatggaggatctaacctgaccggagtccgtgccccgacatgatcgggaccatcatcgtcaacaacttggtctatcgagatcattcaagcctcaagctccgcggcgtaccaaaagatgtcagatcacatgatatcgaacgagtacgcagcaaggtaattaggagattgattttttaaattaatctactaattttgtacatattctctgctatatgtcttgccttatagaaaatatttttaggaacaattgagcactcgagtaggttgtggtcgagtacaccccattatcgagaacgatctcgacaaatgcagagtcgtcgcgcccaacctgccaacgaagaccgacgacctatctcatagcaccggccatggttggactactcgagaaaaggttgttaacggataattcctcgcgaacgtcgttggcttgatcacccgacatgattgcaaacggacatccggatatgctataagttgggtatgtgagtcatgctggccacatgagatgcacatgtaataaaccaactctagcacctccattggtgttcgagagataattctactcgctggttcttgaaccagtaaaccgtagcaatctctcgcaccgcaacttccattggtgttcgagagataattctactcgctggttctcgaaccagtaaaccgtagcaatctcacgcaccgcaacctccattggtgttcgagagataattctactcgctcgctggttctcgaaccagtaaaccgtagcaatctctcgcaccgcaacttccattggtgttcgagagataatcctacgagctggttctcgaaccagtaaatcatagcaatctctcgcaccacaacatccattagtattcgagagattattctacccgctggttctcgaactagtaaatcgtagcaatctctcgcaccgcaatttccattggcgttcgagagacaattctactcgctggttcttgaaccagtaaatcgtagcgatctctcgcgccttaacttctgatggtcaaggtaccactacggcaatagcgtagcggtcctcgcaccacgacttcagacgacttcagatggtggaggaacagctatgattggtcttcgaccggcagcgtagcggtcctcgtaccacgactccaaatggtcgagagacacctactcactggttctcaaccagtcaatcgtagcgatctctcgtacatttacttcaagtggtcgagttacgactactacctggtcttcgaccagagatgtagcgattctcccactatttccactttaagtgatcgagttacgactactacctggtcctcgaccagcggtgtagcgattctcccactacttccactttaggtggtcgagttaaggctacacttggttctccaccagcggtgtagcgattctcccactagttccacttcaagtggtcgagttatgactaccatccggtcctcaaccagtggtgtagctattctcccactacctttactttaagtggtcgagttggggctacaactggttttcgaccagcggtgtagcgatcctcccattatgtctactccaaaaaagttgatatcaggtacacaatatcgccaagtgttttacccagagatcccttaccacggcgacacctagagttgaaaccaatcctactgtccctttacgccgttctgacaaggcctctaaggaacctaagggaacttcgactggggacgcccagagtggataaggccttgtcggatcatgtagagacaaacgaccatgtaagacctggtcatgtaagagttctcgccgtgcgtattaaccaagccatgtaatccgaaattgagttttccaactagacggctgggggctagggtcagtgcctttttgaaccaaggcaggtcaagggtccaagagccttatcctccgagaacaattctccgacgacaaggctgggagctaggaagagtgtatgactcaacaaactgactgatcaaagtcggtaaaagagaaaacgctcgtacacaaaacattggtctgtaaatttaattcatttttagttttccaaacatattataacatgtcaccctttgagcattcgctcgggggctatttctatttaatattcttttctaagtattgatttccggaaaattctattcgacattgttgaagactcgatgtctctatggttctacaccacaatcgactaaggcgagtacgaaaaatgttgacaagcctccgtcgcagattctgcgccttctccatcactcgagaacggttagtggatatcgacaaggaatacggaatgaagaaatggtgtactcgccgagacaaagtttcttggtttcaatccaaattctctattacagtaagacgggagacttagtcgtatgctctgtgctttcttggttaacgtcggagattgactcagacaaaccctataggtgcccgcacgaggctgataagggaagtctaatgttatctctgaactcaccgagaacggtcacgtgagctcgataacagttactccatggtctgtagttgagaatatgaatttgttcatttgcattgaagtcgggggctactgtcagggttatggataccacatacctaatagtagttgactaaatctcagcaggacccaccacataccatgtcttatacagaaactgacttcggatatggatggagttccggataaggaaagacaaccagagttctacatgtaaacgacaaggactactcagattgtatccatattggtttccctagttctacttagacaaagggacaactatgggtataaatacaatgtcccctaggaggagagggaagacaatcaacatacacggacatacacggaacaatagatcaagacacgagatcaacatacaagccaacatacgccaagacaagccgccggatatcgacttcagagataggcatggctagtcccctacggtgtctccggatactgtcaggagagacatagcgctatctctgatctcgctaggcacggattcgaggagaaagagtaccctgttgtcgactacaagtcggaccttctgaccgccatgtcgacaacagttagataggctaccccaaatattgtactggtgtgattatggtgaataagagcaacaaccggcttcagccaacaggatatagggctattacctgacaattcaggggcctgaacctgtatgaaaatccctgtatccatctcttttacctcagtctcgcatatatcctagtatcaacgaacccatactatacaaataccggaatcgcgacatcaaacgtcgacacactgctcgaccattggtgcgtatcccgcgcagcctaagcagtgaggaaatctgttcttcttagccaactctgaaaactttttgctcctttcaattccttccggggagttcttcagcgtcacagagtcgacccactactttggggttatgttggcatacgtcgaaaactgtgtatggcccgtcttcacgaatttcttgttcaaggtatttttccaaccacgccaggagttgtccattgtttgcagtgcacaattcctcactgctgcctctgatccatccgggaactggaagattttcttcaactctttctataggacttccttatccccatccgatatatgaccccagtccttgaccgtgatgggatcttttcccttactattatgccacaccgtgaactaaatttcgcacgtgcattcttaggggcgagcggctctccttttggcccaacattggtaacaacatgaaacccttcgtcctttctatccacgcttatcttgccctttttttcttcgcctttgctgccggttcgcttttctttgagcaggtggtcttagctgggacctcgtcgtctttcgacttatcttttttctttggctgccgttttgatcgccgtggcgccctttcctacgagaaggtatatatcaaagtttcgaattagctcgggctaatagttatcagtcgaacagtttacatattaagtgtacttaccccttctttagggggaatgtagtccttgtcgcctttttcaccctcgccctttttccttctcttcgggcttggacaaggatcacttggcgacgagtactcatcatcctcgtcagctatgtcgctgtcggaactatctgtcggctggaccgttggttccggagcaaccacaataggaagggacggctcttcctcccctaaacccttctcttcagtccctttagtaccattggccatcgtttcgtacttctaacataaaaaacaaactgtatattaacaatatgtcatatgaacaaatttaaattctctgagattgccatatattaacactctacggaaatagtttaaaaaattgataagtagtgtactatgacataacttatcatatgttatattaaaaacttgtgtacatagttgcaaaatgtaataataaaaacttgtgtacataattgcaaaatgttataaattagtacaaactaatttgctaaattagtacaaacaaatttgttcaaaatttgatatgttattattaagtagtgcactaattcacaattacatttcatcgacatgttgtttaaaaagaaattaaaaaggcgaccatatcctccacatgttataaaaaaaaaattgaacatatcctcccacatgttattaaaaaaaattgacaaattcacatatcctgcaaaattgaacataccctcccaatttcattcacatatcacccacattcccaaattcacattgacaatcaacatataacccctcattcacatatcacccacccctcgttcccattcacacccacatgcacacacacatatatagcccctcacagccacatgcacacacatataaaaagaaacacccacatgcacacacgtccgtggacaatgaacggccgacgacgaggttcggtcgtggacgacgacggaagggccgacgacgaggttcggccgtggacgccgactggccgaagacgtcgttcggctgaggatgacttcgctcgtggacgacgaccggccgaagaagccgttcggccgagatcgcgactgcgagagagagagagagagagaggtggcgccggcagtggtggagcggctggcggcgaagtgcgggcggcggtggagccggcccccgcgggggtggatctcgcgcgtggtgagcggccggcggtggagcggtggcgcggagctcgacagccgacggggtggagctcgacagccggcggtggagctcggcggccggcgcggagctcgactgtcagcggcaaggacctccacggttggcggcggcggacgacgacggtctgcggcggcggaggatggcggtcgccggcagtggatgacgacggtctgagggcgatggttgcaggcaggcggcggagaaaaaatttggcaccctgatggcgccaaaatttctagggttcccgcctggacatagaaattttggcgccgcgggcttgcccttatatagggaaacgatcttcgcgggcggacggtccgcctgcgatgatgtaaaccctactcggcacaataatctttgcaggcgcaccgcccgcctgcgaagattgttacagagctgactatatttatttgaaaatgttttctaatttatttttgtaatttgaaaatgtctacaatagttgtaataaaaatggtaattgtacatacaagtatacaaaccttaatattagtactattcaaatgtaaatcttacttaaatgtttgaaacattaatattactacttttaattttttaaatagttttcaaacaatggtaagtgcacataaaaaattgctacaaaattttgaaacctcttttaaataaacttttaaaatataaaaaaactgtaaattttaccctacaaatggtaattgtacataaaaattagtacaaactaatatgcaaaatgttaagtacaattgttcgtcaatttgcaatatgagcacacatatccccttacataccatcattacataactaagaacatcttagatgcttacgtgccactcaacaatcattaccctttaacatttttgcccacaccgtccgtgcgcatgtaaggtttcatggtcttctgagtacatacctcaacatgcttgatcttttgtacaaactgattacaaagtggcatactatcgtattaattgtaattttcgatatcttcgaccccatccactcccaatatcttttgttttcctggtagcactatcgttttcttcaaatttgaagggtctttctcataaaacacttgtgccatgcgattggtgagtacccaagggtcatccttgtgacccacactcgtaaggtcaacaacagtaagaccaaacatatcaacattgaccccgttcggttattttacccactggcacttaaatatggggaattgcattgtgtgtccatagtcgatttcctatatttcttcagcaaacccgaagtatgattgtttttcccccgcttcatcaattgcctccacacggatactgctattttgcgtacaggtcttactatctcgggctcttgtactaaacgagtatccattaatgccatatccctcccaagaatttactgtagttgatggaccacaagccaaccgcttcatagttatttcatcggtagtttgtccctcaggtaagtctaggtctcgcaaccaatctatgaagagacgcttgtgttctttcattatccactcggttgtgcgacccttattgttagctcatagtagttcgatatgttgatcaatgtaaggctcaacgatagcaaactgatgaagcacgctgaagtgagcttcttgaaatgatttgtgatcatgggtgacgaatatcttctttcctatggttcccctgccactcaatctgccctcgtgtcggggcacaggtactccaattttatttccatctttgaggtaatcgatacagcactcgacaacctcttcagtactataaccctcaaccattgatccctctggatgtgcacgatttcgggcgtaacccttcaaaaccgccatgtaacactcgtatgaccacatttgatggaggtacaatgggccaagcgcaaccatctgcgacactatgtgaataatgaggtgctccatcgtatcaaaaaatgatggagggaaacacatctcaagttggcactgtgtctcatgtgcgaatgtacagagatttgctaactcttcatgactaatgaccttctgtgacactgcgttgaaaaagtagcaaaaccttgtgatagcaacatttaaaagttccggttttatggcccttattgtaattgcaagaaacacggtgagcaagacatgacagtcgtgtgaattataaccagataccgacaaatcttttatggaaactagtcgactgatgttcgatgagaaacctatgggcactctgacatcacggagtgatttgcaaaatgacttcttctcctcaggtgtcattgtgaaacaggctggtggaagatatactttgccattgttctctccttcttgagggtgtaactcttccctgattcccatctcgactaggtcaattcgtgactgaagaccatctttagtcttcttcggcatgtccaacaatgttccaactatgttgtcaaacacattcttctctagatgcatgatgtctatggcatgccgaacctccagatctttccagtacgggaggtacttaaagaatatggaatgcttcttgaatgggagagggagtttatcatctagcttcatactatcatctagcttctttctatcctctggtttcttagtcttctcgggtttcttgcgctttgtcccctttgatggtttcttactaacttttccaaattcacaaatcattttctctgtcattgcaaccactttttcccctgatgtaggttttttgtgtaggatcactctcttcggtgccatcgaactccgccttcatcttgcggtacttgtgatttgtgcgtaggaaccgccggtgccacatgtacaaaagcttgttggaacccgggagatacttatagtacgttccattcaagcagatcacacatcctgtttttacctttaatttgacctgaaactgaaaacattgctggataatcgttaatggtcacgaagatgatggccttcactgtgaagtattctcttaagtactcgtcccacattttcaatccctctttccataaatcagccatatcttccaacaatggttcaagaaatacgtcaatatcaataccaggctgacggggtccctgtatgaggatacagagtaatacgtattttcgcttttgacaaagccacgtaggaagattatacatggtgagaagcactggccatgtactatgtgagctgctcatttctccaaaaggactaactccatcagcactcagggcaaacctaatattccgtcggtctttagcaaactctctatactgagcatcaaagtttatccactgacaagcatctgccaggtctcgaatcatcccatccttcttgcgcccttcttgatgccaacgcattagttccacatctcgcggatttgagtatatccatttaattcgttctttgacaggaaggtaccacatcacaagctgcgggatttttctctgagttccctcagttgtatcagacggttctaggccagtattgctattcgatttgtaatggctagcaccgcatgttggacattcatctaaagaagcgtattctttcctgtacagtatgtagtgattaacgcacgcatgaatcttttccacaccaagtgaaaggggacatctgagtttcttcgcttggtatatgctagatggtagtgagttaggcctcaggagcattttctgcagaagttctagaagattgtcgaaactactatcagttcaagaactgaccgtaatgttgtgaactcactgtcatagccctttgattcatcgtacaaaacttccttagctgccttctgtaaagcttcaaagttatttaaacctataaccgaacccattagcacctcgggttctggatgacataacatttcatctagatcgattttgtcctcacctgaaccatcgtcatgcaccatgtcttcaacttgtgtcggaactacattttcaggcccgtccacttgttctttgccatggtgtgtccatatttcgtacttttccataaatccacgagttactaactgctccatcactttagaagcatcttcccaggctatttcattcttacagtcagcacaaggacaaattatcttcctcatattgttcttttcagcgtgtgccttcgcaataccagtaaatttagacacttcatccctatatggagacaaaaacctcggccaatgatacatctattgccgcctttccctatctctaaaaaaattaacataaaagatttgcactattagtaccaaatttgtagggtttactaaaaaaacatatcgctattcaaaactaactgaaggtgaattataaattcgtaaaaaacacaaagtttatttcaattttttttacacagacatgccaaattagtatattaggaaaatctaacaaaaccataccatcggcatattacaaataatacaattatttttttgattaaaccaaataaatagacattaaaaattttgttctctctcatatatatatgtctacatctagatctagatctaggaggtggatgtgatagcaaaataaaaaaaaaagagaatttatgttactacattaaaccactacaacaaaaggcatcaagtattacacatacatctaacatcaacatatcaaaagaaagtaaataaaaaaatggagcttttccttcactattttgcatgcatagatccatcacaaattgaggtctaaaagcttaaaaaattgcatacctagtgtggaaaagagtagatctaagcaccgaagaaaaatcccctgaagatttgaagttcaaaagctccccctatatttaagtcactttaggagagagaaacttcgggagaatgaacagggctcagaaaggaagaagactatataggggcattatt

SEQ ID NO: 75533 - DNA, 5589 bp, Oryza sativa
cgctctctcgcgcggataaggaggagaaccagacacacgcgtggataaggagatgaggccggctcagctcggtttggtatgggtgccgttttttaattaactagtacctatcatatattataagtgtcggttcttcttaaaaaaacgggtacatatagtattggtactggtttttcctaatgaactggcacctattatccttaaaggtatcggttgtatatttttttgatgtgcggatgtgggaaaagtcccataggtgccggttataaatgaaccggcacctatatggctgatctctattagggttttttagtagtggaaaaaccaatatccaactgtgagtcagacttacatgtagtcaaattttacaaaatactgatagtatctaactgacattacgaatggtgtaatgttatttctttagtttaacaaagctgcaatataatggtatagatccaattaacccgttaaaatagtggacatataatatactagaatgatatgcgcggcgtgtcgccgcgcacaatgggagatgcttaaacttgttatgaagtataatgtttgaataacttgtagagacgaaatacatatttatcgtgggtaacccagagtttattatcgtatttgcgttgaaacattcagttatgctgtatatatcacagttaaatactaactcaaattttatcgatttcctttcggaattaattaccaagaacagaatcctgtacatgacaaacaattggctctctcctctagtcctaccacatctcttgctcccaagtcccaatttgtcctcttcctgaatcagacaagtttatgtaattgtgttcagtaattatgcatactccacagtaaagatccttgccttgaggcttcagcagcagctggcttacagaaacaacacagatcccaagagaaaatcagtacctcaaaaattcagagaagaagcaagagaataagacttcatcacttgggtagcctttaaaagactgcttccagcctctttcggaagcaatgcaggtaaattcagcttatatagttgccaaataatatgattgggatgtatggcaatgaatccttcatgaagaggcttatggaaaccgaaataaatgcaacaacagatggaatcaactgagtaaacaaaaaattgagaagtcagtcatcccttgaggaaaaaaattgaatatcaaattggattaatcaaataatggatctgaaaaacttcggtaaaaaaaaaaagatgtgaacaaacctttgctttaatattcagcaggaaaagagtaatctcttgatcacgtaaaaaattgcttgatgcccaccagaaatcccgaaagaactctatagaaccccgaaagaactctatagatcccagaaagaggcgtgcatctgcagaatcaaatattttttcattgtcaagattcattcatgaagaacaagtcataaaagtaattcattcatgaagagcaagatacaaaagcaatttcttcgtgaagatcctatattgaaaaaaatcacagaagttatttgattcattctgaacaagctagataacctcataacccatgtttcatcatataggttactgatcatatcagaaggcaaaatgggagttagagccatcatttcgtattatcaattaatctatactaatttcaaagaacttaagcatggagaagcaaatgaatcatgtatttattggttaaatagaagggaacatgcgcggcgccacgccgcgcaaccagtatggtgacatgatgtgctaatctgatgcattgccttacttaaacgtttttttttcaaatctctggatcatctttgcaaaatgagacagcgagtcaggtatcaataatcacctacagtggcattgatggtatcagctgatacaatctacaagtagggcattgcaaatggtggggaggtagggttacatatagatttcgactgttttcatcagcaggattgcaggaccaagcatgctcagaatttccagtgaaggaggcccttagccatggtgccaacaggttcttcttcgctctaatttcgccttgctcacctaattgcttgttcaatacaactgtaacatgttcatacaccaaagcggaacattcctccgatgatccgatctttcaattttgcaataaaatacttacattgattataaaattagcactgaaaacaaaaattaaaaagtagtaaataggtgatagcaaaaatataatttcaaaactggagggggaaatgcaatcggttacccccatcagaattcttctccaagacaatgccatctttagacacttgatgcatatcccattgatgagaaacaaatgaggtaactttatttaggagggatggcctgtcatgtccagttgatacttgcaagattgcgtaaaatatcaacagtgccccagggagaaatatacttggattaatggaagacaacagatacatttgcacatttttgtaagtcactgacaagtttggaaatctttcagtttgtaagtctgactgaaataatccttcatatcaataatagacttaaccagttaacctggtagcaatctagtagtacccatgtcatgcaaacaacctaagatatcatttcaaaaagacgcgatctagtgaaattcaggcacaattctcaaaaacatagaaaaagacaactattgtagtatatagaaagctggagtcaggaatgtgatgtaggacaagctccctaccttataaatgaactcaccaaagcaaaattaatttagttcagtggtttcagatttacctatcaaaatagttgagcaaaggcaactattctgtattcaggttagcaggctaagtatcgtgcataacaaaaatcatacatcgcatattgattcagacagtgcggcatagtcgcagggctcctcaaccacccagcgcgatggccgtgcagtccctgaagcactcataccctgaattagaccctaacgctagcgccctaacaaaaccctatgctgtacctggacatggatcgatgggcaaccagaagatgcgctgctatcgatagcctggcccatggcatggcaacgttctccttgggaaagtggcagcctcacaacaatgcttcatctactatctaactgtctgacgattaggcaacacacgatcgactgttcttttcagtgcccacttctccattgtcatttcgcaatattaacacatcctaccaatgcccaaagtgtgtcatattcttgaactatgaaaaccaaagttaacaaaaaagagaggagggggaaggaggagctgtgagacggcaattttatgaaatttaggcagtgagtagccaatgctgatgagaaggcatgggtgcaatataatcttcatggaaagctatgcaagcaagcatcatattatcgaaaagaatattgtcatgattaatatttgtgatgaacaattagctatgcaaatgatttaatcgatgaattggtttgaaaaaatgtgtggatgttggtgtaagtgcgtgtgactaatgtggatcaggttgtgatttctgtgcccagaaatggttgttttgtctgattgtgtgtaggtgacttgaggtcagccttggtcaatggtgaggaccgggactatgttcaatgaggaacagatgtgtagtgcggtcgagataccatataagaaattgactagagtcaggattcttggaggtcaacttcggtcaacggtggggatcgggactagattcatggaggagttgagatccagaaggtcaaggataccgggtgacgaagttggatacgagatggtatacggtggatggacatcgtgtgggagagatcttcacaacgggcttcacgaggtgtgtgtgcaagtgtcggtgttagcgaaggaaattacgaagaaactggaagaagaaaagatgtgctacagtacacgaggtactgtagcggggatgcatgtacgtgtgctgtacatgtgtgatggcggcaagcggcagtgcctcggctgggatgtgcacgtgggcttgcttgtgttgtagacaggccggcccaggtggtgagttggcggcctgcttggaggaagggtcagcgcgtggaggaataggaaggagaccgagaccgagccggcacaggagcgttcggctgtggttttggagaataaggaaattgagggattaagtcctattgtaaatagtagttctacatctactatgagtaggaggttttttatgtataaatagagagggagggtgaggcctcctaatattggttctagagagactagagttgagagaaagttagggtttcgagtttagtttgagattttggtgaggagtgctgtttgtgcactttgtaaacactagttgatgcaataaagtcaaaaagtttcaatctacatcttcgagtttgtcatctaccggtatttctatgtcccgatggtctaaccgtaggtgtgcacgcggtctgaccggtgggatagcggcagtctgaccgcaggtgttcgggcggtctgaccggcggcaggtgggcggttcgaccagcggcgactagacctcgtcaccgacttcgttcgagaataatctttaattctgtaaaagattttgggtttttggtttttcctaccattcacccctctctggtaggtttgtttggtctcgtatgatcctacaccaccgtggatcagtataatggagccaaagaaaagctcatttgaaactcacaaactctctctatttttcatcacacagtaaaacaatctaaaatacagccgttcctgttcaaagaaagagcaataccatgccttctcaaggaatgcaggtgagtggattttgctctctccatcgagtcaacacaagcagaaagcaggaggggaaaagggggagttggtggtgggggtgaaggatggagtaccgtagcgagcacgaggtcaagctcgaggcggcgaaggtggtctgaatctgatgcactgcgcactccaactcgtcaagggctcgatgctgagcaagcccctcgtcatctcgcaggtgagggaggattgggcggcagcggcgtgatcgaggcaggtgaagtcgtcgccgacggccggcccggtgccggggttggaggaggccatcgtcgttttcgtcgcagccgccgtcagcatcatcatcgtcgtcgcagccaccatcactgttgttgttgttgcagctgccactcgctcccgctcgcctaagccagccgccctcgctctcgctcgtctaagcccgccgccgccgctcgcgatgacggaggcaggaagatcagcatgctgccggccctcccgctcccgccatgccattcctgaggacggaggccgctggatccatgtgccgctaaggctcccgaggacggggggcgatggatccgcatgccgccgtccttcccacttgagcctagcagctccaaaggacagaggccgatggatccgcgagccaccgtcgctcccgaggacaggggggcagatctttgcgccgccgtccttgcccctacactctccccctttccaacggcgtggggtatggaggtggagcggtggagacacgaggacgggcagcagagagcgggggaggacggatgacttcgtcggcggcgggtggagggc

SEQ ID NO: 75534 - DNA, 21696 bp, Oryza sativa
accgtcccctcctccccgggtatcgtctttgccggcggggttttgcctccgaaggccatgcccgtctgcgaaagtggaacccctacgtcgtagataatgtgttttctagtagtgagggttcatagggtgcacatgccttgattacaagaacgggagatacgttcctttagaagaaatccaactacggtcatatggtttggcttattcagggaatatgtcaaatggtgtttttgcaaatgaaaaataattttttgaagaaaacttttatatacgtgtccttaacgacctaaaagtaaaggttgaaaaataaatttcgatcaaaataccccaaaatcaatataaagttaaaaattgaaatttttgttgctaaccataagcataagcgaaaagatgagacttcaagcataaaaataaaataaaatttaatgttaggtttaatgtaactaatctggtgttataagaattgctacatctccctataattttgatcaaatatataagagtttaactcagagaaaaaactcaaaacatattataagacataaaatgaatcggtattgtaatcatcaaaaggaaaaagtaaggtgatatgattttataagagaagaaaaggagggagataattttgaccgtagatctattatctatgggttaaaaacaattaaggcgatgtagcttaacgagagaagagagaaaaatcgtttaactacttagtgcggataaactttatggatatacagaataggatttgctatgttttgctatgtgatagtcaaacatggtgtttggtgaaggacgaggagagctacaaattggacgtccgatgttgtaaaaacatcggatggtcaaatgtttcagttgaccattggtgcaacattaagttatacatgatgaaaacaaaaaaaactctgaaacatacataaattttgtgaaatacaatgagaacacattgtgaaacgtatcgttatcacgtatgaaacattaagtttttattgtttgaaacatatatttttctttcatcataatataatcattgatatcttgttgcaaagattcaataataacgaaatcaaccgcggggcggggaggggggggtgagcgtcccatactttttcggttatacgtggtgaaatagaaaaatatgttattgaaacatttaatttttttatgaaacataaagaaaacccatgttgaaaatattgctaccgcatctgaaacatttaattttaacagattgaaacatatgtttttctttcatcggaatgtaatgatgtgatatcttgttgtaaatatttaattataacaaatataatggtgtgatcatatcatagattggataagtagttcaaaagaaaaattattttgaagatcattatagcatttatggatgtgtatagtggatagggaggaagtaatttgcctgtccgattttttctgcgtcatacgtatgataccaagcatttccggtgaaggacacacgaaaaatgtaattacgcccatggattcccaaaaaatgtcattctttgccacagaactccacctataatactttgtcatatgagttttatttttactcctcatccctttttttatagtagaaatgaaaattatggggagttcatgtggaattaaattttagggttgatttgatccatgccattgcaaaagtgagtcattgtatttcgtctatttgtaatcgtgccactcaaattttacaaaattcgaaccatgcaatcgtcgtcatgttttccatcttcttccccatctgcacgtggggcacacccatcatattcatcttcttcctccatcctcccctcttctctttgtttctctctccaccacttcttagtctccacccgaccaatccatcccgacaccctctgcaccgcggagtacgcctgcgccctcaccaccacgggagtccacgcctaagccctcaccgccgcaggagaccacgcctcacacctccgacccccgttgcctactcaatcgttctaagaactactcgatgcttgctgcatggcggtggcggcgagttcgacctgcgcggctgggagaagcaccagtgattgcgcagcgacgacacactcgcctacttaaccgacaacgtgttgcagcgaggtacactaagcttgctctgccgttggcggtctgttgctgcgggcggcagggagggagttgggatggatgtacgtgtaacgtgcagatggggaaggaaatgaaaaacatgatgcgatggcatagtcccaattttataaaatttgagtgacatggttaggaatagacgaattgtaatgacatttacctaaatatgcacatttgcaatggcacagatcaaattaaccctaaaatttaagtgatgatgtacgactgaatttatctcatcgtacttaaaatgggaattccctcccaatacctacccttacacatgtattgaaaaaggtgggagctgctcttaaactctcaatcccaatccctcataaaactcccacatccatcaaccaaaacaatagactaaacaacctccacccttcaaactcccatcccctcttaacaattccaaatgcactgatcttgtaaaatactcaaacgagtcacttatctttttttaatcacataaaacatgtgtcatgtgaggagttctctattaaggttgatgccatgttgatttatttggtaaacatggccacacacaatcctggattgtcaatccacaaataagccaactgcaatatgattatagtaaaatccaattttaagatgaattatattattgcttgctaagtttctcgaaagcacccaaatagcagctagcattgatgaaaatatggtggtaatttgtaattcttttacttccctaaaaacatataagcttatcctgcccatatggctcacaatgcattatatttggctggtatggctgtcaattcgaaacaaaacaatagatgtgatatgtattttataagatttgcaccggcgaaatgagatgagtgacttaactgagcaatttgtaaaataagtaactaaattgcacccgcctcgcaatgagtaatgacaagtttatcttatgtatcgttctgcctaaacaatgtcgtgtcacctgtctcataaatcattttgggttattcagattgatgtcattttcaaaccatactattttttttaagttgctaaatatatacatccatttagttattaccaaactctaataaatacataacaaatcttgccaaaatttgacaatattactaattgccaaatttttggtattaccaaaattataaggtttatttttgctacaacctaaacaaactcttttaactgtaaccatgaaaaagtggcggtgctaatggctaccacaacggtactgaatggatgaggggggggccttaatgggcgattgatcgccaggcgatcgcccaggcgatcggatccggcccccctcctcctatactcctccctcctctcccctattcctcctccccttctcctctttctactacagtagactacacaaatttttttgaaaaataaaagttagaaaaatttatgtatagaaatactatatataaaaaatttgaattcaaattcaaatttgaatcgggtatgtaaacttttgacttataaactttgggtctataaactttaggtgtataaagtttagatgtatagaaatactatatatagaaaatatttgaattcaaattcaaatttgaatcaaatattattcaaattcaaatttgaatcgggtatataaactttaggtctataaactttaggtgtataaactttagatgtatagaaatactatatatgaaaaatatttgaattcaaattcaaatttgaatcgggtatataaacttttgacttataaactttaggtctataaactttaggtctataaactttaggggtataaactttagatgtatagaaatactatatatataaaaatatttgaattcaaattcaaatttgaatcggatatataaacttttgacttataaatttttggtctctaaactttagatgtgtaaactttaggtgtataaattgactaaaatagaaaagtaacgcggtgccaaaaaaggaaacaaggtggaaaggtggagggagggaagggggggtgccagggcgatcgctcgtcaagtagcattcccgatggatgagcacgctgcgtcctaggggcaatctggttattttgtattttttttctccctcttgaattacctagctagaaatgataaaatatttttggtggtgtctatagaaaaaccacatcgtttaggtgtgtatgtgtgtatggacgaagccatatttttaaggggtgtttaaatctaggggtgtaaaattttagcgtgtcacataagatataatatagggtgttcctaatttaaaaaggctgcatatatctggtttgatgtagaggccggataaaaatatctttctcaaagaaaaaaaaccaacgaccttatgttacgatccatcttccttacaaagttgtcccaatgggggctttttgcaacatgtgtttcctacgaaattatacttgtttgtcaaattagggtctgtttagttcgcgaaaagaaaatttttaagagtcacatcggatatttgaacggatgttgaaaggggttttggacacgaatgaaaaaactaatttcataactcgtctggaaaccgcgagacgaatcttttgagtctaattaatccgtcattagcacatatgggttactgtagcacttatgactaatcatggactaattagactcaaaagattcgtcttgcgattatctcttaactgtgcaattagtttttttatactatatttaatgctctatacatgtgtccaaagatttgatgtgatgtttttgggaaaaaaattttgagaactaaccaggccttaatccatagaagaatctatggattaatagcaccgggcatgaaaacggtgcatttacgcactcatgtgactgctgcaacggacaataatcaaaatgaatgaaaaaaaaatgaacgataaggagtttactaacaggactataattcgacaagctggtgtgcttattcttgtccgtattgtcattgacttgtcaacaactagttattgtacatgcatcctatgaccacttagattattgcaacaagtacttgtcaggcccagcttgcgcctgtaatgtccggaatctcgataaatttatcccgtatatagcgcccctacgtcggccggcccgacgactgtaatatacagtcagtcaatggtttcaccaataacaatgtatggtatactgacgtttcccgggaaaaataaggctgatgcaacggagggtaaaagggtcccaagcgtgcccacagccacaggaaactaagagcatcccaacagcattccaaaatttcatccccaaaattttgttttccaaaatcctaaaagaaatttaaggtgtgaaaataatcatctctccaagagatgacctataactaattctctataactgaaaagtggaccctataaaagctaccaacaaaaatctgtttcctccctcctcccgcaagtgatcatgcagcctcgacgcttactgtcaccacgatcgcattcacctcccatcccacaatgttgctctccccccgccacgatgtacttctgcatattttggcctgcagtgtttgtaaactaccatctaaatttgtacttgtaagaaaatttctcagtacaaaatcaacaatcagattagtacaacatccgcatttcaacgcgatcaacccaacaacatttcagtagaaaattatctcagtccaatatagcagcaagcaaaccaacgtaaccagtaagcagcagcagccagccattacgagcaatggctgcttctaggatcagcatcagttcaacagcggcagaagcagcaagcagcagctgtagaccacacgggtggagaaagcgtttgtagtcccggttcgtaacccctttagtcccggtttccaaaccggcagtaccaatccgggactaaagatcgctatctttagtcccgggtgcaataaccgggattaaagatcgagctgacctttttttttttttcatggccctgttgctgcatggttatatatatatatatatatatatatatatatatatatatgaccaaaatatatatttacattaaagaaaatgtgtacacatgcatatagaaaaatagacatgtattaattacaatccattatgtcctagctagctacgatttcgacgtagtagtagtcgctatttcagaagctaaggacctatgaattgtatttctgtcgtagtagaattcacccttgggatcaaggatttgttcgttgatgaatcccatgagttattcttgaatcgccgcgataaattccttgtgtgtgatcaggttatccctcatgcgaataaactatatgaatgtatgaaattaattagtaattaaacaacaagtcgatatgtaatgaaattttgaatttatttgtacgtacatcgagctctcttgtggtgatgatttggtctgcaaggcagtggcaatactcgcacacgtagtagccgcacaagttagttccctgcttttgctttgcgcactataaataaatgacaaacggcgagagatgtaattaatatacaattgtatgtatttgaatcggagattcaatataaatgtagagcatgtgtactcacaggaaaattgaacttcggcctaagtctttctctccatttgccgcggaccaaatgacagaaccgataccaagccctacatggagtttaaagctatgattcgtagtagcaattaattataacaagattcttaattaacataggaacttatgacagtacctatctataagttcgaaaacattgtcaaacgtagactcttttttatccattgagtcatatacgttgacggtgcaggcctccaggttgaagagtaaaagcacccagtggaatttgcaatgtgcgtgggatgcattacatatgaaacacttagcatgttcgtacgggaataaaatttggtataggaagacagtaaaattaaactaactctgagttgtacggcaatagtatgaacgtccctccgttcatactcagaagaatctccctccgttcacggaatatggacatatatcgcagcctgactgggatacgtttgttgcagatcatacaacagctgaagcattggctttgaggaaaaaaatgtccgagctcgcgaagaaaaatagatatccccatagattggggtcaagtggatacgctgggcacgtcgatcaatggcgggagaccgagcaaagatttgcagcggccggcaaaccactactggtagaccccatggtggaacgtagtaagaactgggtttgggcgcgcagcacaggtcaagtctcggatgagggagacatactattcgagactccggacatagaacaagtgactactaatttgcagcagatcgtcgagaaagaaagagcaggacagtttgtcccacggagggagcgagaccagcttactgtggcgttggggaccgccgaacactctggacgtgtaaggggtttgtcctcaaagccaagttggaagataggctttccacatgacgcaccaagttataagaagagagacaaatacaaagaacaactatcatacaaaatctatgcgcaagtgaaggaacacttctactcgttggtagctaaaaacccgacagcctttccaaggttattccctgatggccagcaacccacacaatccacacagcaaacaactaatgcacccagtagtgtaggatcagtggagacaactcccttccctatggatggtataactggaccaactccgtgcagtctcgtcgtacctatcggccgcgctagaaagactaaggaggttgcaactggtttagcgatacccggatgtcaattacacaacacggtaatccctgaggattacgcaagggtacaggtcgccaaggtccatagagaccacatttccttggaactagacatacctgcacctgagaggattgaacttctcggtgatgcagtgaatcagtttatgttgtggcaccgcagagacataatcctgaccgcggccgttccagcagcaggatcttcaactccatcctcatcacaagcaaggacagttgccgcttctgcttcaccgtcgcctcctggaccaccatcacctccaaatctggcatcaccactaccgtttaggtcaccggcttgccaacctacaccaccaccgcttaggtcatcggcttaccaacctacaccaccaccctcccattctcaacagcctgctctcccggctccacaaccagttcaagcctctcccacctccccagctcaacagcatgctcccccgactccgcccttagttcaagcatctccacctacaccccaatctgctctggtagaacaagtgcacataccggaaggtactacatccgaaccgaagtctaatcctttggaacctcgtcgtataattccaaagttgatatcgacatatgacccaaaggagattgacaaggataaggagaagttcatgtttcagctttcaggaattctgagaagagaaaagaacttgctcacgtcatgtcagactcccagaagtcagtactagcagcccaagatgaattgcaatcatggttatctgccgatgtgcctgaaacttatgagtatggcaagccattcttgccaacatatcttatgaacaatctaccctgggaaatgagggcaatgcacgaatggtatatcaaggcatataggaagggtctcggtttcataagcatcgccgtcccggaaggtgctttcatgagttgagtggtcctaatgggatattttttttatctctttccgagacctttacgccctctacaagctagataaaatggacgttaatctcgttgcggcattctgtctgtaagtctgaactctttattacatgttacacgtatcattccaaacaaagaaaccaaatctcattacttctttgttcattatacagtatgcaattcatgaagctgatagaactggatcaccggttggatacatcgatccaacaagaatatgcaaaagacaacacaccgtagagctgagagaggactacgagcaaattggttggcaagacccctcaagaaaaggaagaatatgtgaagcaattgcacaacaggaagaagctagaagtagcaacatacttagcaatagcaatgttggcgcacgccgacaaagatgtcttaatggtcccctacgcgttgacgtaagctttatcttctttttgtttaattaatttatcttcttcggaattttctgtctccaataagcctatcttatatgcagagaccactacatattattccttgtatatccaaaaaaccaattgatcatatcgttggaccccacacaatatgaaaaggagacctttatggaattcctcactattttgaatttgtaagtgataaacatttcattaatataaattgtttaggtcgatccctagtcttcttgctactgataaaataattgttttcttcaaatagagcacacaagtactaccgcaaaagaggcggacccagtacatattccatcccagaagcagttacccatcatgactggctggccggtactatcaaatctataccaatagaactaattatcgaacaatacatactaatttatatctactgagatcagtccctcataattatatcgcagcgttacaaacaaccaccaggaaccaacttgtgcggttattacgtgtgcgcgatgctcagagtaaacgggaggtacaaaacaaccagtaaccaagtaagttagcgaactcttctctacaaagaaacccatctagcacacgcttctcactgagtaccattctattttcctttctgtgcgcagatccccgaaatcccatatattgcacaacaaatcaacaacggtactacctggaacgtgggcgctgacctctgccgattcctccgtcgtgatgtctgcaacgcaagaggtctcttctacgacaacaagaatgaactcgcaatgaacgacaaatttaaacctctcagagagtgggagaaagaacatatgcaatgacatgtacactacttatacatatgatgaaaaaactgtgacacttgtattatatatttcgtatgtaaattacgattgaatttatggttatgtatcataaactgtaataacaacaacccgactatctcgtatgcttactattccgaaatacgataataaatcctcaataatttaatattaattaccagacacatctcaccaaaaggctagaataaatattattttagctattcggaaattgaacttcgcatgcggtctacttaagacggccgcatgcgaaaatagatctttgcatgcggtcttgttaagtcgatcgcatgggaaaatagatcttcgcatgtggctgcttaaatgggccgcttcgcatgcggccgtcttaggtgaccgcatgcgaagatcgatcttcgcatgcggctggacgcaaatgatgatctttgcagaccatttcgcgcatgcgggccggccgaccacatacgaagatcatgttcttctgtatgcaaaaacccattctgtagtagatgataggtgatgtcgcaaaagtgatggactgatggcgtccccaactacgcatgatggacgcgattgtggggccggagcctgatgaatcgccctcgacgggatgaattggcagaatcacataagtgagagcgtcctcgtctatgcgtgatgcacaagattgtggcgccatgcatcaacatgaggatgtttggccggacggggtttgggttgttcacgacacgtcctgatgcctgaaggcacggtgcggttccgcagcttcccatcttgctccttcacagcgaacggttagatttatttcgataccgtctggtaccagtaccacgaggagaaacgctagggtcttctagctaactccactagatggtgggttagcctgcctagctagttcgaagcggcactccttttaattatttgatattagatcattttttaatatttgtgtttttacaagtaccgcgaggtacaacctcatggacaggaacaacgcttttttgcaacatatattttatacgaaatctatgctttctgtaaagttaaagcacactaaatctaaagcttaatatacaaccatgccacatcatcacccactagcaataattatatatttaatctcatacaagcatacaaatgatctacaatttatttaattatacaaatcaaaatacaagcatccaaccatcatccgtctccgtcatacatttgcacaatatttcaacaaatctatctattacttttacaatatttaacatatacttatcaatatgtttcacactaaagcacgagtattatttgactgataaaccctaatgttttgttttttttcttcgtaatcctagtttgattgtaaaaaaaacatattgagaatttcttagtaaattttacaacaaagcacgggaaagcgtgaggaatcacctagttatactatagttatactagtttcattgtttgtcgaaccacagtgaagaagaatctattgattaatagcaccgggcttgaaatcggtgcatttatacgcactcatgtgactgctgcaagcctgcaacggacaataattaaaatgaatgaaaaaaacgaacggtacggagtttacttactgttactggattataacaagctggtctgacattgcgcttattcttctccgtatcgtcattgactttgtctacaactagttattgtacttgcatcctataaccacttactccggagcaagattattgcaacaagtacttgtcaggcccaacttgcctttgtaatgtccagaatcttgataaatttattccgtatatatagcgcccctacgccggccggcccggcgactgtatattaatatacagtcagtcaatggtttcaccaatacatactgacgtttcccaaggaaaagaaggctgacgaaacggagggtaaaagggtcccaagcgtgcccacagcgacaggaaactaaagcgaaacggaaagtaaaagggtccgagacggccaaaacgacatatttacaaacggaaaataatttgtgaataaaacttttatatacatgttcttagcgatgtaaaagcaaatgttaaaaataaactttgataaaagaaccccaaaatcaactttaaatttaaaattaaaaatttaaattttagctaataagtataagcgaaaagatgagaccatataccgtagcgcatctattcatctaagccgtttggggcaaccggactcactatttggtttttattcgtgtagctgatccttccgtcccaaaatacaagaaatttttagtactccctccgtcctaaaatataagagattttggaaagacgtgacagattttggagagacgtgacactttctagaaccatgaatctaaaatatgtcacaaatcttcaaaatccttatattataggatggatggagtatattccatcagcagtacatacacataccgcacatgattcgaacgaattataactcctacggtgcaataatatattgtaatggttgtatatagtgttagtatatagtagggtgtgaaaaaccgccggtaaccgcgcggttaccgcggttaccgcccgtaccgcgggggtacggttacccgtaccgcacggtacggtttaataaaattcgtccaaattcaaaaatttaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttaaaaattggaaaaagaaaaaaaaataggccggcccgttactgtgcaacccattacacatcgcgcggtaaccgcgccaaaccgcgtggttaccgcgtcaaaccgcgcggtaaccgcgccaaaccgcgcggtttgcccgaatttttgaattcaaatttcgatttgaaaatttgtcgcggttttgcgcggttaccgcggttaccgccggtaaccgccgtaccgccgggtggcggtaaccgggcccccagcggtttttgaaaccctggtatatagaaggacgcgcggcgccacgccgcgcacagctgaacccacaagcatggcttaatcaaagcaactattaaaaacacattagctattattgaccaaatattaatttatagttccatttagcttaaaaactactccctccatatatattgacgtcgttgacttttcaaccaacgtttgaccattcattttattcaaattttttgtgcaaatatgaaaatatttatgtcatgcataaagaacatttgatgacaaatcaagtcacaataaaataaatgatcgttatataaattttttgaataagatgaatggtcaaacgttagacaaaaagtcaacggcgtcatacattaaaatatggaggtagtatatcatagtacaagcggcttatacactcaaaatatccgtagtttgttgtttgttaacaaagcggctttataattaaacagtgggtgatcgaacaacatgagcctaagaaaaacaagatcgatagagtaacatttttggtgtgaccaatgtttcggatacatacaggaatagaaccactctgtctcttttacatttatcatagcatgattgctcatggaacaacaaattactgattctaaaatctgaaagtagcagaaaaaagctacaaaactacagtcagtacatagacatgaaccagcacaaaataacttagttcgagaattagtacgaaatccaaagaacacaatagctcacacctgtgcaagcacaaatcctttcaaatctctaaaccgaatgccatcagagcaccccccaaagtcccttacatggagcaccttttttgctgcaagtaaaaaggcacaacattaattaacttatgtatgcaaccaatcatgaaaagcatactttaatgttgacctggctatgtacatgtgcacatagtaatctaattttaattagttccatgaggataaccatatcattacaatatcccatgaacaaacttagaagtttctgatgtaggagctagaaagaatgataaaacactggagtttggacgatatgggcatctagggaccagttctctgtaaaccagatatgcatacaatgggctacatggcacataaacaatttgacattagtctagcaaatccaagagcatactcacttctgtgtatatccaagggtaccgatttactgaatatgcaaacacaaaaattgtagaggtcaaatgtgtacgctaaattgagttccagaaaattgaaaattttaactgtacaggaagaaattaatcgacaacccaaaaaaaaaaaccttggttacaatatatttcgctattaagctgcataagaaaagctacagagcactgataataatgcatctggacatttatcaaccatatgttatagagatttaaccaataaatcaagaacacgcatggtgctttcagatcaaacaaacagaatcacaagcaaacatagccaaatagatgccgtctgatttgcctgtgcaatttgtgttaagcagacatttgaccactccatgaacagtttgtgtagttagtcacctgaaatgcaaaacatgcaaacaaaacacatctccatccattttgaactgttccttccaagttgcagaagtgaaagaaaaagggtatcaaattggggaagcgattgtttgcatagagtaccaatcaggagcaagaaaccggttctgttttttacagagtaccatcaaaatgtacaaaaacaaaattgaaggagcatagtctaaatcacctgttccactaagtgctcgtcctactgaaaacatgtaaatacaacatgtcagatagttttaataacaggtagcagtactaagtacgtagattttaaaaaaagtattataagtacttgtgcttccctctcatggaagcattttatgtttacgatctttcatcttctggaaatgaacaatataaaataatattgtttggggttgtatctagatagggtgactcaacaaaacaaatgacaatcattcatgaacttgttactaatacggttacgtagtaccttcttcacaattttcattgctaaagaacccctctcgcctgacacggtggcagcagttagtttcatactacctctccaattggtgaaattaaattacaaatttactaaactaaagcaataggtacaaatatgtgcaaagtaaataatcaacactatttttttaagcagaaccaacattactggttccccctgaacttgacatacctgaagattgtaagatcaacaatcctaggcggcagcgggctagtacccagcgcccaacagcaaggttctgggattcggtccgaaagatccgaatttcggtgaatttcacccatttcaatgaggtccgagacaaagattcactcctatttcgcctaaatatggttcagttttaccaaaatttctcaaatttggtttaaatttgaccaaatttcatccgaattttccgaaattcgtccatttcggtggacgtactccgaattttttctgcaatcgaatcccaaaaccctgcccaacaggcacggcacaccaatgagcagaacaaccctcagcctcaaagactcgttgtatcaaaatctctacaaatcagaagcaccaaacctcagtaatcatgggagattgaaagagaactacttactggacatcttgataggaacgtaagaattttgtgtgcaaatcggatgagaaattgggaatttagttgtatagggcaaaagaaaactcacctgattgcttatctttcctcaacaaaacacccattgctgtgctgctgctgctgctgcctgatgtggggaaaacgcctagtgttcctcatggagacacctgtcggccgttctgcctcgcttatgtgctgctgctgttgctgcatcatgatatgaggaaggcaaagaagatagcatttgttttgttgggcttggtctgctatagttgcatgtctatgggcaagcgttagctcacgcctctgcccactgcacccaactgaatcgcaacctcttggttgctcctgtcctgcacagctgcatgtcgtcgctgagccgccagccacagtactggagagggagcttccacagccgttgcgcatctgatgacggtatgtagcggtgccggtggtgaaggaggaggtgggaggacgcgatgccgatggtgaaagcggaggtgggacccaacgcagtacgaggcgacgacgatatagtgcaacttttgcagcttgaagcgacaggggagactggactgggactctggggagttacctcatcgaagggctccgcctccatggttgcgccaccactgcctagggttctcccctccaaatcgacggcaggagtgaacgaaacagacgatttgagggcgataggggatatatgccatctaattcgtagacctttcagggcaagccactcaatacgcacttctttcagattttgcactgagatagcgaattcctttattccgtgccactccgtcgccgatccgtccgtccgtccccaacgccagcttttccgtcgtcttccccacctcgtcacgctcgtcaccggcgcccgcgtgggccaaactcttggagagttggagggactcgagctcggactccggcacggatgggaggaaccagttgtcttctaatcttgcgaagcagcagccgattaaatggcgaggaggggccagctgcagcagcccggcgggtacggaggagaatgcggcgacggcgacccggcggtcggcaccggtgacactcatactttcttcaggtaatcactaatcaggttcatagctgactcctccgagtgaaatagcaagcctacagagtttgtatgtgtcaagtctgcaggctggaacgtacgtaattgctccgtgcatgaatttatcataaaaatactactgattgtgcatagatctagcttgtgtgttaattgcagctcgctaatttcttccctagtttcttcgttctctctcatcgatcaattagttgcggaatgtgatttctttctacttcgttctgccttctgaggagcacgcttggtagtttatcaatgaaaacagtagattcctctatcagttttctcaatgcatttgtttgggaagattaacaattttttgctgattatggcatggaagagattagctctgcagttctgcctggtgctgaggtcgcacgtccgcggaatagatatggccttcgttcccgatgtggcccaggttcgcgaaggtggccgctcgccggctacgtcgaggtggaagacgctggaaatttcttcgccgagttgcccaactattctgcggtgtggagggcggccttggcgcctgcggctagccccgcctcgtgcgtctcggctcgcccgtttcgatcggctgctgctttgccagattacaagacgaatctgagcttgaggccctttagagcgtggctataggtgtccaaacgggcggcacggcccggcccggcatgggcacgggtccggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcatggcggcccgtgaaggcaggccggcagttgagctgcactggccgccaggccgccaggccgccagtgcacagtgttttttttaaaaaaaaagcaaaggaaatgtataaggaaaaaaaattaaaaatggaaataaaatgtttaaaaaaataatgatttactaatgttaaaaaatgaaaaaatggtatttaaaaaatggaaataaaagtttttaaaaaaagtaatgatttgctaatgttaaaaaaaagaaaaaatggtattttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcaaaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaagacgatccaccccaaatcctaccccactgtatcttcttcttacctgtagtggggataggagggggtctctgctgacgaactttctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaaaagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaatttgtgaaatttttggacaattgcccaaacatgctcgttcagtactgaagacctgtcactgtttcttgggccaccacgtgactgaacaaaatcaaaaagtaaactactataaggtaaaacaacttttaacattaaatacgttgcattccaccgatgctctgcatcggtggcaaacttacgagctttcacaccggccgcattgcaaaacctcttccatgcagcaatccgtgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaccggaggttctcgatctcttcgagccggtgtgtgtcaaaacacttccgctcgcggttccggaaaatccttccgaagctgtcccgcctgaaccggtacctcctcaacgacagccgtatgaaccggtacctcctccacagatggtggagttggagccgatccggaggtatcgtcaaaccccgacatgtagttggggtcgaaatcacccaaggtgaatgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgtgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccctgctttcggcctggcgcgtgcgccgctggcccgctttcagcctgacgggccgccggcgaaacgggccgtgccgtgccgcgggccgtgccgtgccgtgccgctacagtagccgtgccgtgccgtgccggcccgcgggctcggccagcggcccaagcacggcacggctactcgtcccgtgccggcacggcccgttactgtagcaggccgtgccgggccgtgcctgctacaggttcggccgtgccccgggccgcccgtttggcccggcccgtttggccacctctaagcgtggcccacgccggcgccggtgacgagcatgacgaggtggggaagacgacagaaaagctggcgttggggacggacggacggatcggcgacggagtggcacggaataaaggaattcgctatcttagtgacaaaatatgaaagaagtacatattgagtggcttgccctgaaaggcctacgaattggatggcaaataatgaaatggaaggagacgtcagcggtcagcccgaagcggcggcatcggcttcgtcgcggccacaggggctcggggacagaaaagaccatgtgtcaaaaaaatttacaataaagtttgacaattagtttttctcaagcgcatccatcacaactatggtcactctatatcattccacaaccctgatgatcccgatgcccgcaaaaaaaaagagaaagaatcaagtaaaacctaaacgaacccaattacacagtatctttttaagaccacaatagtcctccgctctagagaacggatccatagaaccactgaagaaacatcgcaagtctgatccatggtccgatcctaaaccaaatatgctcttaga

SEQ ID NO: 75535 - DNA, 9558 bp, Oryza sativa
cattcttcgcaaccgtttaccccggattttggaagaagggaaccccccctggtttcaccctccgggcaaccaccgcccttaaccgcctttgccattgccgggaagtgccgccgccaccgcccttcggccgcaggttcggccgggatttgcccccaaaaaagaaaggtgggaaaagaaaagaaaaggaaaaaattgggaagggtttcgggattggggggggggggttagtgtaggacgttttgaagaaaagcccctatatttttttatgtttacaacgctacccctataaacggaattttctcttcttcgcattgtatttttctggaagacaagaggttatacataagaaacaaaacaagatgtcagtcggtgcaaggatgtatgcgatattccgtgcaaatatgaggagttttttataaaaagcccagccctcttaccgggagcagcccttccaccctaaccggcaagcatgcataccaccacagcgcccaattttttattaaccggcacaccgcttatgggcggttgcccccgcgcacgcgaggagcaggagggattagcagcaacgtgtaaaacaatgagataccccaataaaaattcaaaaaaatgagaaaaacggtggggttaggggagttattgattgatgatgtgtacagtaggatctctcctagtcacctatagagaacggcccataggtgataactcatttaaaaccgacacctattaatcttttctcacctcccccagatggaaaaaaaatataaatcgacatattggactctcgaggagtgatcctctctagcgggagattgtgagatccccctttgtgagttcggccgggggcagcggatgagatccgagtttttcgagacaaaagagacacaagggatttatacaaattcgggctgctaagaagcgtaataccctactcctgtgctatgctccttgagtgaaggattacaagatctccttgttggagtaaaatgtggtgttgatcatccggggctagagactgctctagagcgtcaaatggatcatcccagatccctccccccttttactaggtctggacctccttttatacctcaaggggttaccacatgggcacaaaaacctagctccggtggagaagtgttttgcattaaatgcctgtcttgtctcttgacttgggaagcaagcgcgcgtcatcttgatgatggggcctgtcaaatcttgccgcctgacacgaggggcgccaatgtcagctgcttttaatgggtgaagacttctgggctcctatttgtcgacccacgattttggaaatcggaaatcttctgtgtttatgagtaccaatccctgaatcagtagttggtacacacataaatagccgaatcacaacatatcacgaatgaattcaggctaaaagagttaaatgcttacattagggccaggcaggccaacaactatcagagaacaatagcggaagacaaaatagtacaagggcccggttgacataccacaagcagtcgactagggaacgagacctagaatggaaccgcactccgatcatcttgttaggtacgcaagcgtacaaacaagggcttctcttcaacactctgctaaaagatatatatatatagagcaacaatgagtacaaaagtactcaggaagccaccacacaaaatgcagtaatgtaagggtattactagagtggctatggttactttgcgtaaagttgagttttcaaatatcatttcacaaacctaagacctagcataaactgatcaagttttagttccattgttcattaaacagggatggttctgtccaccatccattgtgttcccaaggatagcttctcgccactggtcgtcatggttttctggggactacaccttctcgcctctcaaggagttgatccaccagcacaaaatcatcatgcatatcccatcccatatagattaaggaattagagtctagccaagtgtaatacatgtcccggtgctcaataaccgcgagcacgactattcaaatagatgggaatactcacactgcagtggatgtacactttaccccgtattctgtgacttgcccaacacatgagcctacgtcccaaggaatgagacttgccatggcaaagcctttcaataacctactttggcagtacccgctccgtgaactttagtcctcatgcactctaggcgtccaagtttctagcagtgagaggagttctggcgctcccgggagggaaagattcacacatgcgttaagttagggttaagtttagattacacatggcagtcctgccgatggcgacaccactataggcacccgccctttgcggtcctaccaatggctgccccaccgtaggcccctgcctctcacacacatcaagaaatccactacggcttgggtaccgcctccactaggctatttactccgctaggtctatacccacacgagaagtacggttgtactagggtttcatgctcaggatagttcttattcttgataaaatcttgatcaaccatcacctcctggaagctgcatacgttgcctcatgactaaccgatatacaatttccataatacgcgagaagaaccaatattcaaacaacaatcaaatatgcacaaacaaaatagagttgttgaggtcgaacctagggttgctcatactacttgtgtttgctaatggattctaatcaagctaagagctaatgtttcttagtctttctgtggccatagtggttttgtctagctaatggctatggaagaattatggctacacatgcatctatctaaataaaatggtcatatactagaggttctgtcgtcggatggatttaggatcaatcacataattacagtgaatcatttgtattattattttattgatggaggatttactttgattatgaacatattttccttgtcacagtaaattatgaaaggttaataactatccatgctttgcatgttagagttgtttaggttaatcatactatggttacagattatttgtctgtgtggtcccgtaacgattaattacaggaggtcaaaatttataattaggacttatctactattcatgtttgttatatactccccagttgaatatatggaaaagggtaaatcaattgtatagttataatgggatgtacaatatacgtgtgtgcaacgatgtataaggttatggtcgcctacagtacatgagccatttagaaagtgtactacccaatgctccaagtgactcctgaatatattgtagttaaattatacattagctagtttctatatggcattgcattgattaaattatttggtgattcatccacatctagctctgttcttattctcctaaacaagttaaagattcatctatgtgtgtttatattttagttacaaaatatgaggctaaactttatgtaagtaatttataagtcatggattttattgaacattaaatagtgctagtttcttcctatacatccgttcatttgagacattactgtacttaatttacatggttgctactgtgacaaaacatgctagaaacaaatattattacatccactctactgaataataccaattttatttattagcatatttgttgaccataatctaatcatttgatattaattatttaataattgtaaatatgttttattaagtagtgagttatataccattggaaagcttatgaatttatatgaaattaggttcaagtttcactcaaatccgagttaaaatgagcaagttatactagtttaaagattcaatttcgaattaatccaagaaattgtgaaaagctactgttcataattcatttatttttaatccgaagtatatccttatccctaacagctgctgacatgtggggtcaaagctttgattttctttttcacaggattaattttctaaaggaaataggaggagtggggacggcttgtcagtggctcggccgatggtcatcttcaaccttcatcttcttcctcccgaccgagcgggagcagcaggggaacacggtgcacccagaaggccggccgagggcaacccggcggcggccaggggacgcacggagaagctccagcgaccacccaccggctgcggcggcgcttggagggacggggcgcatggccgccatggctgcgccatagccgagctcggctgcaagtggctaagacgacaggaaaggtttccgaccaaattgatgagtgcgtgagcatctacggcatacgggggttccattttgttagctagataggaaggggagcccccgggatggcttgtccacggcgagctcgccggcggcgaaacagtggccggttcggcacggctttgggtgctaatcgccaaaattggtgagacactaagcttctatggaactaggagaggctttaggagcgaggtgttaccgagaggtggcaaaacggcgatgttcgatgccgtggtggggagacggtagtgaagcagaggtggacgatggcggcgagcgcgcaggtgttcgactgcaggtcctcgggtcacaccggcacccggagttgatccaaggtagcaacagtagaggcatcccgaagccacagctcccgcggtcgtcagtaccggctccggcttcaagcaatggctatggaggcacgcacacaaggtgctcgatgaaatgcattcgagaggaaaggcagagagggatggggatttcattggggcttagcttagggtgtaagcaaacggtgtggataagatcgccagcacatgtctggacgagctagagctctaatagcgatcggataagggcaaggagatggatgacgtggataagtttcgatcctcccaagattcgggttccatgcatcgatcgggcgtgatttcccatacagtagagttgcaggggagggattgctagctgtgggaagaagcgctacattatccagcggtcttggctaggggcgacgagatgacgacgcgatggcgacaagaatggcggcgacaggcagtgctaacggccgccgatagagaggtgcagggctatctctagggtgacgcgggatgacgtggaggccgttatccctcggcatcgatggtgacacgcgatgggacgtggtgacgcaggcgctcgtggcggcgcaacctttttgcggaaatccggcggctcggtcaggcggcggggtccacgcgagcgcggtgcggcgtggcgcggtgcacggacacgcctggtgcggcgcacgggcagagaggtcgtgcgcggcctggttgcaacagggaaggtgcagcgctgggtgttcggcatgggctggggttctggtcgagcacctggcggcctatgaacagtagccggccgaaattaaaagatttctagggttttgagggatttaaaaattgagaaaatggctaattcaatttgtgttttcaccaatgcatttgatcaacaatattaagtattcaaatgtgaatttggtccaaaataaacattgtccaatatttaaatcttactatagattttatgattttctatataacttgtaggctctgatatttataaaaattaatcaaaatattctaatgtgactactattaatacaatatctcattggttgaacttatttgtctagcaatgtattttacacggaaaagtttaatctattttattcgagaggtaatttgagacttggtacaacattgatctaaatgtttaattaaacactcacataacgtattttatatataaagttcaatttatttacatgaccaattattttatgcgagtaggttttattccatgcgagactcgatgaaatttataaatattaatttaattattctagtggaacactcctatatctataaagtcattgcagtggcgactatttcgtggttacttagatgtcatgacccaattcaatccgtaacttatagaaattaataattgacttgcactttatttggctttgctaccttgtgtataaatatttctatggttaataataaataatgcattattgtgattattacttagatgtatatatttagtttaatattccattgtgacaattttataatttgccgagcaataacaatcataacaaccagcatgatgcaaaagttttaaaaagttcgaaattttagtgatttttattgtcaggaattttcagggtgttacactattacaccgggaaacgggagcctagctttgaccagagcgggaggaccgactctggctgggataagaggatgagaacctctcaccatcattatttgatgggacatgtcaggctgcacgccgcctgacacacgagcagcgcacaggcgcactacctagtcccatcggtcattcgaccggaaacagaccggttgagtacactgcacgccgcattaaatgcggcgtggcgcgaccgctcggatcgccataaatgtaggtaggtgagcacctgtaggcggacacctaacccaccgtacgtggtgacctagagagggggtcgggggagcccgagccctagtcacgggagggggcggtctccgcccgacctcgggccggatcccccctcgggggagggccacgtggcgcctggggcagccttctccctctagtctcgtttagggagtggccgccgccctacctcgggcccgacccctcccgggggagggccacgtggcattggggggcagcctcctccgtccaatctctaggagggagtggccgtcactccacctcgggccaaactccactcgagggagggccacgtggcattggggggtagcctcctccgtccaatctctaggagggagtggccgccaccccactcgggcctgactcccctcggggagggccacgtggcattggggggcagcctcctccctctaaacatgatacccttgcgcccatatcaccgacagtagcccccggcgttagccctgaccaaaacctttcccaggtggtcatggttgacgccactctgctagttagttgacatgtgggcccgatattctgtccaatcatcctgggagttgggcagtgggagtttagtcacgttcatacgtcgccttaacttcccactttcctcccggtttccgaggcgttgtgggcacgggagtttagcccgtaccttaggctgtgaacttatttcctgtatatactcagcaaacgttgttagattctctcgggcccgtgagcatacgccgcgtacctcgcttgcccctgccttttgttaacctctgttcgtgttctacttcatctattcaaacaattatttttgcgtgagcgtgaggactgaactttccatagctagcaatcttcacccgcgatcaagccaagctgggcgctgtagccagccggcggggccaaagccaaccactacggaagagccagcacagggggccccgggagtcgacggcgccaagagctcgacgcagggctaggagagagctaggaatcgtagcccccgcattttaagcaaagaatcgtttgaatagatgaagcgaatacaaactttttgttaccaagggatgcaagccagcacgcgacacgtgggtaccgcgggaccgctaggaagagataggcgagagataaatataagcaataatgattctatgcaaacgattatcttcgcgcaagtgcgaggacttaattttccatagctagcaatcttcacccatgatcaagccaagctgggcgctttagccagtcggtggggccaaagacagccgctacggaagagccagcacagggggccccgggcgtcgatggcgcccagagctcgacgcagggctaggatatagctaggaatcgtagcccccacacttatagcaaataatcgcttgtatgaatgaagcaaacacaaaccttgcttgcatgtcgcgacctttcaaatctttagctcgaagagggcctcccaccatgggttcctaaccattttgggaagcctgcgaccacttagaaaacaaggtgaggttcccacgagcctgtgtccccacgttacacattttgtttgctctttcctttcggtggcctccttccaatatctctctcttttacatggacgactactttcgcacgagtgtgagagccgaaaaactctagagccagcgatccctgtccacagttgagccaggctaggcgccgtaaccagccggcgggaccaaagctagccgctacggaagagccagcacagtgggtcccgggcttcgacggcacccggcgctcaacttaaggccggaatagggctagaaaacttagcccccacacttagcgaggaaacgttcctgtagatgagagagaggttgggctcttaccaccgagggaccaaacaaatgcgtaacacacgagcgtcacagggccatgagaaaagaacggggggaaaataaatataagactttaagctgtattaagctgatgaattgaaaaattaaaaatacttgaagcttgaaaggacgattagttgagccgggccgggcaccgtagccagccggcaggaccaaagctagccactacagaagagccagcacaggaagtcccgggcttcgacggcacccggagctcaactgcaagagccctccaaggtgtagaccaaggcgggtggcaggttcatgagcgatccctgcgcttggccctggagggccatagggaagaaattcgccttgacccggtcgtcgccccacgtcgcctctatgatcgtcgtgtggatctggagggactcagaggggttgacgctactgtggtaccttacggtgaggctgggccgaactttgggggtcatcggacattccgaagactcgcaataaagacctggccgccagtcttacccggtgaagatacggggggcctagccccctgcctggggtggtgcggcacttctgaggaggctgcaccttcccccgcattggcggcacgaagcttatcacgccggcgctcgaaagaacctcaaaaataacgaacgcgcccctacctggcgcgccaactatcgagaggtgatcctctctagcgggagatcatgagatccccctttttcggtttggccgagggcagcaggtgagatccgaggttttcgagataaaagagacacaagggatttatacaggttcgggccgctaagaagcgtaataccatacttctgtgctatgctccttgagtgaaggattacaagatctccttgttggagtaaaatgtggtgttgatcatccggggctagagactgctctagagcgtcaaatggatcgtcctcgatccctccccccttttacttggcctggacctcctttaatacctcaaggggttaccacatgggcccaaaaacctagctccgatgaagaagtgttttgcattaaatgcctgtcttgtctcttgacttggaaagcaagcgcacgtcatcttgatgatggggcctgtcaaatcttgctgcctgacatgaagggcgcccatgtcagctgcttttaatgagtgaagacttctgggctcttatttgtcgacccacgattttggaaatcggaaatcttttgtgtttatcagtaccaatccctagatcaatagttgggtacacacataaagccgaatcacaacatatcacgaatgaattcagggtaaaaaagt

SEQ ID NO: 75536 - DNA, 5090 bp, Oryza sativa
gggggagggccacgtggaattggggcgcaacctcctccctttaaacatgatacccccgggcccatatcaccgacatggaccaactataaacataagcaccgctttatttgaactgtccccaccctccgctcctgacgacgatgccgttgccccctttcctcccgccgccggccatccgcctccatcccggtcatgggcaacccttacttcgacctctccccgtaatccacccgtaacgatgacgatgttgtcgcccccttcctcccgtcgctggtcgcgcgcctccatcttcgacaagggcgacccctcctccgatccctcgccgcgctccactgccgccaatgacgacgctgctcccttcccgcactccttcacctccactagcatgatggggacgtgcttggtttccaaggatgacagcgacgatgcttgggaggtgagtagcagatcggtgttgggatttgttcttgtgtttgattttgagtagcatgttcctctccctaaccagtgacgaggagcaagcttgcctcaatgcggcacggctatttgttttacgaaatctacacccaatcagtacactggccaatgtcacctgtgacgggcccaaaccctcatctttgacagcttcgcgcatggtcagtgatcagtggtcattggtgagtctagtcacctttgacgggtggccggccgtcacaggtgacacccacctctgacgggcaagttactagaaggccgttagaggtgttaatctccgctagcctagggcgagttgggacccgtcacaggtgactcatctctgaaggacctttaaataaaggccgtcagaggtgatggtctccgtagatagaagctgtcacaggtgatctacctgtgatggccccaaaagtaatggcccgtcacaggtaggtcacctctgacgggcctttatttgctagtccgtcacaactgaggttacctttgatggatttttgttctgacccgtcattgatgagttaattctagaaaaaaaataaatgctaaatattggctagcctcaagatttgctagccatgccctctgaaacacagatacatcacagatatattctagtcaccccccaatataacatcacagatccatctcaaacatcacagatccccaacaacacagatccatatcaaaaattgacatcattcacatatgcagttcaaatgccacaattttgcacagcaaattcacaccccttgaaagccacaatttcggtcgttgctcatagaaccgcatatatacttaccaaatggattaaagccataatgtcgtcgacctccacgacctgtcaataaggaaaaaaaaggagaaaacaaatgaatagtacaacgtaaatcatagttgatcaaatttgatgacaatttagtaaactaccataaatattgcacatatgaaagtaaattacactgcactccataaaaacatattttttacatcacaagaaattataaaaacatcttctttacatcacaacaaattatctagccaagttcatgagtctatttgacgtgaaaacgtcctttcttgttcattatttctgcaagaatgaaggcgcacacttcacctctgatagtgggggggggggttgatgggtgagatcttgaagccatctctacctttctgtttaataaataagaggttagcacgttttgaatagcaatgttggtattgaaatgagcttattcgccattagcaacaaccttagggtcgaaatctttcacctctcttagaagtgttgacatgttgtggcacacgtggaaaccacattggtctccgatctgttgtgcgcatgcgaacttggtgtcatgataaagttcgtcgttgccctccttgtgcctaccacccttttccacatatgggccccaagccatatttaaggccttggtgatttcagtgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttgctctgggttgtgtgcgcacatgatgtactccttgtcttgatgggaccataaacaccggttgacatagtcaaccacctcagtgaagctctgtcgtaaattaacctcgttcaccatggatggatcaaggaacccaacctgattaccaaggcgacgactctcgatccaacacaaccttaaaacatttatgtattagaactaatttaattaggagatatagtccaatcatatcacaagtatagaaggtatgcacttacaaggagtagcattttagaagaccagtgtccaacttccagatcctgaaaaggttgaagaggtcatcaaagcctatagttatgtaggcaggcgacgataggaacggttggtggtcgtgatgtccaactatggatgactccctcattttccgcttcgcattgcttagctccatgtattgcttatgtagctctcggcaagcaatacccatcacggctaacacattgtcctccaccaatggcatgcttaactcaaattgggccggcgcactcacgaccttccccgctttgctcaccggcatcgacgtcgtagccttgcccatttttggctccggcgcaaactccccaaccttccccttgccgcgttcatgcttctggcccttgacaagtggtggggagctatcagcctttcttgtggtctttattggagccaagctttgagctatatctgccaagtccatattagctccatcaggagaatgaggtactgacaatgccggtccacggggagcctcaattgatagcttagacttgggaggtgtaagctccatcagtcgacttggatgaggagtcagtcatcttcacaactatgtcttctttgggccattgtatgaacatcttgcgcgaatcgcccaaagtcatgatttcatcattgggggcatgggcagcggatagcctgacaaggtgtcctttactgtatcgatggacaccttggcatacacagctagcaggtctgtgccgtggaccttgtctgtaaccgagggcttgaaagccatgccctcagcgacttcgggagcgaaagttgggtggaccctcgccagtaggacacattgtgctacgccctgtatatgcgaaagttggttttttattagatatggatcagataacatcaattacctctatgtggtccactgcagctagtggtgcgaccgggagaccaggggccgacacctctgtggatgcacaactactcttgtgctgtgacggactcgcgtcgtgttgtgcacgaggagttggatgcacagcaggtgttgtgccttggggtatattcatgtcggcgaggactttgttaaccctttcttccaccctagcgttcatgctagcttctagttcttgaatgacctcaaccttaagttcggccttcaaacaagcgtccctctcttccttggagacttttcgtttcctgtattgggagctgtactgcgggagtccattgtaacatcctgaaaattcaagacaataaaaaaaatcactaaaatttcaaactttttaaaacttttgcatcatgctggttgttatgattcctattgcttgccaaaccgtaaatgatcaccaagaaggtaaagaaaagaactacatttaagcaatagatatgatttatgagaatatatttaatcctacaaataattatgtgcaagatattaaaatcaaataaaataaaagttattattaacctattttatcaaatattaaaatatttgaataatataggtgggtgccataatacaagccggcgactcataaagttgattccatcgcactcgtcgtcaggaaactcggcgtttacccctacctggcgcgccaactgtcgaaacatgaattcagcaataataaaagggggtagcgctcgagacctaaaagtggatggatcggagacaaaggatttagacaggttcaggccctctcaatgagaggtaataccctactcctgtttggggatttgaatccgccgagtgtgtattgatctgacgattaggttgtctcatgccccctagagggcctcctgcccaccttatatagggtggggggcaggattacaagatagaaaccttaaccaatacggtatcggtttcctaaatctacttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacaacatgaaatgatgatcattcaaatgaactgagctctctgtatatataatagaattatgggagtatttaattcgatatgtagatcgattttgcaccaagttcctaattgcatttagggattgaaatttgatatattaaacccctccatataaaataaactaacatatagataaattgagctaatgtgctattatgttaataacggtctcattagaaaaaattatagaatctttaataaaccttaaaaacaaattggtaaaataaatataaattaaaaataaaagattaggtacggatagtaataaataaaatattatcgcgaccatatttggatcaattaaatttaattgcgatagaataagaatttaccctaattaaaactcaaataaattatataaacaaaatatgagtgatatcaaattaaggagaattttagttaggataacacaaatatgggataaacttcatttatacaagatttagaaattatgaaatcaaatttatattgaaaataacctaaaatcgggaataataggaaagtgcactattcattgctcgcaaggtgttcgatttggtccctaacctttccccttctctcccacctctgccctagccgtcccgagccgcgcgtcgccaccttgcgccgctcgcccgccgcgccgccgtcggcatcgtcgccgtcggcctcgcgccccgtgccgctgcctcgcgcctcgcgccgccgctgccgcgctg

SEQ ID NO: 75537 - DNA, 5924 bp, Oryza sativa
cccctcttccctataaacacccccacccctctccatggtttcccactctattcctttctcctctccctcttccccctttggcacgcgccgccgtcgtcgtgccgccgcgccgccgccacaaagtcaccgcgccgcgccgcgacttgcgccgccgtcgccatcgttgccgccgcgccgccgaccacggtgacgccgcaccgcaccgggtgccgcgccgcgtcctgagccgccgtcgccgtcgtcgccgccaccgccgccaccgatgagccgtctttcccccccccctccatctcgcgcccaccgccgtcgccgcccgagggagaagccgaggaaaaagagaaaggagccgggagggagagaagaaaggaaaaaggagagagaggagagaaagaaaaagaaaagagaggccggcagagaagagaaagagagggagagaaaaaggagagaaaaagaaagagagggagagcaaagagagaaaaagaaaaagaggagagaaaaagagggaaaatagaaaagaagaaaaggagaaaatagaagggaaattgggggagaaattagggggatttaggaaataaaaatggtcggggttaatcatagattatttttggaaattcctcgagcgtaatagtatttcgattgaaattccgagttaattataaatatatgtttctggatcagattaaattagaattggtagttatttagatataattaataaccaaacaattagatgaattcttatagattattatagattatttttggtaatctctataagtcatcggttcacggtagaaattcggattcaattacttggaatcttagccgtgtattatatttaatcgtttagtcatagactaaattaaattgtataatatttctaagatttcgtccgatatttagctcgtaatcgaaatttctaacctgttatatggatataatgctcgggatgagtaaattaaaaacttatgacaacaaaatatttatacccgaaaaatagtttaaatcgaaatggggtttgccgtagttcgcagatagtaaagttaataaaaaggaatcgacttttgcattcgacttttactcggatttaagtgaaacttgaacctagattcatctaaattcataagctttccaatgatatataattcactatttaacaaaatatatttataattataacttaactaatatcaaataattagatgatagttaacctaaatagtgtgccaatgaataaaaatggatgttgtacagtagcataattatctttaacatgtcttgtcgctgtagcaactaaataaattagttataatcaatccttcaaattaatggatatataggaaaatattagtaccagttattaatctatgtccaaatataattaaaacccacgacttattagttatttaaatagagttagccttataattattaggtaagtaaaatatagatacacatagaacggtcctaagcttgtttatggcaaataataacagagctagtgtgattaaatcacctatatgaaattaatcaacgacatatcccatataatagcatatagtaggcaaggtgagcaacccttagttaaccaagcagtaaatagaaactattcaaataaatgattcaatatactaagatattgtgcacacacatattgtacatcccattatagatatatggtatcgtattaatctgcttgttgcgtatattaatttagagggagtatatgacaaacatgaatattagataaatactagttatacatcttgtcctcgtataattacagatcaactgtaaatttggattattcattgtaaaattatgtgatgggataatccgtaaccataatatgattaacctaaacaattctaacatacaaagcatgggtaattgttaaccttttacaatttattttgacaagtgaaatatgtacataattaaaataaagcctccattaataaaataataatacaaatgattcacagtaattatttggccgatccaaaatccatccggcaacagaacctctagtgtataaccgtgctatgtagataaatgcatgcctagccataatccttccatagccatttgatagactaaaccaccgattagccaaatatatatgtatcctataaatgctatgttggttaactcctaaataggccacgttgacaatagaaagattaagaaaccttagcaagattggaatccattagcaaacacgaatagtacattttgttgcgcatatttgattgttgtttgaatattggtttttctcgcgtattatagaccttgtgtatcggttagtcgtgaggcaacgtcagcaacttccaggaggtgaaggttgatcaagaattacatcaagaataaggactatcctgagcaaggcaagtcatcactattccttgaacatgttgatcccaattgcgaaattgttttgtttacaaataaacttgcatgcaatgatgaacatcctactggtgattataccatgccttgattattgttcacctttaaatctttgtaaccatagatacgtacgagtccctagtcaactatgacacttgcttaggaatgctattttagattcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggctggaggacttgggtggtgtccggaaaaggctagtaccgtccctggtcaattaaggaccgagccatgaagttaagcatgaaacgacccccgtacaaccgcacttctcgtatgggtatagacctagcggaatagatagctgagcggaggcagtatccatgcatagtggtttcttgatgtgtgaggtaggggctctacggtggggcagccattggtagaaccgcgaggcgggtgtctacagtggtgtcgccatcagtaggactaccatgtgagaatttaaacataattacaacttaatgcatgtgtgagtctttccttcccgggtgcgccagaactcctctcactgctagaaaccgtgtacgcctagagtgcatgaggatttaagttcatggagcgggtactgccaatgcgaggttatcgaaaagctttgctgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggatgggatattgcatgatgaatttcatgctgatggagccacatcccgagaggagggaaggtggacatcctcagaaaaccatgacgattcaatggcgggaagctatcattgggatcacaatggatggtggacagaaccatcgttgtttaaagtgaacactggtactaaaatttgatcagtctatgctaggttttaggcttgtgaaaagaattgtaaaattagctttatgcaaaagaacctgaagccattccttgaaataccctctatcatatgcattgttattgtggtggcttgctgagtacggttggtactcacccttgctattcatatatcttttaggagagtgttgaagagaagcccttgtcggtacgcttgcgtatccaacaggatgatcggagtgcggtcttgttctaggtctcgttccccagtcgactgcctgtggcatgttaaccgggcccttatattatgttgtcttccgctgttgttctctgatagttgttggcctacctggccctaatgtaagtatttaactcttttagcctaaattcattcgtgatatgttgtgatccaactatgtatgtgtgtaccaactactgatccagggattggtacggataaacacagaagatttccgatttccaaaatcgggggtttacatccatgcttccagggcacatcgctaccaattcccctagtccggccaggatgtcctttggttccgagcgcctttgtgaggatgtcatcttcacgcctctttggcgtggactcaacatcgctttgtgaagcttgttcagcaaccaagcccaactagaaaaaaaaagagtcgtttatacgaacttctactttatacgaacggaaattagttaggttaagtagtgaactcaccagttcctgatagacgacagcatcacttttgttctcaaatgtgacagagccgtccgggttgaccttaccccttgcccgcgcccagttgcgagctctttgttcagggatgtctgaaaacggggcagggacattcgctgctgcagcggctgcatcttcttgggcccatattgcctacttgccgatgtaccatgcagtgcctagccgatgcgggtgctcattccgctgttgcagtaggcgatgtgcctcgcttgattccctaaactcttgggtgttcttgagagagcagaattcctcccacaccgcttcggttatttgagggtattcatcgaatggcgtatgattgccgggcgggttgacaaactcggtgaagagcttcgacttccaattcttccaacctttgcccatcttatggaatgccttccacttgagataatctatgtgtaaaaaaatgaatatggggcacaggggtagcagcagcaacagtaattcatcaaaaaagaacaagtgtacataaaaaaaagaacaagtgtagataatctgttcttatgcattaaaaaaagaacaagtttagaggtatttctgttctcgagcattcatcactggccatttaacataaggcaaccataggcagcagcatgagcaaacatagacagcaaggcatccaaaaaaaagcaaacatagacagcaaggcatctgaggtatttctaaaacagcagcagcaagggtatataaatcatgtatataaacaacaattcatgcaattcacctattcatagacaacaagggtatataaagaacaatttatgcaattcacctattcatagacagcaagggtatataaagaacaatttatgcaattcacctattcatagacagcaagggtatataaatcatgtatataaacaacaattcatgcaattcacctatttatagacaacaagggtatataaatcaacaagtgtagataatctgttcttatccataaagaaaagaacatccactgcagcaaaattcatgctaagatcctataataccaatagaataattcctctaatactgcattcatccaaaatctagcccctacattcatccaaaacatccacagacaacaaatcacatttaattcatctacacagcagcaccaacaatcgaaacaatagaaacaaatcacatttcattcatctaaacaatgcaattcatccatcgaaaaaaggaggaaggggggagggtggcagcgtacttggataaggcggcgcaggccgtaggcgtcctagatcccggcggcggcgaagacgagggcggggaggcagcggcgaagaggtcgaggcggtcggcgctgcgggccgatgtcgtcaatccaggcgtcggggaggtcggggtcagggaggtcggggccggtgatggacggacggtggcaaacacacaagggtggtggtggagatggcagcggagagggcggcggtggagaggttgaggtggcagtggtggtacagatggcgacggagagggcggcggtgatcggggatcccggcgtcgtgggggtggaggtggccggcgtcgtgaatcccggcgtcggggaggtcagggtcagggaggtcggggaagtcaatggacggacagcggagaggaccagcggcggcggtggagaggaagacgtagagggcggcagagatggcggc

SEQ ID NO: 75538 - DNA, 17898 bp, Oryza sativa
ggcaaatgcaagtacgtacgtctgttggcaatgtcattagatatttatatttaaaaactcatatccaatttagttcaacttaaagagaaatatgtcatattaatcggggccacattttctaacttttgtgtcatttaagcaattataaaactataaaaaaataattatatatattttatcatcgtatataacttgataataattaaattagatctaataaaattaaaatgaacatatctttgagtaatattaaaaaaaattagaccccccattataacacaataaaaagtacacatcttataaacactcctaagatattatgttgttctcttaaatcggagaaaatacactcttaagatattacgtcgttctcttaaataagagaaaatcctaaaaattctgacatgacaacaaaacattcgaccatcagcttcgacttaaacatctgacacattattttagtttattagattaatcatttagaaaaaaaaacatcccaaacctcccttcctcccagcccgtgtatagcctgcgccattcttttctctctattttttatctccttatcaactgaatttaaaattttctatatggaaaaaaacacaaatgggcctccatctattacttatatcccattaggcgtttcacgactttctacccactaattaatttctcttaacatgcatatgagggctatgtatctatacaaattgaccttgatacttttaaaatgatctttttaggagataaataaatattcataagaaagattatcataacatcccaattacacatatgatatatgaagttactaatcataacaggtatttatctagcaatatagacaatagattgaaaataaatgtgtggccggttgaatatcataccagtaagcatatgggttgcacctaggaatcttaacaaccttgaggtggcctttacaataaatcaagtcaattctatataggaattaaagaccatgtcattttttttaatttctggtaaattttgctacaatatattataaaatcttgacatagaacaatctagaaatgtgtatttgttataagatactccactttagtgatgattcgctaaacacactatgaccattacttcaatatttcttgacagaaaaatttggaatgcatgcctttaccccatgccatgttatatgcaattatattttcgtctcaaattgcaaatatcaaatcatttcaaggatgattcatataatgaaaatatccaaaaataaacaaaaataaaaatggacatgaaataaattgaaaattgagcaaatgttgctagatttaaaacccactctaaatagttagaatgataaaatatataaaaaactaaagtacaatcaatcaaacaattgatattgttggatttttttgagtagtaagatatcctgctggggagttaagatatcctaaattttcttataggaagcaactcctttgtttcgacacaatattttctcatcaattcaaaaccgtatcttctcaaataatttatttttgaatttatatgttgtaagggtaattataagaaaataaccagcgttcaaagcacacaaaataaatttaattttagtttagaatataataaaaaaatatttaataaaaagccacccacacataaatattcataataaaatttcacttacattatacaagaagatgtccacacgtatgcacgggctacctttctagtttttataacaggtaaagttaaaaatatagatagtcttaatgtattcaaatcatattttgtttttgtttccgaaatatcgaaccagcatcattgatcaatttctaaaaaatcgtctgcctagggaaactagactaaccgatttcatccctcgtgaatactagctgaagtggccatttccacttataggctataagccaactataagcttatgtagaggaaagagaatttaaaaaatggagagggttggctctcatgcaagagctagctattcacatacttcaagataaatacattaaatacataggtgagagatagagagaggaggagaaaaaaaaaagataacattatagctcatttactatacatgttaactctaatattagctataagctcatagttggctctattattaaacttgctcttagaaaagcgggtgaaaaattgaagtcgcctccccaacaagcctgaagccctatacttcattaattaattatactatacagcgattactagaagctaattgtattatcctacatatgcccaaataaaatattggtgtacaaggaaattgactaacaaacaaatgccctagcaccgaaattcttctcaaggagagtatgggtctgtttggtttatagggtttggtttgggaaaatgatcctatccgggcgaccgatgcacgaactaaatatcgagcagttactcccctcacccacttcttctccattccctcatcctcttttctctctctttcttcttctctatccacacaaattctctttatataggagaagctcagcggcgcggctgccacaaggacgcaaccgacctttgcgtggcatcgacaacggtagacacgctgacgggtcgagctctgtgtggcgtcggcaacggtggtcacacggatgcggtggagcttggcgcggtgtcaacgacagcgaccatgcggttgtgtctgacacggacaaactcaacgtgacataaacaataacagccacgcagttgcactgcatagacgacaacattgcaaattggacactagagaatgtggtaccaattcgggggcatgccggtgccacctcctcacccacggcaccatcccagtcgatgtggtggctaaccaccggaatggaggaagagatagatctagatttttcttttgaattttttaatgtttcagtatatgtaccataatgtttcatcggttagatttaaatgttgcagtggggttttcgatggtgtttcattctttttctcaatgtacttggatttttttcatgtttcactacattcgaaactgttgttttatacgctgtagtaaaatgttttattgtgtgatttgattatgttttactatcttcagtactgaaacatttttacgtaaagactgaaacaacgtgctcgatttgtagtcgtttcgatctgttttgtttacagcccaaacaaacgacacaaaaatattggcaaggacaagggcatagcctgggtacgcattggtttgtttccagaaaaattggtgttgctaacattttggcaagggcaaacaaaacatcacaagttacattcccacaattttgggcattgccaaaattgtggcttgccaattttttttaggcaacaatccattatatacttcaatataggatttttgggatctaattttgtacatctatcgactcttacggccattaccttttcgattgacctggccgagttcctgaagatatcgtgattattactcaccacacgttgtacacaatgatttgaaaagcgtatttcccttttttctttttcctatcccaattgggcatttggtaaacggagttcgcttccctccaaaatgtcatccacttccatgtcagtccgttctccggcgtccttccccttccccacggcagccggagcccgcggccgcgtcggctcggcgcagccggtgggccccaagctcctctcctcgccacttccgccggcggccacgcccgcggtgcctcgccggctcctcttcccggtggctgccggcatttgggacttcctttccggtggcggagcaggcggcgcggctgccgcgtcgctcgccgtccggggaggcatgcagctcttcaggcaggtgcgacgataagggatttttctttcacattcttttcccacttattttctgtaattacagataaacccctcgtctcagccaatatctgcttccgtaatgctgcgcggcgaagctgtttttgttattagcttcgataaattgcgtgagggttcttgaatttttttttctgttcgtcctatctttgcattacagggagatgtagctggctcagtagcagagttcgatcgggcaattgagctcgatcagcggcagaagaaatgtatgtatttgtaacacttcaaagttcagatttcagagtgtgagtcagcaatgtacaactggctgcaattgtgctttgtttcagatctctggcaaagggggctttcactctactacctggacaggtgcattatcatgatagtaactaggttcatagattctggaaactgaaccaaataatttcaagccatggactgaaattaaaccatgtgtaaccatctcttttatccttggtttaattgatcgaaattctgggataggttcgaagaaggtgcagaacagttcaggctggatgttgctgccaacccgaatgacactgaggagtcgatatggtgctttctctgtgaagctcagctgtatggggtagacgaagcaaggaagcgcttcctggaggtaagttttccagctaaagatatgttttctgaatgctagatttcttgatgtgttctacttcttactaatgaggtatggtgcgtgacgtgaagaagtacgtaattaatgtcctcaagtaagatgcaaaatctttgccacttctgtagactttcatggtcttatcaatttagtttgttggcatgaactaacttcctaaatggtgtttttactgtccattatacactatctttacattgcgtacttcattctagcaatcaaaactgaagctttcaaatctaatgaatcgttcataatatatgctgtggaaacatctatgcctccatggtgactgcagtacataacaaattcaaattatcaattgactaaaagtgtcttaagctgagatcagctggcagagtactaaacgaatacagtgctattgggcgtccgtactcacttgatgatgaccacatttataaatttcttaaaattttctatgcatacgacataacgcgtcctacatgtacaaatttctaatattcttcttgacaaatctctcccaaatataaatggcctgcagcactatgtgtaaacagcccacactaattgctggtaaatgtaaactttattgcgcttcactttcaggttggtttagactcaaggtctgtaatgcgagaagcttatgcactgttcaaagatggtggggaccctgaaaaggttgtttgatttgatgataaatgaacatatctcacctgttcttacaaatttctgataaacatttacgctagttttctttttcatcttcagttggcttcaaatttctctagtggttctgaaggtgaaattttctattcatcattatacactggactttactatgaatctcaggtacaattaaaatcacaaaccttcttgtgaacatttgcattcttattaggttatttacatattttctcatagtttttttactgaacttcccccagtacaacatttaacaggttttcgtcaacgctatattttctttttgctttgtgggatgttttctattttataaatatatccattgtagtccttggatcactcacacatatagattataattgatgcatagccagttgaatgaaatatatataccggaaacacgagcagactgagtagttctaaacatgagcagttgacacatcctgcaagtaggtactaggtagtgtcctgttcttctcttatccatggcaatcgcaattaaaatttaaaaagtctctttactttgtgaacattcagaacattgaactactactactttgattctgtactgaacagaaggatgcagagttggcaaagtcccacattgttgctgcatgcaggtcaccatatggatcaaggtcttccatccccacctgttccaaagtacagatatatttcactaactgtgcagtcttcagccatactgaattaacaggataattcttggtttaggtccggtgattacatggcttcacttgcactagttcattgtcaatgccgcaactggactctggagtgacagaagtattatacaaacaagtggacctaaacattcttgttgaagccaacagataggaagcatcttgggtatgttcttcccatggctcactgtatttaactggacttcttggtctcaaatttttgtagatttggtaaatagcacattgccactcacagtcaatgacgtaacggctcttatgtgtctatgacatgtagatccagtaacaaatcctaaattgtcatttgtaagagtggcaattagttaaatatctcgcgtgatctggactcttcctcttctttttttcccttttaacgagactgaaatggctgatcaaacacggtggaagcattttaaagattcaacctctgagaaagatgagaaatgaaaccaaatcaagcgttgagatgctcattgaatgaatctttattttcataacatttcccatgcttgttgagtaattcttccacaaagtaagcaacttataatcagttgatcggtggttcttcgtccagaagaacagagtgagtgaatcaccaagtatagttaaatgattctgaaagtctgaaccattatttttttaattaatacatgtactgattcggaagcctaaaaacagtatatattttcttgacatttaaacctcactactacgattcatttgtttggcacatcagacatagcacccagaaattttcagtgcagaaatcgcgcttgttcatgcagaagccggactgcagccagggatgttggtaccagcagcgcagccgctactagcagtagagcatccgcccaaaacttgagtagctggcctggacggcctcctccaaacaagagacggtggccttggccactgacgcagcatgaacacagcgtagtacaccagaagccctgaaactacgcacgacaccgaagtcatcgcgcacctggagactccatgctcatccatggaggccgccaggtagccgaacccggccaccgccccggcgccgaggaagacaactagcccgtttctgttcgatttgatcgtgtccacggtgataaccgtgctgctccggtcgatcgaggtgaaggctggaccagagaagcgccgggacaagctccggcacgcagagcagcagcacaacgttctcgccgagcagcttggcggccatggcgtgcacggtcaccggccagcagcaccacgagcgaggccttgcggagcagctagctctcacgcgacgccggcgcgacgcccggagccacgccggcgtcgtacagccagctgagcctcgtcagcatcaggaccagcgcgcccagtgtggcgctgaggaagaggagaaactgggtgacggcgaggtccgtggcgcggtccgtgccccgtcacacatagcgcccagtagggcacaaccgacatcgccgtcagctgctcggcttcctcggccgccgtcgtcgtcgtattcttgttgccttcgcgatcagttgcagcagccgaactggcactgctgctgcttgcgccaggctcgccgccattgtcagcttcagctcggatcagtgcgacgcacagcgcggcgatgaaggcgagcgcgatgaaggggaagacggcgaggacgatgaacctcacgtcgatcacgagcagggtcgcgtaggatatcaccacgacgatgaacctcacgtcaatttttttcggtgtagttgttgggattgagtaagaacattctgtatatttctatgttccgatattgttagcgtgtccagctctgccgttccaatactgtctctgagaaaaaaaatattgtaacggaaatttgatcattctttttttccgatcgttctcattctaccgcatggagatcgatctttgctagttatgctaggaaagaaaagaagagagcaatccatgcatcttcctcccccattcctgctctctctctctctctctctctctctctctctcgcattcggtcatctatatatatggacagaaccatgaatgtgatagataaaatccctgcatttaatgtgccataaaccatatccgaaaaatgtaatgcaaatataaaacaaacgctcgtctcggttacattcatggcatcatgatatgctagtagtactagctatgcagagtgaaaagaataagtaaatcataattctaatatttaatttgaaaaacagatcctagccccaatgagcaaaaatgattaatagcatacgacaagacaataggcaatatcattatgaaaggaacataatgaaatcaattaaacaccactactaggactggccctggagaggatcccagcgtgagtaagcaaaacccatagaattgttatcagctcacctcctctggcaatggcccttctatgagcatcaatattgtcagagggggcaatgtacaatatcatctctgaccaaaacccagcaagaaccgtccatcccatctcttcatcctcaattccctccacaagttgcttcccaagagttaaacctttgttcaatatcatatcgctcctggatttttcaaccaacaatagtaatatgtactcatattccaaaggtttatcattccggccactgaaaatgggatcgacaatcttcttaacagattcatatgatttcttcgaccatgccttgtcatctggcagtagctcagaagcagatgatagcaagtatgcacagtactgtgacagataagtggcggtgatcttattgctaattgagtctgcaatcaaaggctcagtcgaatgcctgatctcgaagatacaagttgcaatgtgccatacaagaataacatcagatgtgccatctcctttgcaagcccatgaaaaactcttgccgatatggctttgttggagtgatgtaatacaatcagttggtctccagttttggcttttgagagtgttgataattgcagccttcacctctgttggtatcttcacttgcttagtttggactggcagtccgagtagttgtttaattctaacaattggacctatattcatgttggtatccattagggaggtttggcccattttgtcactccagtagcccaagagattgcatcgaaattgtagtacgcaacgaatcaatctccgcatgcgaggagattgctgccatgtgggtttggttatgtagtagcaaatcaaggtaactttggtccaatttgagcacatgtatgagacaatctcccatacctcatcaaaaattagtactatcacaaagaggaatgatagcaccatgaaaaacaaaatcgatccgaactgtttggcttgatcattcttaccgcatatcaacacacaggttatctgatggtagaatggatctgatgacattggcccaacctgtgctaccgaaaccacatgttgaatcgtgcgtattgcaataaataagcagcatgctgtgccggcgaaggagaataagatgtttaatacgaataaccagaagactgaacaggatactgggagcgatgaatggtaaaaatcacatgcaaaagatagctcatccgcgacaatactgacaattctttcaggttcagtgtcactatcaaataatgtgcacaccatgtttgggccaatctcagatccttcttccacaactacacacctcgcaaatcttcgccgcagcagcttgaacagcgagaatgataaacacagatctttgagtggcggccatgagctcaaaacaccatccgttgatgacatgatctgaactttaccgatggtgaccaggctttcatttcccttcctgtctctaaatcgatagccatgagggccttcctccacctgctgctcatcctcccccatgactaagagtggcaacgcaacatttacagcttgcgcgtggtggctgctgctgctgctgctcatgatatcctgtttcagttgatccatgtatccagcaatcaggcgagggttgcgtccatgcgcgaacgagcgttgcgccttcaagaaagcatataacttgacaacaatcctgacaagaacgaagccacacgacatcgaaatgaagacacggtcaagtggaaaaataattctgaagtggtgaactgaaatgtaagaggtccagatcgcacgaacaagcagctccgcgacgggacgatgaacattttgacctccatggtcatcagcagcagctatcacgaagctgtttgctccgaaaatcagcgcaaggatcgcccatgcttccaggaagaacgcactcatgtccttgcattccttgacgtcttttggcaggccgcagttctcaccgccgatgtcggagacgaggtaggagactacaggcaggtacagggtagaggctccgaggaagacgaagcgggcgaaaccatggcgccggtggcgacggctgtagacgcctgatcctacaaggatcgtcaccacggcggcagcgaagatcaactgacctcgcgtgcgccacactcgcgcctgcatgcgcttgtagaactcatccaaccctgtgacgtcgcatgcttctcgaggccctgacattgacatcgttgagctgttgtttctttatctgttagatctgcatatacatgattcattcaagagttgcctcaaaaactactatatttggccagaaaccgaatgagaagtagtgtacaaactaataaacgagtaatgcaagagcaagaattaacagtttgaggtagacagtcttaggcttttagctagtcggctcagattagccaatcaaatctaattagcaatttatcactgaactagaacaccatagatcgatcgatgtcgtcgttttcaccttacagaggtgttatatatccaagcaattaattaatcggaaggttatgagaagagaaattaagaacgaacgtacgtatacctacctgcatgcagttcaacggatcacttgaatcatcgcttcatcaggacaaaggatccacaagatcattcggcaaggtcaaggctatcgatcaaggcaagaaagtaataacgtagtacgcggcaactgcaagcgtatgctacggttatcttatctcgacttggagtattatacacattttgtttgctctcttcgatcggtccccctgttatgctacaacagttccgtactatcaacacctcaactcctcaaggtggcctctgtgatcctgtgggtgcttcctgaatacgaagttcagcaggctggccgtctcattccgtacacccgtttgaacaagcaaagaaacagcttggcccctgtatgtccatcttccaagtaatcgcgtgcatcaatatcttaattaggccaatagaccaatcaaacttgcctctatttcaagagagagagagagatatatataggccaacttgccggtacacacggagagaaacagaaagtgtaacattgataaaagtcaacggtgggtaagacgggccagccatgtggttttggaattaaatttgaaaatatactgactttttttcagaaatatacgggatgcaaaaaaaaattttaagagatataccacccgcacaaccgttatacgaaaataacgtagtgcgatgtcaatccaatgagaaaagtgcgagaccgcagagtgaaagagcgagcctgaacggtctcactgaaccaatcaacaacaccatcccaacggctccatttgattagtgattaattaactagttaactattaactaacaacaattagtgattagttatcttgattagtaattaattaaacgctaatctgaataattaatcaatttgaaatcgctccctggttcagcgagactgtccggtctcgctctttcgtttcacaagactacgtgataccattcgcgatgtcacgtctacgttattttcgcgtaacggttgtacaagatcgacaatatatttctacaaaaaattttgcatgccgaatattcctaaaaaaatttgaatgaataatatattttcaaatttaattatgtggttttgtgcgacagagagcccgagatggacttgcatgccctttatgtgctcgctatgtgtatctgtttgccactagcagagcggccgaatttggctgtaagtgctcaattcacaaaattttcgagttgacaatgacatcgcggcgaagtgatcaaagtatatattctgttcaaaacttgttttgctgccatgatccgtagtccataggaacaaacaaaggcacgtacgcgccaggtccatccgattattggctcattaactcagtacagtttgaagcatgtttccgttggattcacagcgatccatcggcaaggccgaattcacaggccttcccctggaatgggccgacctaaaatatcggagtgcatgaggcatttcggccttatcaaacaaaaccaaggattcgcacaagtcaacccacggataattgttagcctatttttaataagtccacttgccatccctcaactatatgtcgagcttctctccaatactataaatcttcacctctaacctatataaaaccgtgcaattaggtctcgtagtagtatggatatctagtttcgctgacgtggcatcctagtcaacaaaaaatttaaaaaaaatatggggtccacatgtaagtgagaagaaaaaagtagggcccacgtgttagcatcctcttctttctttttcttcccaagcttgggaaggaggggagaggtggtcggcgggagagacagaaaacaagagaggtgatgttggaaacatagacttaaaacacatccttagagcaagtttaatagtataatcagttactagctgaaaaattgacacaccatatacaatcactttaatagcttacccatacaactctcttagtacaaagttatactcactaatttttaaagcttaacatgcaaagatgccacatcattatccactaataattattacatttaagcatcatacaagtatgctatattatctataatttaataatttattaaattttagagatttaaaatataagcatgttaaatcatcccacataattcacataatatttcaatatatctctccattatttctttataatatctcatattcctgtatagttcatcctcacttagattatttatttttcttttatctcattaagtcagatcacattaattgtttgtagtccttaaatgattaatatatggttcaaattatctctcttattttcttctctcattaagccatataatctcaattttttttagcccttatatgtatagtctaaattatctttcttttttcttctctcacaaagttacgtcatcttacttttacatttgaatcatcattaatctctatttttttaagccattagatgtatgggctaaattatcttcattcttttattctctcataaagtcatatcatcttacttttatcatcttacttttacatttgaatcatcattctacgtactatttaaatttaaatcgcatcaacttatgtaaacttatgtttatgtaagcttacgttgtttaaaactatcttacgcactatcttttacttattattatcatattaaacttctgcggcaacacttggggtttcacctagtagttttatattaatatatattataggcacacctctcatacacatattttggaggccatgctgcagttggttacaaatctatagtatatttttcttctctctcctttactctctcctccatccgtgcttatagctcacatatagcatgttattgtagttgctcctagtatgcaatctactactcttttccaacttttattccctcatttttcgagcacatgttttccgagtcattaaacggtgcgttttaaaaaaaatctatacaaaattcttttaaaaagtttatatttaatctatttttaagttctaaagcggatacttaattaatcatacgctaattcatcgtgtatttttccataccagagaaaaggttaaacccaaacgaacacagacgtggttcaggttacaagctccggatccaagctatcaaatccttgaattttggagctgacacgtgacagtgagatcctatagctgcggagtgatcaaagtctcatttgattggtttactaactccggacagttgaagatcgatcggccatcgagcatgtgtttctattggcatcacgcatcaccacgacgacgacgacgacaggaaccaacatcggccggttcgagcggtcccgttcgcagccccaacacagtgtatcaccggcgatgccgacgaatagtatcatgggcccccagactcgagggaacagtgccgaaaacgaagccctacttgaatccacagcccatcatccaaatactcgaattaaatcaatctacttgctttggtttggtgtccacataccatccaaagttatggctgagttcgggtcgcacgaaaaacgggtgttaacccattaacatgtgattaactaagtgttagtctaaaaaattgaaaaatggattaatatgatcggtaaccgcgaccgtcgatatttgaacaaaggggtccatctattcgaaggaactcacatgaaaaaaaaaatctattcgaacgaacatccttggccaatcaatcctttttcctttcggggaccatccatatatgtccctttttggccgtccacaattgtacgttaagtacgaagctcaagctgtggccatgaagaatctcaacaattgtggtcacaatcatcctcacgagagtacattagtattttgctgttgcggtgaggctgaataggaaatttatgttactccttgattataaggacgcaagtgggtcaacccgtgaacccacttatatagaatacttcatccgtttcacaatgtaagtcacattacttacattgtgaaacggagggagtaattaagtaggttgacgtgtgggttacccgcttatatttatgctataagtgaattggtcggtcgatccatttgcagttttacccgatggctttggagatgttgaatcttgcttgtatctgttggaattctgctcttactaccttgagcaacatctgccctgaagtgaaaagtgaataaaagaacactcaaacgatgtcagttttggtccgttctcagctagctgaccacatttattggttttcggtgactgattccttcccacagcgatttgatctttacgcaaactaagaccttttggattttggaaagcagagttttccttttttttttcttttttttttttgccagaattgaacctagaacctttttcctatgaaattcatgcacttaggctatgctgcatttgtgatgcaggatctaatcagttacgagaattgagaatctttactgaccttagaatgcttttcataaaagttttgaattcaaagtagaaataaaccagtgccaaacgtagtctaggtgtgatgaacaaataaattctttattactttcacttttatttcagaatgaagaggaacgatgtctccttctgaccatcattccctcacagggggcaacatcgatgtacatattcgaagaacaaaaaagaaggaaataaaaaataaaaggacaaaaaaagaagggtgtgagtgagatcaacggacctctgatcatatggatcctaccacaatcacaaacagataaggtcgacatgatcaatttatctacgatacagcggcacggagaaggagcagacggagtcatcagatcgccacaaatccatccctcacattatcccatcatcatcatcttcttcagatagggcccctcccctatctcatcctgataaaccaagaaacctgtatgatctggaaccattggtggtgtgtgctttgtatgtagtatgtactatgtacatttggcgattgggggtgagcaggatattgtcagccatgtagcaatgtggatgcagatggggacgacaatgtcattagcaacaatgcagcctcctccacacccatcagaagcctccttttcggaacaacctgcaagttgctgctgctatttccactcccactgttgcagttgttgctgttgctgttactgtcttttacttcaggtattacctcaccatgctcctgcttctgtggctggttcaggtccagcccaagatcctgcctcctcttcttccggtaccggattccgcaagcgttgcatagagactgcgataagaaattgaaaaataaggatcaacggatcgacgcatctgaatttattattgcaaaagggataacattaagaatcacctttctgccaattattggctatctagttactttatttccttagtgctacacgtgcttttgtgcctaatgttgctacgggatggaattgaggaaaacattaagggtggaaatgaaaaatattccaattagagaatcgaaatggataaagcatctctctctctctctctctctccatgtacacaattggtttggtggttagctctgttgcaaggaacagctcaactaaccaacaagttgcaacccagctgaatggagagaaatgtcaacaagattagtcatgatagattggaccaaaacaagaggtcaccaccaccccctgtgctaaatgcctaaatccaacaagacatcaagtaagcacagactgtcaacagaaaacttgatattttctcggagtctatttcaagtatatatatcattgtgccactaaaaggggacttgaggaaactttcgaaagcgtgtttgcgctaatgatcttgttgacagcgcattgattaagaagctaaacaaactgaaggccaggggcaggttagatatggacatatggtggaatgtggtaggaactttctcctaatgcaatgtacttagttctctagctgtctatgattaaagtgaagggcacaagatagcctctttgactcggtctttgcagctcatatatgtttccattggatcatccaacattagaatcttagcggtactactcaagtgcaccaaaaatcagtttagcattctctaaaagcatctgctaattattttttaccaaaatacagaaaaaagattagcatttcccgattagaacagattgcactaaagaaaataaatacctgttagtcaaaaaaataaataaataaataaatacctgataaaaatccacaaaataaagatcatgacgtccctaaacatccatatttaatggatcaaaacttcgctaggacaaagtaaaagttactaatagatgagatgatcgaccatgtagcacagattgacagcatgacacgaacaaacggaacaatcatttgcaccacaagagcagagataaaaattaatatgcatgtatatacaagtacaactactacgtcatgatcatgtaatcgatcggcagtccagaattaatccccaatcaatcaatctgcctgactctgatcataacgatgatgaacacagtaaccgaagaggaaagccaagggaagcgatcgatcgatcgatcgatcaagaactcaccctggggccggtcgggccgctgcgccacatgggcgtggtggtggcgcggcattcgacgcagctcctcctcccttcctccgccacgccgatccccaccacctacatgatgatcaccaaccaagaaaaaattgaacgagaaattgatcgagcccagaacacacaaacccaaaactcagattacacaagctagggaaacaacggagagagccgcacgcgcgcacgcacgcaccttccgatcggtggagcccatccggattaacacagcgttggttggagaagagaatcgttcgtattttttctctagttcttgcttctgtgttgttgatgaagcgtgtagtagaggaggaggaggaggagagagtagttgtggaggaagaagacgagagaaggagcaggagaaaggtagaggcttaggcggtggagaggtgaggtgaggaagacgtatgtacgccgcgcggcgcgcgggatagcggaggaggtgacgtggcgttggcggatggacaagggaagatatggctgcgattctggtttcgtttccgtttggatggtaataaaaagattttgtaacattggcg

SEQ ID NO: 75539 - DNA, 13552 bp, Oryza sativa
aaatgagacccctacatcggaaaaaatgctttttctagtagtgttagttgtactagtatagcaagcagagaatgacatgatcagtgaccactaagccatgcgtgcaattcgaaatagaagcacagcaaactgagcaaggctagagcggatcaacaacctcacggagcccagaacaatagcggcgtagggacggaggacgaggttgaccggatatgactgttcctgctgctcgtgcctggcttcttgcttgaccggattgaaggctatgctatttcttggctgcttgggtgtttgcttgaattgacaacgatgcttgctgctgctagctgctgattggcgaggccgcgaagatagatgacgaccgcggcacacgggcggcaacaaaagagagtgctagttactagttactgcatctaccaaatttctgtaattaactgagtaggaagagttggaacagataatatctgatattgaactaactgaggagacagatgctatcctttgggcctttggcctctggcttaatctaactgctttttcaacaaattcgctctatagattgctcatatccctctgaaggtgaaacattttcactggcttgcctgtatggataggatcgaatctacatctcaactggtaaagaaaaactgggagagatctgaacttcgtgtgctgtgtaatgacttagaagatgctgatcatctcatcttcagatgccttttagcaaagttcttttggtgtgtacttagagatgcttcgatttcacaatcaattcctagttcttgtgaacacttcttctatgatgtagtaggccatcctagttataaacagagcagaggagtgatgatgctgctcggggctgctgcttgggcctagtggctaaacagaaatgttttgattttcaggaagaaaattttaaccacccccctgactattgttttccgtgtaacgttttatctgaggcaatggtctaaattgatgaagtaaaatgaagaagcggaggctaaggcgatcacagcgaagattttgttagctgttcaacttttgtctgcaaattgaactggagtcggctaaaatcttgaatatcgtcctctgttcagcagttgtagatgttttctttcctgtagctagttcagacggtttgtttggccaaaatgttggctggattgctcgtcttctttaaagctggtctccccagtgtaatttgagctgtgtaaactctcaagctttctataaaagctaggccactcaggccttttatgcagaaaaaaaacaggcgacaacaaagaagtgtcagccatgagcagcaggcgcgctatgacgacttgatgagaatcatgagatggaagatggctccgccggcggccagccgtggccgccactgtcgcaccggctatgtcagggcttagctagggttaggatcaatgctctcataccatgtcactatttgaaggaatcgggaagcgaaacgttagattggatttgacataaaaggcaatataaattgtgtacaatatatgtgaagttacgactctatctttgggagtgcatcctatacacacagaccctcgcgtgtacacaccgtgtacaccaactaaaaattataaaaaaaataaaaaattcatacatatacttctaataatattatatttacgtgcaaagtcgcatcttcaaatttattctacatagagagtaaaaaaaaggataaattctggtagaattacaaccttaaaactgtcagattttttgtttttttttgttacggtcaaaatataatgaatttgaggttaagattttgtccataagtgtaatactatgaaagtaaatgtatgattttttttaaaatttttgtgtcaattgttagttggtgtgcacgtgtatatacgtgagagcttgtgtgcataggatattgcctgtagacacacacttatacttaacaataattattaggtcgtatttctagagaaacataatagtaacagagggagtagtatggagttattgccacgagttttgccatgatctccttggatgttcggctttaaaagagaacactaaaacacacaactccctgcccaactacatagtaaattattgaaatttaaagaatgtacctccggtcaaaagtacatgtgagcccaactacacagtacattattatgtacctcgggtcaaaatgcacgagtaaattaaggttcgttaaggagtattaaaaaattgaaaaaaaatcagcaaaatagattagtatgtgataaatcacttcacaaacacgtaaattcaaatttaacttctgtaagtaaaaaaaaattgactgtgaatatacattaattagctatagtttaattttttttgtaacttatataattttaacttacatgtttatgtactgatctatcacatgtcaatctatcttgttgaatttgttttttcaaacttgctaataaataattgaatgacaagcaaactacggtgcgtctcgaacgtttagaatcccctgccgtaaaggagatcgatcccaatgtaaaaggtttgattccacaagtatataaaagagaacaatgaaagataacaagtcgctaacaaactatgtattgaattataaacatttccaaaattgtacctccggtcaaaaaatagtacatgacacctcgcagcagaatagtccacaaaccaaccttgaaaccaagaaaacaaaacagccacaccagattaaatattcagtaattaaggaggaaatttaaagaataataattcagccacaaaaccaatattttggaaaaaacttgtgtttgctgattacaaattaagtttcaggttaattaaccaagttttgtttcagtggaactcttcgtcaggcaacgtgccggccttggcgccgacgttgaagaactcgatgatgacctcgagcgggaggcccttggtctcgggcaccttgagcgccacgaacacgagcgcgacgcagcacacggcggcgtagaaggagaacacgccggcgagccccacggagctgagcatgacggggaggctgtacgtgacggcgatgtcgccgagccagaacgtcagcgagcagatggcaatgcagagtcccctcaccctcgtcgggaagatctcggcgcagaggatgttggggatggggccgaaccccatgacgaagcagcagaagtagacgatgacgctccccgtcgacagcgccgcgtgcgcggtcgccgccatgggcacgacgttcgccaccacgagcacggcgagggacgcgacgaggacgggcagcgtccagaggaggagggcgcggcggcccgaggcgtccatgaggcgcatggcgacgccgatggacgggagcatgaggagcgtggtgaggccgctgatgaggatggaggtggagtcgccggagaggccgaggctggcgaggaggacgctgacgccggcctggtcgaggatctgcggggtgtagtagagcacgccgttgatgccggagaattgctggaggatctggatggtgacgccgcagaagagggcgtggcggacgcccggctcgagcagctcgcgccacgccgggcccgtcgacgccgccgccgccaccgcctccggcgggttcgcgaacgccggctcggtggggctctgcccgatcaggacgtccttggtgtacagcatcgaccggctcaccagcgccgccgcgtggacgtacgccgtggactgcgcgtcgccggcggcgcccgagtcaccgccgggcgcggcctcggactcctcgtgcaggtacatgcgcttcaccgcgccgcgcttgacgccgtcggggcccacgttctccgtccacttccacgccagctgccacccgccgccgatgcccatggtgctcgccgtctcgacgccgccgccgccgccgatgctgctgtgccgctgcatcgccacctggccggaggcgggctcgttcttggtctccacgtcggtgctctgccgcgacagcagcggtgcctgcaggccgccgccgtcgtcgtcgtccttgccgtcgtcggagaggtactcctcctcctcctcgtcgaggtcgtcgtcgccaggctgcacgttctcctcgtcccagctgctgccgccgggcctatcgttgacgctaagcatgctcccgaggttggggaacagcgtgctccccctcatgctgcggtggcgccgccgccggactccggcagccgctcgtggacgctcccgagaagcgccaccacggggtccttcatctgctcgtacatgctgccatggcgcgacgcctgcagccccagcgagctccccagcatgctgccgcggccgccggcgaccggctgcgccacccacgaaagcccctgctccggcccgtacagcgtgacggtgtccctcgcctgctcgttctcgccggcgtcgccctcggacgggccgacgacgtagtcctcgatctcggtgtcgccgccggtgccgaggccctcgacgagcagcgccatctcgccggagacgtctcgcggccgcgcagcatctcgagcacaaccctggcctccttcatgcgccccttgctgacgagccaccgcggcgactccgggaggtagaagacggtgacgaacaggtagagcagcgaggggacgaagaggacgccgagcatgatgcgccagttgggcgagggcgagagcgtcatggcgaagatcatgcagtaggacatgaacatgccgccggagccggtgaactgcggcagcgtgttgaggcggccgcggatctccggcggggaggtctcggagatgtagacggggacgagggtgacggcgaggccgacgccgaagccgtcgacgaggcgggcgaggaggaggacgtagacgttgggggaccagagcatgatgaggccgccggcgaagtagaggagggaggaggcgatgagcatggggcggcggccgacgaggtcggagacggggccggagaaggtggtgatgatggtggcgccgatgagggacatggcgacgacgaggccctccacggcgggctgggtctcgagggcgaactcccgcttgatgtacagcacggcgccggcgatggtggcgttgtcccatccctgcaggtagttgccgatggcggccgccacggccaccaacacggcgcctctcatcgtacgtggcgatcgatcgatctcggatcggtttctcagagaaaccacatgaaaaagcgcgagagggattggatgattttgtgcaaccaacagggcgggtgtttgggtttcatgcacccgtgtgcgtcgcacgcgaggctaacaatagcgcctagtgttgctagctagggccatccgcgccgcgtcgaacgggggatcacaacaatgcgcaagggaaacatgcatgcttgcatctacggttttgacgaattccaccggtctccacgtacgcctaccgacgcagatgttatatgcacggtatactatgtaaaagagaaaatcccttgtatatctctgaaaatcccttgtgtcccttgtatacctagctactaccaatgtttacaatatttctttttatgaatgttcccgatcgaaaaaatccattgtcctattaaaatttcaaataaaaattttaatttattacatttattttatttccaaaatttatgacaaaattttctacaccaattatttagtctcattagttttataaaatgcacacactgtgcactcaaacaaaatttttaattgtttttaagcttatatttaaacctaaataagcataaaggataaaaaaatacatttgcaaccaaacgtaacagtgaaattatggaaaatatgacggtaagagcatggatgggatcaagttgaaatttcaggggtatagaaggggtcgggtaaatttcagaggtacgaaagggattgagtgagttttcaagggtacacggggaatttactctatgcaaaactagaagggaagttatttttatccctcgagggatgccccctagttgtttttatgtcactcaaatagttacgaaaaaaattgaaaaaattgagaacatgtattaacatgtgatataacactccacaaacatgtatgttcaaattcaacttctacatctcataataaaaaaaacaaattaaaccgcagctagctatcgtatattcacaatcaaatttgtttttttcgttgtatgcactagtatagatcctctcatctgtgacggcccgtcacatgcctgcattttccgggctgtcacaacaaagtgatctcaaacaggctcaaaaagaggccgacaaagatatactcacacagacatgttagatgcgcataaaactctagcccatcacgtatggcacctattggtgatagggtttagtttaggaccgattgagataaccggtgaaatctttgccgggccctaatagaagcccatcaccgttggtccatcatcaatggcgggctccaacttgaggcccgattgagataactgttaggcccgtcaccgataactcaggcccaacaaagataactaaaatacctgtcactgttgtaagtttttttggccgttacagatatttattgcacagtataaataccccaactacctagtttaatggttatctcactgttcactgttttggtgggagtgtgagcacgacgatttttgtctcttttttccaagaaaatcataaattgcaaaagtaattgaaaaatagtggtcaattctcataaatttagtaaatacttacctgcaaaatatatatctaatatttttccaccttttggcagctcagggatcgatggatcgaagttggatgtataggaaaactgtgcgacgtcataccaaggagtatagagatggtgtattgaattttattaatgccgtggaggaggataggaaaagaacaacgattacatgtgttgtccatgcgtagattgcaaaaatttgaatatgttagatagcagagtggacgtatacgctcatctgataaaaaaaggtttcctgaagggctacacatgttggctgaagcatggcgagcacactactagaaaaatgatttttcatggtcgtatcctattattttcactggcagtcatatgagaaatccgcttgtgaaattcaaacgagagatagagggtttagaaccacaattgaaaatccatttttgctggcggtgagtttaggaccgcaagtgaaaatccatttttgctggcggttggttaaaaggtccattagcaaaaataagcctattttcactagcggcctcttaacataacgtcagcaaaaacggattttcgctggtggtcctaaagagcgccacccttgaaaaaaaatcacgcgtgctttaaaatatcacagcccattaaaaaatcgccacccaccactccttatcaacctacccatccttatcctctcattcctcctcctccctcctccctcctccctccagatccaccagatccaacaaatagcaccctctcctcctccctccctcggtggcggctctaacggtggttctggtcctcgggtggcggcgcgcggcggctccagcagctgtgtgtggcggcgatggcgacggaaggagagtgcgcagcggcgacaatagcaatgcatgcggcggtgatggcgacgaaaggcgagcatcggttctcgggcggtgacgcgcagtccctttgcctccctcctcttgccgcctctttccctcctcccttctctctccaccgccaccagcctcccttccctctccaccgctgtgtgggggaagagggcagtggcacggggaaggaggtgtggcagcggcgtggcgtatggcgcggcggaggttcttgacagcaagcgggcggcgccggagctgaggacaggcaactacgacgacgacaaccacgaacgcggcggcgacgacgacgacaacgacgctaccggccgggagcgtggatccgccatcgactatcctcaggagcatggctctggcggcggagaggctcccaggcggtggatctaaggtggccgggctcggcgaccttgaccacgcacggttactccccaacctctatctcttctggatctggcttggggccgaggggaggagaccggcggcggcggcaacagctgctcctccagtcccaaatctggcagcggcttctttatgcatttgatttgaatttggggagcgcttgggaactacggttgctagatgtggatttttctcaatgcactatcttcccattctattgcagatttatttgatgtagatgatttatgtattacgtaatagagatgatgtagatgctttgatttgtatgtcatgtttgatcagtggaaataagcagcaaaggaaatgctttgatttgtatgtcatgtttgaatgtttgatttgtggaaataagcaggaaaggaaatatgcgcgtcggtatttttattttatttttattttttgccaaaatccatcatcacttgaggtcgtcttaaccggccaccagtgaaaatcttctttttgctgatggctgccttaatctaaccaccagcaaaaatggatctttgctagcggctggcttaagatgaccgccagtgaagatcagatcttcactggccattgctttgtggcggctctaaattccaccaacgaaaacctaaaatggtgcacaaaatgaagaatgtgaagatcatgagcacgaatcaggaagtggtgcacatgaagatgaccatgacaagtttgtaccttcttcattgggcgttgaaatggttgatgtggatcacgatctattgcaagacatgttacgtgacattgaggacccagcttacaaagagagattcctgaagttcagcaggttggtcagtgactcagaaatgcctttgtacgcagatgcaaagcaaaacacactaagttgtcagcaaccttggacctaatgaagccgaaggaaagtagtcgattgacagacgagtttcacagacttttttaggaatttttatggttttacttcctgatgagaacacattgcccgagacgacatgtgaaacaaagcatgttttgtgtcccctggggttagaagtccgtagaattaacgcttgtccgaatgactacatattgtaccacaaccaaatgccgacttagatgcttgccctgtctgagggccttctcgatacaagcgaaagaatagtgctgacaaaggaaagaagttaaagcggggtggtctgacaaaggttgtgtggtaccttcatatcattgatcgttttcaatagaatctttgccaaccctaaggaagcgaagtttgtacgttggcatgccacagacagaaggaacgacgatatgcttagacacatagtagattcgattcaatagaggaatatcgatcgaagacacgaagactttgctgctgacccaagaaacatgaggatatgtctgtgtacggatggcatgaattcttttggagacatgactagtactcatagcacttggccatttgttattgcaaaatttaacctatcaccatggttgtgcttcaaaaggaaggccgatcttatctcttcacgaaggaaggttgtcaggtgttggcacaataagcaagaaaagaattgttcccgatcaagcctcctatgtgcaggctcatttcgctgtgctccaacatacggcgcctctcatcggcgatctctcgtacgtgacgatcgatcaatcgatctcagtttctcaaagaaaccacatgaataagagaacgtgaggctggctaacaatagggcctgtgttgctagctagcgccatccacgctgcatcgaacgggggaccacaacaacgcgcgcgagaaacacgcatgcatgcatgcatccacggttttgacgaattccactagattgactccacgtatgcctactgacgcgacaatcaatcattttgatgaatacctaggcagctactatacatgcaaaactaaacgtaacaaacaaattaaccgcatctgaggagaccggatattcggaagaaatatatcgattggtagccggccgccgcgcacccaacaacgaattgcggttcatcacttcattcatccaatcatatgataaaatatgacccatttggccaactttattgggccgcctcaacaaccgagggaagccgtggagtgagctgttacttaattattctgagactatagatggtcaaattggtcgcctggcatggtccaacccatgcacgaccaaggcacggctttagattggtcggggtagcatagcataatcgacatgccgagtcgtacctgtgttgctagctaaggccatcgatgtttcgtcgaatgggggatcacaacaatgcacgtgagaaacacgcatgcatgcatgcatccatgattctgatgaactccaccggattgactccacgtatgcctactaacgcgtcgatcgatggttttgacgaatacctagggagctactatataagcaaaactaaacgtaccaaacaaattaaccgcatatgaggagtctggatatacggaagaaatatatcgatcggtagccgaccgccaggaacccaacagcatcttgcgctttatcacttcattcatccaatcatacgataaaataggacccatttgtccatcatcattgggccacctcaacagcccagggaaaccgtggtgtgagctgttacttaattttgctgagactatagatggccaaatggatcgcccggcatggcccggccaaggttcgagcaaggcacagcctgagatttgtcgggacggcatagccgattcaacatgccacgtcgtgccagtgttgctagttagggccatccacgccgcgtcgaacgggggatgataacaacgcacacgagaaacacacaagcatgcattcatccacggttttgatgaagtccaccggatcgactccatgtacgcctacttgacacgacgatcgatggttttgacgaatacctaggtagctactatacatgcaaaactaaacataacaaacaaattaaccgcatttgaggagttcggatatacggaagaaatatgtcgatcagtagacggccgccgagcacccgacaacgtcttgcgttttatcacttctttcatccaatcaaacgataaaataggacccatttggccatctatattgggccgcctcaacagtcgagggaagccgcggtgtgagttgttacttaattttgctgacactatagatggccaaatgggtcacccggtatggcccagcccaggcaagaccaaggcatggcctgagattggttggggtggcatagccgaatcgacatgttgtgccgtgcctgcgttgctagctagggccatccaggccgcgtcgaataggggatcacaacaacgcacttgagaaacacacatgtatgcatccacggttttgacgaattccatcagatcgactccacgtacgcctaccgacacgacgatcgatggttttgacgaatacctagggagctactatatatgcaaaactaaacgtaccaaacaaattaaccgcatatgacgagtctggatatacggaagaaatatatcgatcggtagccaaccgccaggaacccaacagcgtcttgcgttttatcacttcattcatccaatcatacgataaaataggacccatttgtccatcttcattgggtcgcctcaacagccagggaaaccgtggtgtgagctgttacttaattttgctgagactatagatggccaaatggatcgcccggcatggcccagccaaggcacgagcaagtcacagcctgagatttgtcagggcggcacagccgaatcaacatgccacgtcgtgctagcgttgctagttagggccatccacgccgcgtcgaacgggggatgacaacaacgcacttgagaaacaggcatgcatgcatgcatccacggttttgatgaagtccaccggatcgactccatgtactcctactttacacgacgatcggtggttttgacgaatacctaggcagctactatacatgcaaaactaaacgtaacaaacaaattaaccgcatctgaggagtccggatgtacggaagaaatatatcaatcagtagacggccgtcgggcactcgacagcgtattgcgttttatcacttctttcatccaatcaaacgataaaataggacccatttggccatctatattgtgccgcctcaacagtcgagggaagccgcggtgtgagctgttacttaattttgctgacactatagatggccaaatgggtcacccggtatggcccagcctaggcaagaccaaggcagggcctgagtttggtcggggtggcatagccgaatcgacatgttgtgccgtgcctgcggtgctagctagggccatccacaccgcgtcgaataggggatcacaacaacgcgcttgagaaacacgcatgcatgcatccacggttttgatgaattccatcagattgactccacgtacgcctaccgacacgacgatcgatggttttgacgaattcctaggcagctactatgtatgcaaaactaagcgtaacaaacaaattaaccacatcagaggagtccggatatacggaagaaatatatcgatcggtagccgaccgccgggaacccaacagcgtcttgcgttttatcacatcattcatccaatcttacgatcaaattggacccatttggccatctttattggtctgcctcaacagccgagagaagccgcggtatgagctggtacttaattttgctgagactatagatggccaaatgggtcgacggacatggcctagcccaggcacgaccaaggcacggccggagattggtcggggcggcacagccgaatcaacgggccgtgccgtgcctgcgttgctaggtagggccatccacgccacgccgaacaggggatcacaacaatgcccgcgagaaatacgcatgcatgcatccacgatcttgtcgaattccaccggatcgactccacgtacgcctattgacgcgactatcgattgttttgacgaacacctaggtagctactatatatgcaaaactaaatgtaccaaacaaattaactgtatatgaggagtccagatatacggaaggaatatattgatcgatagccgaccgccgggaacccaacaacgtcttgcgttttatcacatcattcatgcaatcttatgataaaattagacccatttgaccatcttcgttgggccgcctcaacagccaagagaagccgcggtgtgagctgttagttaattttgctgagactatagatggccaaatgggtcgcttggcatggcccagcccaggcacgaccaaggcatggcctgagatttgtcggggcggcacagccgaattgacaggccatgccgtgcctacgttactaggttgggccttccacgctgtgctgaacgggggatcacaaaaatgcacgcaagaaacacgtatgcatgcatgcatgcatccacggttttgacgaattccaccggatcgactccacgtacgcctatcgacgcgacgatcgatggttttgatgaatacctacgtagctagtatatatgcaaaactaaacgtaccaaacatattaaccgcatatgagaagtctagatatacggaagaaatatattgatcggtagccgaccgctgggaacccaacaacgtctt

SEQ ID NO: 75540 - DNA, 10882 bp, Oryza sativa
aaataggacccatttggccatctttattgggccagctcaacagccgagagaggctgcggtgtgagctgttacttaattttgcggacactatagattgccaaatgtgtcgcccggtatggcccagccctggcacgaccgaggcacgtcctgagattggtcggggcggcacagccgaatcgacaggccaaaccgtgcttgcgttgctaggtagggccatccacgccgcgctgaacgagggatcacaacaatgctcgcgcgagaaacacgcatgcatgcatgcatgcatccacggttttgacgaattccaccggatcgactccacgtacgcctatcgacgcgacgatcgatggttttgatgaatacctaggtagctagtatatatgcaaaactaaacgtaccaaacaaattaaccgcatatgaggagtccagatatacggaagaaatatattgatcggtagccgaccgccaggaacccaacagcgtcttgcattttatcacgtcattcatccaatcttacgataaaattggacccatttggccatttttattgggtcgtctcaacagccgagagaagccgcggtgtgagctgttacttaattttgttaagactatagatggccaaatgggtcgcctggcatggcccagccctggcaggaccaaggcatggcctgtgattggtcgggttggcacagccgaattgacatgccgtcccgtgtctgcgttgctagctagggccatccactttgcgtcgaacgggggatcacaacaacgcgcttgagaaacacatatgcatgcatccacggttttgacgaattccaccgcatcgactccacgtatgcctaccgacgcgacgattgatggttttgatgaatgcataggcagctactatatatgcaaacctaagtgtatcaaacaaattaaccgcatctgaggagtccggatattcggaagaaatatatcgatcggtagctgaccgccgggaacccaacagcatcttgcgttttatcacatcattcatccaatcttacgataaaataggacccatttggccatctttattgggccgcctcaacagccgatagaagccacagtgtgagctgctacttaattttgctgagactatagatggccaaatgggttgcccggcatggcccagcccaagcacgaccaaggcacggcctatgatttgtcggggcggcatagccgaatcgataggtcgtgccgagcctgcgttgctaggtagggccatccacaccgcggcgaacgggggatcacaacaacgcgcgcgagaaacaagcatgcaagcatgcatgcatccacggttttgatgaattccaccacatacgacaaggatgaataaagttctacatggaaacgacaaggactactcggattgtatccatattggtttccctagttctacttggacaaggggacaactatgggtataaatacaaggcgccctaggtggagagaggacacggaacaatagatcaagacacgagatcaacatacaagccaacatgcccaagacaagacgccagatatcgacttcagagataagcatggctagtcccctacggtgtctacagatactgtcaggagagatatagcgctgtctttaatctcgccggatgcggattcgaggaggaaggctaccctgttgtcgactacgagtcagcacttcagaccgccaagtcgacaacagttagataggctaccccaaatattgtactggtgtgattatggtgaataagagtaacgaccggtttcggccaacaagagtagggttattacctgacaattcaggggcccgaacctgtataaaaatcatcgtccacatctcttttattacaatctcgcatatatcctagtaccaacgatccccatactatgctaataacagaatcacgacatcaaacgttgtcacaccctaaaaatcccaaatatataaattgttgtttaattggaattataagaattgatttttaaaagcctagaagagaagatctaattttaaattataaattccaatataaaagtgggccagataaaatttcattaaatacttttcttgattctatagttcctagatttttttgggatttatttgagccaaggaagtatttttaataaatggaattgcatttcatgaataatttaaattgaaaaaagtttttaaaatcctcttttggctttgggccgaaagtcggcccaaaccctctctctctctcccggcccaggtcggcccgcagccgagccaccgcccgcgcacgcgccctcgcccgctgacaggtaggggcccacctgtcagactcgtcgtcttcctcgcaccgtcgcccagccgaaccctagccgagttgcgccgccgccgcccttccaaattcgatcgtgtctttccatctccggtgaaattgatagagggaaaatgatccccgcgatccattctatcttttcccttttggaatcattggctaattccgtttggaaatctgtggattcgatctcgaatcggattcgtctttctccccgaaccctaaaccttccttcgccgttgccggtcgtcgtgggcctctactgccgccgctagcccctatataatggaccccggtgtctcctctctccgtcgccaccctcgccttagctcgccgccgcctgtagcatcgcctccgcgttcaacggtgcaccgccgtcgccgttgttcgtccagccgtgcgccgccgtcgctccggtcgtcgtcgtcgctcgggaaggccgccgtcgtgatcgccaagccgtcgccgacctcgtccacccctccgtcgttgccgtaggtcgccggagcaccgccgtcatcgtcaagccgaaggtcgccaccgcttcttcctcgacgccatcgccatccgttgatcttccgccgctgctttggtcaccggtgatcagttcgccgcgtcgcccacaacccgtaggtgcccttcgttagtgctgccgcaccgtcgttcgccggcgagcatgcaccgtccgagccgtcgccggtgatgacgtcaccgctgacgtcatcatcgtcatgtcgtgaaccgccgtggactagatcgatctcggccgtccgatttggttagagtgatctcggccgttcgttcccgtagaccgccgccgtgcacccggtccaccgtgaaccctagccgctgacgcaataatccccttttccttttcaaaaataattcattattgcgtcataattccattaaaatccatataaatgatttaatccgatttaatctttgaaaattcataactaattcatcctagctcggatttagttggttcaagtctctaaatttttctaaaattgagatctacatgttaaaaatatccacatatactgttcatgcttgtttatgtactgttttggtgattttgttcttttctctttagatttcgacgttcctggagagtccgattttgcaagagaagactttgaagagttccaaggccagcaaggcaagtcacacagatcccaaacaaccctttgagcatgttgatcccgtttaaagctattgtttctattcaactactgcatttatttttgaatgtcattgggtggaattaacctattgttttgtcatagccctttttgttcttgattactttattccttgataccttgggttattataacttcactagttgagctttatatatgggttcagctggatattagatataattgcttagccatgcttagaaacattagcacactattgggataacttatgcttcactattatttaatgatggcttaatgatagctcatgatggttaattatgattggttaattaattaattcgccaactaaaatttgataatggtgggttgtgagcatatggttttgatggttgtgctcatgacaattaaggaccggttcacgattttcggttgtgaaatatttaccgtgccaaccacaaaccagcgtgggcaacggctttactttctgtatagtatggttcatagtagagcactagactgtgaagtggcggagataagcccacgggggtcgctagggagtccataccttgtttataagggggtgattatgatccgggaacggtgcactgctttgaattgtattatatggagggtattgtcacaatttctattcgggtacttattaagtatcgcgacgcatggttgacatgatgttgaggttgtgtcttgtgggtacagtggtacacctctggccagagtttaaactattcgaatagccgtgcccgcggttatgggcgagtctaacaatgtctttcgtgattagtctcacacctctcactataataaatgatgctgttaagaacttgtttagctcctggtttggaatggttaattcctggtttggagatagaactgtgcagccgggattggttgttcggaatggttgggcctatgcaacagggtatgttgtatagcgttggattaatattgtttaattattatttaactgttttattaaattctgaaatatttgttaaatgctatttatgcaaatgagactatactatgccatcctttgttatcctgtgcacttgcatatttgttgtgtggcttgctgagtatgtcagaggaggagttctacagcgatgctaatggtgtggatgattaggcgtagccctggtcaagctgcctgtggagaggagtcgcctgcgctgtttcttttattttccgctgcttacaactttattgattgagaggaactatctatctcggtaatgacattttattcgcttattaattagagtaataattgtactctattatcaatttgttattgtgtgcctcggctgattcctggacgagggtttaaacatatgtaagcgtttggaattttggatagaaattctgggcgtgacaaacgtcgacagggtggatagtgcctgaagaaaaatttattccctggtcttaaagaatgttttctaagtagtgttcatgctaactatacaagactggattggatatatatatatatacacacacataccgatcaagcgtattaattagaacttgtagatagtaatctgctgatgaattgtcactactacaaaacatcaaataggtgtcagcactataggtgccggaagtgttaaaaccggcacatataggcattttcccacctctgtgatccggaaatacaaaaaaccggtacctttaggtggtaataggtgtctgttctataaaaaaaaacgacccctatactataggtgtcggttttagagtaaaaatcgacacctttaattaattataggtgttggcattttaaccgacatatataataaattaaaagtgtcagctttttaaaaaatccgacaccttttacaaaccgagccgagccgagccgagccaaggagatatttcttctcccagcggggtccaccctcggaggagataagcccggcgaggcgcactgagactgaggataaggccaccactcgattttttctcctctctctcgttcactctgcaagtacacctcctcctcctctcacggccccatcccttcccccacctccgccgccgagccgaggcggcaggcggtgctcggcggtgttgacggtcattatcgatcagtttcgaccgtcaatatcaccaaaatagaggagaactagtgatgtttgcaatgcatatatttgctagaataataatattccactagtattaggtctactaaactttacatagtgacaataaagtggaggagaatcgacatcaacatagacaataaatcaatcggacgatgtcgagtgttagacttatgcatgaatggaccaagaactcagaattgacatgacacactgggccaaaattcacaagtctacggaggagaacaacaaaggaggccacctgctgaatatgggccaggttgggtcggccttctggttcggccgaacctcccctggcgccgttggatcgaggtttttgctggacggcgtggatcactccccaacgatggttggagggcaattccgaccattccaactgccacaaccgtcattggcagcctatttaaggagctcctcttctcacttcactcacacacctcaagcaatagctctctcatttctctcaagtttagcttagtagtatctagctagtggaataggaatagagtagaaatcaggagtccggaagccttcggaagagtttggctatggctctagtagcttttctcttctcttttgtaagctttgtacttttattagaatactcttctaaatatatttatggtattgaaatactttccgagtatatgagtacctaccttacattatattcatgttatactgaatatatgactattagcttatctaggagatgctttggtgcgggtataatgttggcttatgcaattactctatgtcatgacgataatattagagtagtatctgatagtttaggcgtggtgtctagattacgggatatcattatttggggttaaatattgcggatgagaggtgggccgctgatggtgacagctcagtacgggtattcctccgtgccagtatatcatcctaagttaattccctggggagtgtattcctccgtatttagccccggttgtatggtcatgacgggctgtcgtaaggaactcggcagtcaggggtggcttctcgaagtaccaggagggcatcggatagagggtattagctagtatatcggttaactaaaatgtatgtatatggcagtcagggatggcttctcgaagtaccaggagggcatcggatagagggtattagctagtatattggttaactaaaatgtatgtataccatgtatattagaagtataggaatagataatatattatgagaatgagtagttaatgcttgtgtgtcactctactcttggattatcttaacccctgcttagaatatgattatcacaaataatatataaattattagtcaagctctctctacatgatcttcccactggataaaataaatacgatacccttggaatactcttaggtgaaatgctacaatggtatatccgtgcgcttgcggatgagctctgtaaccataatataccagaagtatttctgcgtcattgctgggaattatatttctagtaatgtggttaagaattaccaacaggcggcgggcgacgggtggcggtggcggcggcgcgtggagacacaccggcccagcggcggtagcggtgggaggtagcatgcggcggcggaagggacggaagggagggggatgcggaggcggtggaaaggagaggggatctggcggctcccctccgccagatctgcctaggacgggaggcggcaacctggcgcgaggtgccgcggcggaagcggtggcgctctcttccagatccggccgggagcggtggcccggcatggaggatgaggcggcaagttattgatttgtgcgctgtgttattgatttgtgcgatgtatttatgcgatgtgttcttgacttgtgcgatgtatttgtgcgttgtgtttggtgcgatgtattttgtgcgatgtgccagaggatgtgttcttactgtggatgtgggtttaggctttttttttattcgtgaaacctcaaaggtgccggttctaaacaactggcacctatttgattttcaaatcagtgccgtctccgtggtcccagttgtgaaaaccggcacctaatggggtttgcaaccggcaccgatttgtgtgtctgtagcggtgtgtgacaattacatcatggatgagctcgcttgttcccgtgaaatcgtcaccgagttcgcgcagcatgtacgcggactctgcccagaaatctactaccaacgagaactcgttgcaagttcgttttctgcgcacgcaagtcatttactaattgttatattttgggacgaaaggtattttgggacggagggagtagtagatatacgatttttattaaaactgtgttcagtacagactgacaggtacacacattcactaattaggaattaactatatgctttgaaagaataagggacatctgcaggaacccaagcccactttcatcgtcgtgctccgcaaactcccactgaactcgtgcatcgccgtttcctgctacctgccaatcctaagctccaacatcgaccagaaaaaagtgaagtgattagcttcaaaaaacacaaagtttctacccatagccggccatcagtctcatcattagctggggatgcatgatatctctaaagaactttctgatgatccgcctctgtaaattcaaagccttctataaaactgttagatgtgtgttgtctgtgaatttagtttttctgaagcaagtcgctagtgagagattgtactgtggataaattcttcccatgtgtccacctatttattagggtatgctaagacagctctaccgatgttgatgactagcccattggtacgttactccctacatttgtctgtccaaaatttccacatatgcctgcttatgtgttatgtactagtcgttttattgatttttttttgctggttgtattttaattgagatagttaagtattaaagtttatttcacattcataatttttaaatttaaagtttatcttcctaatcttgtgaggacctaagtcttgtccacttgtctagacaagtagaaaataccaacttaccaagctagacccatcttttgagcaagcatttatatgtcgaatttgctatatatttgtatatagtgagattttgggagaaactaatacagtacattgatatgcaactaacaactaaccgcccgttaacatttctcctcaccgcagtacttgctttcctgacgaaccattgaactatgatgagcagaggaaacagaacgagcacctaggcgcaaatcgagcagcccgtggaacaacattcttcagtctttcgtcgtatctgactcccgatgcctcaagcccttgctttggttagcacgtgcaacagcaacatatatatcaaattagtaacgaacaagaagagcaagtttcacagcttatacatgcttaatttgcttgtatgatatgattgtgcaattctcagttacttggtatatctttgcttgtgctgtaactaaccggttagggtggatatatatacctgtatctcttctgtatagttttttttcccttgaaactgggggaaatttaatgcttcagttagcatccagtactcaactacccacaatgcttctgcttgtaagagcaggtacaatagcaggctataagccagctataaacatattttaaagagataaaggaagagagaaaaaagcagcgggctacagatctgtagcaagctgcagcacagactttaagacgtaatgtgcgtatgataggtgggaccaagtattaataatatagtaagtaactattgtatgaattggctactagattgggctatagatgaattggaactagtagtgggctatcctattgaatttgctctaatatgtatactgtatctgttatgactccgtggtgagttattacaaatagctaattaaaaacgggcgtagacactagctagccgccacatcaaccattgagttcttgcaaatggtacctgtccaattagtaaaggggaacactaggaagcataatatcatgtcacagcatcactgaactcttagaacagctcaagagtctagacgacgccaaggagcctcccaaatttagtttacagtatcggttggtatttgtagtaaacatctcgaaggatccatttttaattttttaagataaaatttagactttctctcgtcgatatcagtttttttttacttttattttcagtttaggggaaaaaaactttttgggaaagattatacgtaatctattaataataatgctctaacaattacatcattgatgagcttgcttgttcccgtgaaatggtcaccgaggccctgtttagatcccaaaaacttttcacaaaaacatcgcatcgaatctttgatacatttataaagcattaaatatagataaaaataaaactaattgcacagcttgcatgtaaatcgcgagatgaatctcttgagcctaattagtccataattagccataagttctacagtaacccacatgtgctaatgacggcttaattatgctcaaaagattcgtctcacggttttctagcaagttatgaaattagtttttttattcgtgtccgaaaaccctttccgacatccggtcaaacgtccgatgtgatacccaaaagttttcatttcaccaactaaacaagctccgagctcgcacatcccgtacgcgaactctgcccagaaatctgctatacccacgcgaactcgttgcaagttagctttatgcgcacgcgaacttgtagtagccacttcgcgttgtcagcgcgcgatgctgttgacagcgctaattcgcacaattccaccacgaacaaagctacgatcgagttcgcatggccaccaagtgacgatgatttattctcgtaaaatattttatcaccagtatattttcaagaaaaataatggatgacaatattttttttactttatttctctatgcgacggcagaatggaccatgcatgctgacatgcatgagatctacaaggtactggattcctaatgcctttcaagcctaaatccatacggaccatataaaatgtatgcctatagtttacaaggtcatcattggaaggaatcgaatttatacacatatatcaggagggaaaattgttttaaactgttgggggaatatcacctcatttattcaaactagtaaggtagcccgcgcagttgcgcgggcatcttatttaaatttgttattaggattttgaatattatgactttgtctctcaatgaaagaatttgaatgttcctttataacacatgattgaaaaaaaaagtataaaggccggatacatgttaca

SEQ ID NO: 75541 - DNA, 1444 bp, Oryza sativa
ttacacagatcaaggctaatttgcgaacaatctattaaaactaattaatccatgattagcacctattcattgtaccactatattatcaaataatagaagagtaattaggtataatatattcgtctcgcaaattagcctccatctgtatattctgttttgttcaaacatccgatgtgatagggactaaagtttccttgtatccaaattaccccttaaactcatcttcaaatctctcattttatgagagcgttttacctatctccacacttattttatgtggagctaaatcattttatgagagcgctttacacatctccacttttattttagatggagctgaaactgtttggctgagctccaaccacagaagaaatggagctgaagctgaaactgtgtcaaacaaaccttacttgtcctgatgatttctcacttggcagataggcactgagtttcaattgctgatgggattaacgtgaaagcttcttgaggttataaggctgtgttcgcggtaggttaagctgggaactttccctccaaacacgcaaaacgaaatggttcattatcacatgattaattcagtattagttattttcttcttgaaaaatggattaatatgatttaatttttaaaccaaatttcatatagaaacctttttaaaaaacgtaccgtttaatagtttggaaagtgtacgcacggaaaacgaaggaggtgaagttgggaactcaaattaccgaacgcagccaaagctgggtatatataatttttaaaagaggttttatatggtggtgtttgggaaggagaaactaaactttagtccctctcacaaaaattttagtccctcccatagggacttttgcttttgtgagagagactaaagtttaggtggtgtttagatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctatacagggcctcagtcccttctttccaaacaccacctatataaatatactggaaatctatttaactttatactctagagctcgatctgttttttttttacttttccaactcatctctcttcttttttcgcaaacttggcctaaactatgtgttttttacaaaagtttttttataaaaaaattactttaaaaatcatttttttttcattttttttagaaaactaatacttaattactcat

SEQ ID NO: 75542 - DNA, 16046 bp, Oryza sativa
taggcagcgtaaagccacgaaccaaactcatactaagagtcctaaacaccttaggaaaccctctagtacaagaaagaaactttacataaccaatcgtaccaaatttggactccttctaaattcgactccgcatcccatacgcacacaatacctccatcgtatgccatatggaatctccatcaaccacgtgcatcaactctagcattagtatcccgcataatatctgaccaccatggacaccgtcttaccaccaagccaactcccggtccatcaccgcaaatactcacccgaggcatcgagccacctacacatgaaacaaacaaagaaaccatattctgagaccaagctatccccaacttgactcattgttagcaaacaacagtattatatacgtatagtatccatctagaatccataaccatgaaacaatcacggatatccaaagaaacaacccgaaatcgaaaccgacacaacgtcggccggtcagaccgcgggaatggccagtctgaccacacacatagcaccggtctgaccggcaacctccacccggtcggaccggtcacataaaataacagtgaatccgatcatcacctgaaaaatgattatctccaaaaccacttcgacgataatctccaaatatcaaaaccaataatcacagataccaattgttcatcacagaataagaatcaaaacacactttgatcttacaatctcccccttaatgaacacattggcaaacctcatcaaaaatgttttggtgtttggaaaaataaaaacaaaagtggtaaaaagcacacttcgtacaaatgtacacattgtgcttaaaaatccaaaagaaaacttctccccctttttaaaagaaagaaattcccaattgaaccaaaaacatgctcttctcaaaaactcttcaaaaattcaccttgcttctccaaaagtccaacaattttcacattacttcttccccttttgacaatgattccatcaagcataggaattatgttcattaatgttcaagagcttagcatacatatagcatatcatgtcatgtgttgcaataaaaggaagataaacccatctataacataagaaagcatgcattaaattataaccatgaaccaaagattttacaattaagcttgaatcaacaatcaaaatttatgatttcatacgatttataatgcaacatcttaacaagcacataggttgaagaataaacactaaacacatatacctattgcatttatcactctttctcaaataaactttagcacaaaataaccaagagatttttttttaattttttcttttcttgagtctttttctcatatttttctctttttttattccgggtacgtccctgtcgtcaagactgtttccaaggattcggtattcattttttcatattttttattctctttttcacaatgagcaattaaagctatttgaggaataacaattcaataaagcatatatatagaacatttatagatcaaaccatatgctagcagcaacattgcatattttcttaattcaagtgtagaatttaaatgtcatgcatcatcttccttaaaagcaaaatctaaatatcatgaaaagactagaatacatacaagctatgctagagacaaataaaccttcgaagtattgctagcatgcacaagaaaataccaataatcacagatgccaattgttcatcacagaataagaatcaaaacacactttgatcttacagtcattatcgccgtctctaaatcattaaatagccgaagcatagcttgtgaaggcttcaaggctccaggagttgaagaacggttcatgaaagctttgaagtccgcttcattgaggaggagatggatcttttattttttgtcatctttcaagtggacatcttcaagcatggtttttggattaatcctaatttgttgtcgatctagtttttagttccaaatgcaatgtgtacacgttgcatttgaatggggatgtcaagtataagtgtgtctctaggggtagtattgtaacttcgcatctattgtagacaatttatattgctctttgggtctaatccaatcttattgttcattccccaaattcccccaaattgtgccaattattatataaacgtgatacttaagagagataatatcgatttacttgcgaagtgagcatagctcaactggttaggttccttgcggcggaaccaacccacctgcgttacggctaattattctttcattgatagacgacatacccgtcgacagcaaggcacctctagtgacttcgtcaatctcaaaatatgcctgccaagtcttccggagatgctcataggggtagggtgtgcgtgtgtgcgtttacaggggtgagtgcgcgcgtgttgtgagcgcctgcgtttaaaaaaatatcgctttactcatgtagatataagaggtcattattttctcctaataaaaaatggaaatattgctttaatcctatagatataagaggtcattattttcctgtaataaaaaatggcttgagtgtacataagcgcatattttcaccaaggaacacactgaaagcagacgactactcctttaaacaaaacaatttttttgaaatgaatggcatacgccctggttttgattgagagcagttcatttctcacataatattgccgaacggacaaatgttcagttagttttcatttttacgtgtactatgatcaagcaaaagatgctgcgtgtgtagaaccacacaatttaattttgcaccgggaaatactgtttgttctgttcttcatcctcctccaccgatacaattgcagtgcgaaaacaacatattttgcaaggtggttcatctgcttaaattttattgccagttcaacatctgtttgccgccggccgaagcaacgaaactgaaccagtagcgattcatcaggaacggtgatagcatcgtcaagacgcctccctcgcttgatccctaaagtgtcccggcgcaatgtccacggctagcaggctgcccaaacgtagcagacaacaagagtattctccagcagaatgctccaaaatcaggcacgatgcatccatatttatggcttgtgaacttcatggcagtgaattcgcaaaccagataatccaagcgatgttcttgtcaggccaagtccatgaatacatgatgtcccaacagatctggtagcaccgactcatgacaactatcccaatgcctcaaagtcctaagaatatgtcttcaataatattcagccaataggagtttgagaggggaattgcacgcccttcattatatctatttgaaatgagcatatggcatgtgtttatatatggaaatccggggatatgaacgcgaatagtattgtacggttttgggtatgaatgtggtatcctaaattctggcatatatggattatccaaaatttccattggattatccattaagttttttccaagatctgaaattgttagctcacatggccaatctactccatatatacaacataagtaatgacaaaattaaaatttatcaacattgcgtcaaaagggaggatgcctatgtaggatcgtaaagggtctttcccatcacaaaaactagccattgaagtgaggggggctcccccacttgtattttaggtcttttgtccttccacaaccaatgtgtaactattcaacaatctcccccttcacacattagtgtctctcagcacttcacggcccctttaccgtataccaattgtaaagggtcattcccaccccaaaagctagccattgaggtgaggggcccccacttatatcttaggttctctgctcttccacaaccaatgtgggattattcaacagcctcttatgaagtaaaaccgtagcaaagtagcaaataaaaaaaagtatgaagtttgcgaatccaaattagaatttcacaatataatctcatagcgtcatcgttccatctgcatctcaaaagacatggaaaaatgaatgaagcaacaaaataatttgtcggtgaaaccttgtatcgctagcgatttaaaagttattgctgaaaaataaactaccataaaaaaaacccctgaaaatcaatgcgtatgccttggaaatctcatggcaagaactccgtaggattccctctctattattatgtttatcatgaactacctcttaattattagataaacacgatagttaggaggagtaacatagtccttggatgtactgtgttttaatataagaggtccctaatttattttaatgtataatgaattgagtgtgcacagaatgcaaatgatcagtctttcggacataaccactttttgaaaagaaaggcttattattacagagagcccgactacggtgctctctctcatttgatcgaagtattcagatctatttatgtgtactagaatactgaataacggtagtagaaaaaataggtatgaaggagtataattgtcattcttcttttttttttctcattttcatggaatatgatcgatgccaatgtaatggatgaccacagatcaatttggccaaaaaaaaaagtgacaaagttacccctaatcaatatactagtaaattacttaaaaaaggtatttgcaggcgggccaaatccatctttccaagcggacgtgcgttctacctgcaagcaaaggcttgcgaaaatagatgattttcgcaggcgggcccgcggcatgatttttggtggaggaaatgataagatgagacttagatatttttttggtgacatgatttttacaggcggaccacataaggttccgcctgcaaaatcatattttttttcaggcggaccacataagaggaatttttgcaggggacctcttaagtagtccgtctgaaaaaattgattatcgcaagtgggcagcgagattcaccccggtttatatttttgtacgcagctatttgactccgagggtcatgttcgtatgggaaaataaaaaccccacgtctgcaaaaatggctttttctagtagtgtaatttacccttaataacgaatggcttagattgggtagtataatgctactagtacagagcatcattgtcacagaacaatgctgaatggacaactgtccaatcattttttttttcgaggactatgaatcacgttgaacacggctcttccactgcaaatgatcttgcggaagatggcatagagcttgggatttttctgtgttacgcgcgtgcgtagaaccaaaacagtttaatttttcagcgggaaatacagttagatgtatttttctaatctaaaaattgtttgagtgtacataaccgtgtattttcaccgaggaacactgaaagcatgatgactactcctttcgacagaacaatattttgaaatgaatggcatacgcactggttttgattgagaacacagttcacagaatattgccgaacggacaacagttcagttcgttttcatttttacgtgcactacgatcaagcagaagatgctgcctgtggtagaaccatacagtttaattttgcaccgggaaatacagtttagctagttctccatcctccttcttgttccctagaaagtgtcctggataaatagccaaagctatatcaggctacccaaacagtattctccagctgaatgcttcaaaagtcaggcatgatgcatccatacttagtggcttgtgaacttcatggcagtaaaatcacgaaccagataatcaagtgatgttactgccagcccaaggccgcgaagacacgatgttcgaattgatctggtagcaccgactcatgtcaactatcccaatgcctcaaagtcctaagaatacgtcttcggtgataatcttcagtaggtgttttagaaggcaagttaaggaattacacgccatccattatatccggaagggacgtaaattagagctcatcagtacagttcctatacggtatatatcctctcattgtgtcagccgaatttgaaaaactccatggaattatttcttgccagctagttccaagtgtattgcaaatccgattgattggctcaaatagaagaatatgactgcaggatgtaaccacaaagctaccttgcttgacatctcggctgcacacatctattatgaagattaataatttacctcgattttcgtttcacgcttgtcaaacaactaaacggtgtgtttcatatgaaaactttctatatatatgttgctttaaaatatcaaatatatctattagtcaagtttgtaataattaaaacttgattaatcatgttgaaatagctatctcgttttatgtgctccaactttatttttatcttcataagtttcgaacaccacctgcataatggtggcagtatacttctagcaataccaaaaattaatccattcccgagccaagtctgcatcattttcaatacgactgaaaatggatctgacctgtcgcgctttgaatctgtttgaaataaggacttggatatggatgtagtgtggatgtgggtagtatgatgcgaatttggatgtgtggtatcccaacattctaccatatatggattatccgatatttttatcggattatccggcaagttttttgtcggagctcacatgaccattttatttactctatacaacacaagttatgacaaaattaatattttagtcaactttgtgtcaaaagagaggatgcctctcatctcttttgctacggagaaaaattgtggcgaagcggcaacttaaaaaaattgtgaacttcataagcaaatataagtgagatttccacggcataatctcatagcttcatacttttcttgacgctcataagagggggaaaaaataaaggaagcaactaaaaatattttatgggtagacgtaggatcaagaagacttactagagggagtgagtaggcggttttaaattttttgtccaaaccaggttttgtatgcggaagcgcaaatcaaaacggctttgcacaacaactcctaaaactaataatctcaactaaatgcacaaggaagatagcctatgttaaggtttttaagcgtaagatgatattatcacaaataaactatacaatgtaaacttgcataaagtaaattggcacaaatgtaaattgcacaaaacaaaggagataagagacaacagatttttccacccaatgttcggaagcttgccaacttgctacgtcaccgtttatgcaagcccaacttcaccgctcaaacaatcaaacctccgaaccacctcatcaagaaatgggcaatgtgagatccggtcccgaagtggtccaagaaatattcttaactccattatacctttgccttgcgctatccaacttgggatcaatgcttgagtcaagatcaacgcttgtgaccatgtttatgttaagatcttaacaatcatttatcaagattttcttctcattgcatgctttatttcattattatcaatatggcgatgtccttggcttggtgacaatcaatgcatgatgtcatctatatgcctcatcatggttggtcatattcttttgcacagctcaaaggaaaacactagtgccaacaaattagttgtcatcctccagttgatggttgcattgaaatatataaatatgtttgttgatttttttttcgatttaaagtttgttgagtatttaacaacaccacaactaacatatactcaaacatgagctcacgtgcaaagattcaatatgtatctagaacatgcatacaaatgcattggattttgtccccctaaaattcagcaaaggaatataaaaatatgcgtaagtagagaagaaccaatgggggtttatcctatatacatggagaagtataaacacatgccttcatgtcaatgtagaggagactaaataaggtaaggctgaagtaaacattaaactctcacttatatatcgaaaacatgaaaatcatatatatgaaccatcatatatacgaacctatcaaaaagtagaagataagaagtgctacacatattacttaatcttcatgcattttatccttgtcatgactaaggtctatcaccaaagaattcatatcttccacatctcattattgagaaaagcctagttgaaaacttattacaaaagaaaaggttaatcccggaaaattcggtcttttatctatcacaaaaactacaattatgcaatttgcttgatccaaaatctatcaacattttctctcgttggtattggatgataacctaatataaacaataaagagatgggatgaaaaatgatttcaaattaagatagtgatcttataatgaataaaatatagaatgaggggatatagaatgagcacctcaagatgtgcatagacatggatacaaaggaagacatctacgtgtaaagttcaatacatacctttcgcatttttattttcatatccaaatgaaactagtcaaacaaaaaactcataaaaacgttaattagtcttatataattagatttggcactaatcaccaaaaccaaatttaggcacaatagaacttttctatatatattctttagtgatttaaaagatattgctgaaaaataaacaacaatacaataaaacctcaaaatcaatgcatatgcctggcaaacgtcctcttattatgtttgtcaaaaaaaaactaaatcttaattattacataaacaataaacacggcagttaggagatgtaatatcgacatattcttatataaactttatgttttaattcaagaggtcaatagtttgttttaatgtaatatgtaaaatgacttgagtgtgcagagaaagcaaatgaccggactttctgccagaacaatggtttgaaatgaaaggcatattatcacagaatgatggtgaatgaacaactgctcaatcattttccctttttttttcgcgaggactatgaatcacgttgaacacggctcttctactgcaaatgagcaagccgacgatgccatagagcttgggatttttctgttctgcacctgtgtagagccagaaaagtttaattttgcaccgggaaatacagcttgttctgttcttcctcctccttcgctgatgcattgcagtgtgaaaataacaacgtaaaggaaaaaaaagatagttcatttggttaattaaatctaactgccagttcaacattgttagctagtcgagcagagagtctaatcaataaacgcataaatataaagggaaaaaattctctgcggtggtgtcgcatgacgctttctgagtggcaccacgtagactggcgacccgacatgtcctgtagcaccgcattgaccaagccgcagctactggcaagcaaagctgctccggagttcatggagacattctcttctgttagagtgtataaagtgaattgcccgtctttccctatcagcttaggcttttaggtgcaattggctggtatattcaacttaatatcttcccgtcgcgcagctgccctcgatgatgagtttctgccgccgcctcccctctccgccttttccacgcgccacgtagctccagcactcctcgatctccgtcacgcccaaatccaatcatatgacatcgtcgccggtggttatggggctccgccttccacccatctgtacaacgcaatctatggggccctgtcatcctcctcggcgcccgtttatctgaagctgtcgacgttcccgacggggatacacctgaacgtggtggcatgcttccagggacatgaacggaccgcgacggcagcaagtgagcaggatgatcgatgacaagtagctgatgttaggtttgttgaaaagatattcaatgttgattatattcctggattctgtttccaatgtttcttgttgaaatttgacttggagttagcgttattgttaataatgtggtacaaatagaaatcgccgaaggtgctgcggctggatctacacggtgttgtgggagacattggcatggtgggaagaaagatcttgagctacaggcctacagcagatgggacacgcatcgccagcctatgctgcgtcgtgcaggaagcgtctgcggcactgcggtagagatttattttttcccaagataaagatatccagcacgtgcgagcatcagctaagcatttctcctctttcctaaatgtctcctgacacattagccgcaacaaaccatccaaaattcgtgaaccattgatcagagtgatgttaacgtctgtccaaggccgcgaagccatgatgatccaacagatcaggaaacactgactcacggccactatcccaatgcctcgaaatcctaaagaatgagatcatcttctgtaggtgttttagaggtcagagttgaggaactgcacgcccaccattgtattcaggtggggtgaaaacaacataacacatcacaatgcatttcccctgtctatatgggctgaatattatcacaatgcaacattttctttctatctgttagtacaatattgaatggtagcaaactagcagtacactttgcaaatagtaccgctgcactttaaattgcagatgggcaatgcaaaagacatgctacagtttttattgccttagctattgttagagtgtttctaagtcatgtgcgtcatatgtaaactgacatagctgacagtaataatattgcaaaacttttcgtgcttattctttagtttttctcttcttatggaaccttaatttggcgtgccaggttagttactccctacatttcattaaaaatgttactatattttttaaaaataattgtttaaacttaaaaaataaaagtcgaacgacttgtaatataaaacgaagggagttcaagttttaattaaggttaacgggatgcaccaccgctctgtggtgttgcttgtgtggagtggaaagttttctttcgctgttcctttttaggtcattagtctatcttaaaaaaccgccacaagttttttaacagaaaaacttttaaatctaactacagtgtaattgtaatataatttcactgtaactaaagttacagttacagtccactacattatagttacagttacagtatagttacaatatataatatatttacagtctatagtgtaatctatctatctattatatactaaaagtctattaaacttcctacaaacgctctcataccgccacatgagattcctaccaacgctcccaagccaccacgtggtaatctaataatctggtggacccaatattatatagaattagatctatttttggaaaaaaaatctacatcccacgtccagcttggtctgtgcgtacaggagatatacgtacgccctcccatgtatcccctttaattatctcctatttccatgctacatgatctcttctatttccatactatgttaattcctatttttatgatatattagtcagatgtaaatcataatttataataatagttttcaaaaaaaataactaaatcaccgtcatatacacattaacacatatatatgtacaaacgtacgtactccctccctcctgttccacaggaattagataagaagtgcattttatttttatctgttcgtgagtaagagaccatcacaaatgatttatcatggatggcttcgcttaagcgtgtcttcaattgaatgtgtagatcggctaaataagtaattatttatttatgtcaccaagatcattcatataaaaattaaagttcatagatccaataatttttatagtaataaatgatggtgcataaccttaatagaaaataaaaaagaaagagaagactgaggggaggggagcagatgcggtggtacgtgtgtattacacgtacatgtgggtccaagagaaaagggtgattggatcggtagatttaatctaatggttagtattatcgggtccatcgttttaaataaaaataaatggttagatatcatttttttttcttagaatttatcagagcgccacgtggcggcttataagcgtttgtaggaatcccacgtgacggtttgagagcgtttgtaggaagtttaatggacttttagtatttttaatttattttaacagtaagattatttgtaattaattatactatataaaattaaataaaacttcatacaaacactctcaagccgccatatggacatcctacaaacgctcttaagtcgtcatcgtcatgtggcattttaataaattaaaaaatatcacaccactccagccgtatgtacgtatgttttcctccctcgccctactcttctttaaattaatttttttaatgaaaaaacaattaataatttaatatccatatcacccatattttactataaaaaactaaaatacattatttgaacagattgcaaccaaacaacatccaatttttaatttattggaacattaatttaatttgtaattaattattaatctgactattatatactaaaagtccattaaacttgctacaaatgttcttaagccgccatgtggcactcctgtaaatcctcctaagttgccacatggcactatctaatctcaccgttgatttttatttaaattgacgaacccattagtttacactattagtttagatttattattaaaaataataattttctcatgtttataacgtacaggcgctactgctgtccgtacgtatgagtttgtacgatacaaatgctattgctgttctttctatacgtacaaacgtacatgatctttcctaatcttgctgaaaaaacatacacatgtacataaaaaaagacataaaaaacatacatccataaaaatcagcggtctttgaaatataatttttgataaaatatattacttcacaaatataaatatatttagttaaacaaagatctataatagatatccaatcaatattctttaaaccatcttctgaatctatctattatatattaaaagtacattaaacttctacaaacgcttttacaccgctacgtggctctcaaataaattagcgaaatcctagaaatctattatatattataagtctattaaacttcctgcaaacgctcctacattgtcacgtggcgctttaatttagattaatcatagaaatttagagtaaaaaaaaagagaaaagcatccaatcttcaattgtcacttaaattagtgacacattattttaaacattggattagagctcttaaaaatcccacgctgctaatctctatcccggcaaaaaacatagcgtgcttacgtcgtacgatcatctccctaaaaaaacaaaacttaaatacctacgccatatacgatcgaaaaaaaaataaagctaaaaaataaaaaggaaagcatgcacacgtacatagaacaattggaaagaaatactaatcaggaaaaatcatcggtgccagcacatatttgttgtcaacggcctttaatctacaattttatgatcttcctccccttatttatagtcctggtgtagatagaacttcctttatggtttaattccgagcggtagtaaatacaagacttagcaatatttgattgatcacaactcattatattccatttattataaatcttccaaagtaattcattataggaatgctttcaagaaatggtttgcttttgcacatcgaaaccaaaaattaatcgtgcggatatgtataattcaaaagaatatatagatgagtgattcatacacagaaatcgggatttttatttaaatctaagaggcattcttatcatattagtagtatattaaaatctcccatgtatttttggggtaatatatttcttttttttaggataatctaaattcacttacaatatatatagtgatgtattattctttttttaataacaaataagatgctcgtacatatgtacgaaattcctttccgatttatattctaaaaatgttctccagtttatattctgtcgttatagtgtttgaaacacaaactataatacatgcccgcgcgaatgcgcgggctacgttcctagttacattatagttacactacaactacactatagttacatttgattgttttttgctcaaaaaacttgcgatagttttttagcaattgtaaaacaactgaatgtggatactctaagcaaggaacatagaaagcaaaattacctctctttctcatagtacatatatttaaaatgaaaggcatacactccgcttatgatcaaaagcaattatcacataatgcagaacggacaactgttcagtcatcttctttttttttgtttggcagggcaatcaatcacatcgaagacgactcttctatagaaaatgatcaagcggaaaaacatagagcgtgggattttttctgtgatgcgtgtgtatcacacggtattttgatcgggaatacagttattctgttcatcacccttcttagttaatccgcaagatctttcagttcctgacatttttctcccagttcaacatctgtctgaatgagtaatgcatcaggatttgctgcccaacaccatgaggtaagcatctctgcccaatcccctctaatccttcactctcggggattaaccgaataagctctaaagaataatcctgggacgatagccacgacaagatgcccaaatgtaagagatgccagcaggaatctccagcagaataatcgaacctcaaggcagtgaagtagcagaactaaaagccaaagtgatgttactgtcagctcaaggccaggaagaggtgctgtttgaacagatctgctaaaaccatctcatggcaactatcccggtgcctcaagttcctaagaataagtctacaataatcttcagtaggtgttttagagggcaagtcgaggaattgcaccccttccatgttgtatttgggaagagtgaaaattacagagcacatatcacagttcttttcccttatttatataggatgaatattaccacaatccttacaattatttgttgctagcttcatatatagttgtgcaatctccaattaattggctcacatggaagtctgactgggtactgctacaaagcagacctcaactaccgagctcactattgctgatcatgtgacacagctgatagtaatggtaatcacaaataaaacagaaattgttgcaacatgtacatgtttttatatgttcttcgcatataaaataaaaactgtttccacatttgcatgcgtcttcttcttacaattgtgagttcctggaaagccaatctgagcttaattaaggtcatggcaccctccaaatgtttccagaaaacaacccagcaaaaccttctctttgctgtaagtaatccagatacatttttgttaatagaaatgagggttacgcccttgcccaaaacagagaacactttcagccttcttctgagctggactagtgcttacctccaggagatgaaactgactcatggcaactatcctaatgcctcaaattcctaaagataaatcatcttcagtcggtgtttttacagggcaaagtgccaaagttgatgaattgcacgccatccattgtattcagagggggtgaaaattacagagcacacaacaatgcatttccccttgattatatagggcgaatattatcacaatcgatgcaattatgataatgtgattaggtctgcttagatgcaattatgacaatgtgattattcttcagcgcaatatataggccggacattatcacaactaacacaactgacagtaacaaaattgcataattattcgtgacttattctttagtgttcctacttaccgaacgttaatttagagtgcctaattggttactacttgtttcaaggtttgcgaacgcaacactgcgtggtattatttttcttcttttcataattattatactatcgtctgttggggagttgaccattttcctttaatgttctcttttatattgttttagtgggacactaggaactggggatgaaaacagagtagatacgtatgaaggagcacgcttcttgagctcctaattggcgtggcctattttttaaagcaaaaacttgttatccatatgaatttctatgaagccctgtcttaactccatttatcaacattacaatatttaattcatttgtttgtagcctcgaataattatcacaaatcgctcagatattcaaatattcggctcgaataactggggccatgaatacaaaaatacggataacttacatatggaaaa

SEQ ID NO: 75543 - DNA, 22157 bp, Oryza sativa
atctatggttggaattatctccctcattttcttctctcataaagccacatcatattacttttaaatttgggtcatcattctatatactatttaaattatgataaacaacatcaacttatgcaagtttctatcgtctagatatcttacacattatttctatttcttattatcataccaaactcccgcagcaacgcgcggggtttcacgtagtattgataaattagaattacgtttggatgacttagaattatgtgtgtgtgtgtgtgcgcgcgcgcgtgtgtgtgtgacttgtgagggagaatagtaatactctcgagagtaagactatttaacgtagagcagctattgtacgccctgtctcccatagttcaaaaacccatttgtagactcggtcagataaggtgaacatcgtctggcccttctcccaattgagcctccttccattcctttagttcatctccatgaaaactgatctatatgcttagtgtttgcagtattttcgcagcaaggccccctttgattcctacagtgattccttaaaaaaggcccctttgattattggattggcaaaaaagatttacatagaattcgaattcctatgaagtgtttcttgcatgtccctttgtaattcataagaaaacgaaagaaactttccatatatggttgtatttatatgcttccctttcacagcaaaatcaccaagagttcttacctctttgtaaaactttccaatgtttttcctactactccgttccattttaagtgcagttgtgagttttcgtgtccaacgtttgaccgtccatgttatttgaaaaaaaatataattttttttaaaaaaattagtcacacataaagtattattcatgttttatcatctaataataataaaaatactaatcataaatttttttcaaataagacggacggttaaacattggacataagcagtgtaaaccaatagtctttctaggatggaggcagtatgacactaccaaagggcttctatatttttctcctgtgtttcaaaacacatgttctttttaccattggtcacatcttttttactgctttttagaacaagacaatcgaaaaccgatagaaaaatatatcaattatagcgagagatttcgtcttttagagttgatggtaccgaacatgagcatgagagttgaggaaaggccaagtgtgggtgacaatagcggacatggggatgaccctgcaagccgcgcttgtcccgtaggcacactaagacaggtgatgggagcacgtgtcgcgatggaatagagaagacaagggaaaagccattccattccatgtcaatggcgtcatcctgtcctcggttcgtgtttccagcgttctcaccatgcctaggatctcctccatcgcttttgctgctgcatcatccacttcaacttcaagttctaatccagtggtcaacatccaagcagacctcgagaagggtaagaaaacctggttttattcttggtgctagaacattacaaggggaaacattttattacaagtgagaaaaaaacacaaaacatcaaaataggccctcactctatgactctaagaacaaaaaagaggaaaataaaggtactagctcattatagtctagtacacatacatgcacacaacaatgtaaattatttcatcacacacatagactagctagctagctagcacattcagaccgaagcaaagacattaatatactccctgtgacatgagaaaacaaacataagttacttgcagctagctagctcacttgattccatccatgtactagttaatcaacaaaacaacatcaatcacgctgaatatcgacttcactacgatggacgatatggaaagcgtggccttccttcatagggagatcatagcaatcgtcagattcatcacgaggactaaaatttgtgatttgaatccttttcatcctggagtcaccgcagtcatttttggccatgagtaaccaagcaaaggtgatgagctcccctccactggccagttgttccacgtgaagctccgcccttgacttgccggcggaatagaggaggactctcacccacatttcgaccagctcgtcaagtaccccatctccttcaggctggtcacccactagtaacgagtcatggatatttttgtaatgctcaacatcagagatgtcattagtcctcctctggaacatacgttccgcagttttaatcgaggatattgcactggtattgagtggaagcatggaagggtggttaaccaaaagatatatcatatagtttgacagttttctgcagacatccaccaaggaatgattcccagggtattgcctgaggaaaacctctgtgaccatatgcatcatgagaagagcagtaccaaagtctgcggtgagaacatcttgtatctgttccaggaatgagccaacatatctccattctaggtattctgtatcctgaccatcgacttcattcattaagccataaaggccaaacacaactcgttccatagtatctctatccgtcttgacatacccagtgtgtatcagcttgtttatccaagatatctccttagcaccaactttgtttgctatgtttctcaaataggtcataattttgggtgtgcatgatgttggcgggctgatgcctaccaacctgttcacgcaattgtactgtcccattgaattagaccaccgtggcctattctctggccatccaatgcgactggaaaaaagataccatgaaaaacaggcaagccagttgtactttcgaaccttcaaccatgcccacgtccatggagacatcatgaaaataagcactgcgcaaacttcaaggagaagttctccaatgaatagtgacatggtgaccgcaatatcaactttactataccgccgtttctctgttgaaagaaagagggcaaaagcaacaattgaggtagatatagcaatgaatcgaagtgcaatacctcccttttttctaagaagaagtgcctttgtgtagaggtcatcatacatcatgccgagctgaagctgcaccaaacttaattcgggctttattatagtttcaattataattttctccaattctgcttttctattttcgattgatatttcatctccctccaattgtacttcttcatcaccttcaattggtgtgttatttcctgtggattgtatagcttcatcattctcagttgagattttattttccttcggttctactacttcatcatctttaattaatattttatattccttctgctctactatttcttgatctatatccacagacctagtggctttctccaattctactgcttcttcatcttctctcacggatctagcagcttcttccgattctactatttcttcatcttcactctcagagttagcagtagacctgagactgcgtgcagcaaagatatcatggatttgtaacatggaatttaaagcagtgagaacataatcgtaataggtcatattcgacccgttgctcgcttctggcaattgtatctcatacatgtgtcgaatagtggagttctcaatgctttcaaagctcccccacttgagagaccatgacctagtgaaatacttgataaatccagtagcaaacataaatattcctgcaagtagaagctccttgtgtcttccaatagaattgaagaaaacaaaaacagccagaacagcatagaacagaagtttccctgaacgtgtcaaccatgcattcttgtcctccattttaaaagcagtaatcgtgtcctgcccaccaagatgaataagaagaaatggcgcccaaaagaaagcaattgattgggggttaccctcttgtcgtgagaggccaccgagggcatagattgctatgatatctgcccctagataagttgatgagattaagaccctggtgaacttgtcagtgatgtgcacgtgaaatctacccgcaaagaataggaccacttgcattgcgaagctcaagagcacaggcacatatttctccatttcgtatctcatagcacctgttgattagaatagcatacaatatcattcagtgtgacttcggcaattggaagaagcaatgctttataaatggcagtacaatcaatccataccattcatcctttataatccaaatcttcatatttatttatactaccaaaccactcatatagtagattaatttttgtactgtggtagtagacttcataaatcaacagttaatatctccttataataatattggtatagaatactgtatcaccgtaaagttactcttggacaacatagcgaattatctagtcgatcatatactatttggttcaaatatatatatatatatatatatattatgttttagccttatgtacacgaatgtagtcactaccagtaaaagtattttatcttacaaaatacaaataatatacccaccacattaggtaattaacaagggtatctagagaaagttggaaggaaatagacaaagtgccaaatagattgataacctggatttttttttatctatggacattcgtccttgatactgaggtcaggatgtcaatggttctcttatataagaaatatagatcacctcatggattttctctaaataagtcatcgttagaacacttggataaaacatgaaatggtgggtctccatctaatttataaacatctctcaacacaaagccctaactcatgcactttcctctctctgatccatcatatctcctctcccccctctctttctctctctaagccattacctctgtttcccacccacttgtgtgctcttgattctctacaatgctcctttctccatctgcatagaccattgccatggcatcccttcctcccatgaatctacaacaccgcctgcctccatctacctcctaacctatcgtacttcttgctttagagtggaaattccactaggtgccatcccttgggatcaaatccatgctgctggcgaccttagccccacgaccactcaggagccttcctggttaccatcttttatatattgaacgcctctaacccacggacccgccatagatgttgtctagttcatctgttgccatccataccagctcaaatgactgatccactcttccgccaagtgaaacaatgtcgtcccatgcatatttttataatatagttggatggctgaaatttgaggttgaattcaagatgtttagcttactgattgcgtcttattcttgacatgattgatgaagttcatggagattaataaatatcttactttgattttatttatctggcctctaaactaagataataatttattttattatgtcgttaattacctttttatagtaaaattcttagaagattttgtaattacaagtgagtttatattgcattgactataaattttagatgtcattatcttacactagcctataaatttatacagatgagtgtaattgaatgaatatttttttgacgtgaacgtttgcatagtcttcaataaacgtgtttcatcatttatcttttctaatttatttagaaaatataaatggtgaaacatgtttattgaagattgtgcaagcgtctaaaataatggataaaaaatggacatagtggtatgcagaaaaaatgtttagttgtatgagaatttctgttttgtttactgtgaatacaggaaaaaatggctaagttgattatatccattagtgggttgttaaagtgatttattagcacatcagattctattaattagttgtctgttaattagtctatgaggtgagcctaaacatgcaacggttacggttgattgagtgatgaacgctttggatgttatcaacggcaaattttgccgtttgcctcaaaggcagacgatacgaacagacttggtggttgtaccgatggtagctaggttaccagagaagagatcttctatgtatgaatgggtttaaatagcaatttgtgtgatgtttgtagtgccttaattttatatatgattaagactgtgtttagatcaggggtgaaaagttttagcgtgtcacatcgggtatacggacacatatttgaagtattaagcgtagactaataatagattccacctataaactgcgagacgaatttattaagcctaattaatccgttatttgcaaatttttactgtagcaccacattaatgtcagatcatggaataattaggtttaaaagattcgcctcgcaatttacacgccactgtctaattaggtttttttctatatttaatactctatgcatgtgccaaacattcgatataatagggtgaaaaattttaccagggatttaaacaggccctaaatccttaaatatcagtttttatcttttatgacccggcaataaagttagctggccaaccgtattaaaggcaatcccacacgagaaaattgtaagtccccatgaccgactgcaactcttcctcatcctcaacaaccctacccacgtcaccgcctctcctagccatgccgctgctgcctccatacccagctgcaccattgtcctcctcctatcgtgctggagggtggcatcagctgacggatttggtggcaccggatcctagaccactaggaggagaaggagaattactaagtgacttttaatattttttttaatattcaagctaaaagtaaattatattagttatttacaacaaataaaaatagtttgtcaaactatatatattcagagagaaataaatttaatagactctgtatcagattgtagatgaaatatgatatcccgcactttgattatattgatgaatttatgttaagtattataaaaatgatggatatatatgttaaaaatattgtaaaaaataatgtgaaaaaaatgattggatgttgatttgtagaatgaattatatatgatattgcatgcttgcataagtttttatataattattgctagtggatgatgaggtggtatgtttgcatgttgagctttagaattagtaggttataactttatagtaagataggattcatagtgccgttcggaccccatgccgtgactcaaggaaaaaaagcaagatacacgtgtgcaagctgagcaggggtcaggacctccacggggctctctccccacgctactcacctaggatttggctgaagaacgagtgatcaaagttggatacagggattttaggtagatgtggtagaagcgaacgtggcacggaatattcgttaggggaatgatgcaactgaatgccaacgttaactcaacgcactgtaaacgcccttatccaacaaccctagagcctggtttgcggatgggatccccaccgtcccacgatgccgcctctagcgtgctggggaggaagtgagatagggagggtgatgacggcggcaacttaggatggctgacagatctgacattgcgaggcaaaggccaacggattgggcatcaggaaagctagcggccgacggatcaattgtacctgaggctggtggggccgatggcatgaagtgaatgtttgtgctttttaaatcaacttgatctcaagattttattgtaagattgtttagtttactgttgtgagttgatctttatgtaatttgatatctggattgaaattgtattatagattggagtaacatgttgatgtaaccatctattttactttgtccccaaaatgagtaacactggtggtctagatgccagtttttgaaacggtagagattggcctttctatgccggtgatagtcctatctatatatactactataaaatacaacaagtggtggtggttataataacctctctaccactactttagcaaattttctaaattagtccatcatattttatgatattatacaataatctaatatttgtttcaagtaaatactatatattcaaatgagcaaacaaacaataatagcatacttgataaaacaataattatctatgccatattattatatattattttatccatagcaaaatatgggcatttcgctactaaaattaaaattcgatgtgatgcatactagtctggaccaaatatttaaaatataaagtttaattggagtcatatctcaaaccgacgagcatttgttactgaggaaaaactgtttatggggataaagaaaacacacacatatacttaccgatggatggagtcgtcatgttggacctggatgtgcaaacttgctgcttcctgagcctcctcttgcatatgttcccggacctgcctcttgcctgtctggcttcaccttaaatagaagaacgcaggcaggcatatgcaacttgctactggggtctgggagtaccaagtaaacgctagtcttcctggtttctagggccgtggtcgatcgtgtggggactctcacaactaagggcagtctcaactcatagtgctcataagcagtgtctatggtgtcatatcaataagacatcacaatataaactacactctacgatccatggtttcttaaagttagccattaataaatgcatcatctctcttctctaccaatcttatttattcttcatctattatgaaaacattattctctccaaatgcaaaacttgatagtgtctagtgcatagattctcgtgttgaagctgtgtcttgcatgagacccagtttcctcctctcttcactctctcttaattaatatagtgttacgtaagctaaaagtcctacatggcaatgtagttaataccatagacaccatcctaggtggagggttgggactgccctaacgtgggtgcacttgccactcgcgtagctaattgggagtaaaatttatttaacatgtaaagagacccgtgtaatggtactatatatctgagtgcgatggcaaccaagcatattccatacgaagccagctttggtgtgctgttctgtttacaccaactttacatatattgtaggactagtcttgtaaaatttatatacatatccaaaatttcaggcatatactcatgagggaaattaaccaatttcgtctgcaggaacctttgggccactttatctggaaaaaggtggcaactttggggtcatcatacatttgctgatgcatttgggtaagttcacacgatcgcgaccctacaaaccaggaagactagcgtttacttggtaattaaagacttagaactgctaccgaggactcctccgttgcataattcttaacgtttcggataaggttgagatcaaactttaatagctttgcttatcaataactttaaaaatacttagtttaaaaggttgagaacaatatgtatagatttgtctttccaagaactgtaatacggagtaaaagtaaacatgtatttatttattgtgtatattataataaaaaataagattaaagatatattttgaagaccatattattatctaaaacattaagaattacgaaaccggagagagtatatgcccctgggtttgatccccgccgccgtggcctcccattcgcggcgttcctcgtggagggcaaaggaggatgggatgatgcagtcgtcattcaggggatttattttttttattagcaagtgtcattatcttctaataaaatcagggccagctatggggcagtacggatggtgcgactgtactgggcctctaaaaattaggggcctccaaaatatgtatactatggtatcaagcctgataggcttagagaaaagacagaagaccaattggcgatcgagcatatcgtgactgcttgattgtattttaaacttattagtgtgaaattcgttaatgacaatgagtttttaaatattatcttatattttttggtgtatgggggtctttttttttttccgcaccaggccacaaaaagtcagggccgtccttgaataaaaccctcactctgatatgctaactaaaagttgcctgctattctcttttctttacataagcgtagttgttcagtaactgaacctggcctgatggcattagtgctagtgacttattattagcagtggagattaagaaattcagcccaaactgtctacaaaggcattagaagtaagaatgttatatcgtaaatactcctcctgttttcgaatgtaaaatgttttagtttaaaacaagttaattatatttctcccttatggccatatcgcaaaaaataggatacaccagtttaccaactttttctaggaagtgcaaaaataataatccatgaaccaataaagcgtaatagacaacgaactcagaaacgcacttcaatatttttaccagatcagtggactacaataagcccatctaaatttccattttctaatattgatgacatatatagggtggcataggagttctgtagaggaatatatatttaagagtaaattgaatcttgggtcactcttttttgccattgttgcaatttggattaagggtaaacaaactttttcaccttagaccacgtatcgtctttactggtcgtttaagtttggactatttcttctacctctagctccccctctctcctctctttctctctttactcatgggcaggaagaactgttgagattataggtatataatgatttaatatattccataaataaatcatggcattacagatgtatactagcattaacgcatcattagatctacacatgtaaactatacatgtaaactaagctgtaaaacataaacagatcaaatatacgcaacatattaaacacgtaccgaggtgatagaaagaccggctgctcggcaggaacttttcgcgattgcaggcgtcaacgaaggcgcacagcatgcgagcgaagaggatgacgagccgtcacggacgaatagggagcagtcgcgctaaacgcttcccaaaaaccttattgctgccttctcctggtgcaggaagtcgaaggcagatgttccggagacctggtctcccgatcgccggtgcacgccggcgagcgggatgtagtaatctacgagcgacagcgcagcacagagtaggaggcaaaccctagattgatttcgcgtgtgttgcgtgaagacggcaggtcggtttatatagagaagggtcgcttgatcagggcgcccgcacgatctccactatgcgtaaccaaaccggataagtcacgcgtaacttatccagactccaagccgttttcacgcaccggatttttcggaacgtttccaaaacagaaacgaatccgaatttgcagcaaaacaaaactgcaaaaggaggctgcatctgcgcaaggtgaggaatcaattttggcggaccattcgacgtatacgtcgtgcacgcgcgccgcctgccctgccaggccaggcgaggcgagcgagcgcgcgcgtgtgttccccctcttctctccaccacacatgcttcaagtggctaggaagacatcctcccttttaaggaggtcccctttcctagaataagcaaggtggtactaaactccacatgcatgccatcccatgaggtgggcttttgtgattttctaaagaattaatcttcgagtgggctaaggcccatccattaattccaacaatcccccaccaaatgtcaaaatcccactgagatttgcctttaccaatgtactgtttatataccagcggttcgatggagaccgattaaggttgaacatccatctagaactccaagctacacttactcacaacttgaacaatggactacgccttgaattgcaagtcttgtgcaagcaagtttcactcaaagtcttatctggtactagatcgtctgtacactacccctcgggtggagcgtataagtcatactcctaggtctttagtaagcttcctagaagattcacccaaaatcttcatagactgcgaccaacagtcaagctcacaaaggtgagttctttcaagaatgctctgcaggacagcatcttcgctaattaaagccaacagaactcattaaggtatagccaacctgccttgcagctcacgagagtacatgcatcttcacttagagagggtatatattggtactctcctctagtttactaatggtttgttcttcccaggatctaatttacgggatctccgatcacatagactgggttaccaccatagtataactcacatgggtctcaaacccatctccttcgatgtattgtctatcacatttcgtgatagtcccttcgtgaagggatctgccaggtttctagttgtttggatgtaatccaacgttataactccggagtttctcaatttcctgacagacttcaatcgtcttttcacatgtctagacgatttcatattatccttagaactattcactttgacaattaccgtttgattgtcacagttcataaggatagccggcaccggtttttcaacaataggcagatccattaatagatcacgcagccattctgcctcaacagtagcagtatccagtgccgtcaactccgcttccatggttgacctcgtcaaaatggtctgtttgcaagatctccacgaaacagcaccaccacctagtgtgaagacatattcactagtggctttgatctcatccacatcagagatccagttagaatcactatatcattccagtaccgcagggtacctagaatagtgaagccccaattccatagtacctttcagatagcgcattactcgctcaagcgcacgccagtgatcatctcctggattagaggtaaaccggctcaacttgctcacagcaaaggagatatcaggcctagttgcactagccaggtacatcagcgagccaatgatttggtagtattccagttgattcctagcaattctcttgttcttgcgaagcaacaagctaggatcataaggtgttggagaaggcttactatcaatgtagccaaagcgattcgagatcttctccacataatgggactgcaagagtgtaatcacattctcacctctaattagcttgatgtttaggataacatcagctactcccaaatccttcatatcaaatttttgagacaagaataatttaacctcatttattacctcaagatttgtcccaaatatcagtatgtcatcaacatacaagcacagaataactccctcacccccaccatggcgatagtatacacatttatctgcctcattgactgcgaagcctgcagatgtcaatgttctatcaaatttctcatgccattgcttaggagcttgtttcagaccatacaaagacttcaacaatttgcacactttgccttcttgaccttcatctacaaacccatcaggttgatccatatagatctcctcatccagctctccattaagaaaagctgtttttaacgtccatttgatgaacgagaagaccatgtgaggctgctagggaaagtagcacacgaattgtggtcaatctagcaacaggtgagtaagcgtcaaagaaatcttcgccttctttctgagtatagcccttagcaacaagtcgagccttgtactttttaatagtaccatcaggcctaaacttcttcttgaacacccacttgcaccccacaggtttacatccatagggtcgctttatcacttcccaagtcccgttagcgataatggaatccatttcactacggacagcctccttccagtagtctgcatcaggagatgcatatgcttctgaaattgacttaggagtgtcgtccacgaggtacacagtgaaatcatcaccaaaggacttagccgtcctttgtcttttactccttcgaggagcttcactgtcatcctccttagtgacatgttcatgtgtatgttcagtttgttctggtggtgtgattgaattggcaattatttcagaaggttgactagaactactatgtgtatccttcgttgggaaaaaggtagcatcacgagactccataattgtaccaacatgcatgtcaggtacctcagatttaactattaaaaatctataggcaatgctgtggtgagcatatcccagaaagacacagtccacagtcttaggtccaagtttgcgcttcttcgttattggtacattgactttcgccaagcacccccatgtgcgcaagaaagaaagtgatggttttctcccaatccatatttcatatggtgttttgtccttatttctgttaggaactctgtttaacacatgattcgaggtcagcaatgcctctccccaccatgccttaggtagtcccgcggtgtccaacatggcattcaccaagtgtgtccaacatggcattcaccaagtcagtcagtgtgcggttctccctttcagcaatcccattagactcaggagaatagggaggcgtcctctcatgtataatgtcatgttcctcacagaataagtcaaactcgtttgagaaaaactctccaccacgatcagacctaagtctttttatctttctatcaagttgattttcaacttctgccttataaattttaaaatagtctagagcctcgtctttcattttcaacaagtacacatagcaaaatctagtagcatcatcaatcaacgtcatgaaatatcgttttccacccttcgtcaacacctaattcatttcacaaagatctgaatgtaagagttctagaggtgccaagtttctctcctcagcagccttgtaaggcttgcaaggttgctttgattgcacacaactatggcacttagaacctttgacaatggaaaacttaggaattaaacacatgctggaaagtcgagacatcaagccaaaattaatatgacataaacgtgagtgccagacattagcctcatcatccacactgccataaatatggttcatagactcaaattgtgtttgagtgcagtaccgaaacttctccaagatggaggaagtttcgcaataatgcacccggccacaaatttgtcgggtaagacacacttaaggagttcgaattccttagccatggtttgtatcttatgagcctgttcgactacagaacggttgtcagccatcttgtagtcgtgaaactgctccatgatatacagatcattgctagcatcagtagcaccgaatttagtattcagtgcatcccacaactccttagcgtcggtcatatgcatatacacctcgaccagacgatcgccaagaacgataagaatgcatcccacaaagagagtagtgacttcctcgaattgcttctgctgttcagtagtaagaactccttcaggtttgccagtactcacccagaaacatttcatagctgtcagccacagagtgaccctgatctgccatctcttaaagtgcacaccggtgaatttatccggcctcagtgcatcggcaaaaccagccatagtaaaatcacagtgcctataataaggtttttggattgttgagattataagcatataatgatttaatatatttcataaataaatcatggcattgcagatgtatactagcattaacgcatcattagatctacacatgtaaactaagcagtaaaacatgaacagatcaaatatgcgcaacatattaaacatgtaccgaggtggtagaaagaccggctgtgcaggacgtcgaaggcagaggttccggagacctgctctcccgatcgccggcgtgcagggacgtcgaaggcagaggttccggagacctgctctcccgatcgccgatgcacgccggtgagcgggatggagtaatctacgagcgacggcgcagcacagagtaggaggcaaaccctagattgatttcgcgtgtgttgcgtgaagacggcgggtcggtttatataaagaagggtcgcttgatcagggcgcctgcacgatctccactgcgcgtaaccgaatttgacgcgtaacgtcgtgcacgcgcgccgcctgccttgttaggcgaggcgagcgagcacgcgcgtgttccccctcttctctccaccacacatgtttcaagtggctaggagggcatcctcccttttaagaaggtccccctctctagaataagcaaggtggtactaaactccacatgcatgttatcccatgaggtgggcttttgtaattttccaaagaattaatcttcgagtggactaaggcccatccattaattccaacaagaaccaccactacaagtgagcaggttgagcagccacctgccagtgccgtgcttgcgctggaactccgccagcaccagcatcaatgccatgtgattgaaaaatggcctaaggaccttggttgcacttgacagaaataaagaagataagggcagaagaaattccccattgccaagtggaggtaaagctcgagctcaactaccacgacatgaatttagatgtgaatatgtgatgttgctggagcacctccattgcaaggaaaccatcattgcgatggatttgggtggcagcgtccgatttgtgcaacagccacaagatggctctcatcgtggttgggcttgtcctgcatcatcccctacgaggatcagaccatggactgattgggggcgatgcagtaatgtgttcacctcaatggcagcaacccctcaaataggagttggccacagcggcgcagttcgtgatgtggtcaccactcgttgtcttcggtgaaacgagaagagacagataggaccttggaggtagagaacagagcagaaggtagaagaactagcctaaactgaatcaactagtaaagataggtggtttaatatgtaatatgtcactctaacaacgtgcaggtataaattcaactctacaattttttaacaaaaataacaaatttaactctaattattatacgtatattcacatacgtatattcacagttgaatttgatataacatgtagaaatcaaatttaaactacaagtagtttgtagaggtgatcttgtcaataatatatgacaaattttttcataattatttatttgtcatgtaataaatggatgtacatccaccctgattagaatcgactgccaatattgcgttaactggttgcaacatcgtagtcgcattctcgcagcagcagttacgattgagaaactcggttcagagcttgcttctcccagacccagctgtccctgtgggtgcgcgcctggaggaggaagaggcggcggcggggaggctgcccatggccttggcccgctcccgcagcgccaccttctgcaccttccccgtcgccgtcttcggaagctcctcctccaccaccaccaccgtccgcggcgccatgtatcgcggcagccgcgcgcggcagaacgccatcagctcctcctccaccgccgcgccgcctcctcctcctcctcctcctcctctcagcttcacgaacgcgcacggcgtctcgccccagtactcgtccggccgccccaccaccgccgcctcctccaccgccgggtgcccgaacagcgccgcctccacctcgaccgtgctgatgttctccccgccggagatgatgatgtccttggaccggtccaggatcttgatgtacccgtccttctcccgcaccggcaggtcgcccgaccggagccacccgccggcgagcgcctccgccgtcgcgccgccgtccttgtagtacccgctcatcaccgtgttcccccggagcatcacctccccgaccgtccgcccgtccgccggcacgctccgcatcgtcgccgggtccttcacgtccgccgcctccagcccgacgtggtggagcccctgccgcgacttgatccgggcgcgctcctccgccgtcagcgcgtcccactccggcttccacgtgcacaccgtcgccggcccgtacgtctccgtcagcccgtacgagtggatcaccaggaacccctgctcctccatccggaacagcacctgcggcggcggcggcgcgccgccggtcatcaccgtcaccctcctcctcctcccgcccggctgccgccgccgcatcgtccgccgtcgcgttcacgatcatgctcagcaccgtcggcgcgccgcccatgtgcgtcacgccgtgccgcgccacgctgtcgaagatgtccgccccggtcaccctgcgaacgcacacgttcgtgccgccatggtctgccacgccccacacctggcaccacccgttgcagtggaacatcggcacggtccacaggtacaccggcgtctccgccatggcgttcacgatcacggcggcaaggctgctcaggtacgcgccccggtggctgtagatcacgcccttgggcctcgacgtcgtcccgaaggtgtagttcagggcgatcggctcgttctcgtcggccggccaccggatcgcgaagtccggcgacgatccgacgtcggcggcgctcagaaggtgctcgtactcgtaatcgactcgggtgaccttgatcttggcatcaggaggtgatcgttcgttttcgtcgaggagctcgctgatgagaaccaagacgggacgcctggctccggcttcggcgacgagcacgagggctttctgggcgacgccgagcagagcgcggtcgacgaagacgaccttggcctcggagtggcgcagcaggacggccgccatggcggcgtcgaggcgcgagttgagcgtgcagatgacggcgccggccatggggacgccgaagtggagctcgcaaacagcaggaatgttctgcgcgaacaccgcaacctgcgcatgaaccaaaatgtgaatcaccgcgattaaattacagcatttggcatgcgaattcacagcgattttgaggggtgaaattaatgttactgttacagtggcgtggcgcctgttcatacgtaccacgtcgtggcgctggacgccgaggagcccggtgagggcggcggcgaggcggaggcagcgggcccgagtgtcccgccaggtgcgcgacacggccacgccggcgctgccatccgaggcgacaatagcgagacggtcggggtacacgagcgcggtgcgctcgaggaagctgatgggcgtgagcggcgcgtggttggcggagcagagcaccgtgccctccatcgatatcgtcgaactagcagtggagaggaggagagctgctgctgctgctactggagtctggagctcgagagaggcagccatggagtctgtgcatggctgcctatttatagcgcggcagccgctgcaggctagggtagtgaggtggtgggtggggggaggttggaatgcaagccgcagagtgcgcagaatcattgggccgcgttggttagttttctgattcattcagcggcgcggccgcccgccaaagcacactagcacagcaccggcacaatgagggttagaattagattccaatttcgatacttgtaaactactccctcactcctatcttaaatacggttacagttgacatgtatggcgtttgatctgtcttatttcaaaaatttataaaataaataaaataaataagttacatataaagtattatttatattttatcatctaataataatataaatagtaattataaaattttttaaataaaacagaccataaaacgttggatacggaaatttataactgcacttaggagccgaggggttactagtagtatagctttattatccatcttaggttacatgacagcattggaagccagatttcaggtatcatatcatataaaactactggtaataaagttggtgaagtgtcatcagtttcgcacatagctcaccctgtgaatggtcatccagcttgaccgtggatcttctcatccgagatccgacactagcgcccgtcctattcagaccctgctgacataagcactgagctacgcctacaaccgataagtcatgataaaataatcaaaataattaaaaaaaagtttatgaggaaaactactttcatttgtatcaataaatgtttaaaaaataatattgaaaaataaactacggtataaaaattttaaaatcagcactaaaattatcttcaaaattcaaattttaattgcaaccgataaatagataagcaaacaataaaagaaaccttgtgcagctctgtcccgtcaaatccatccaccactctgccgaggggacataaaacaaaaaagagaatcagtgcattcaggcatgtcccccttagaaaagtttgtttagaaaagttcttctagaatctctctccctatataaattatgggatattttaaatgtcatgttaccgttgatatgtactatacttttattataaccgtatatcatattgaaagttcatactccctccgtctcattttaaatgtaaccatgagtttttacgtccaactttaatcgttcgtcttatttgaaaaaaaaaaattaattactaccaccgttccaaaataagtgcagtcgtcgaaatccatgtccaacgtttgaccgtccgtcttatttgaaaaattttaaaaaaattagtcacacataaagcactattcatgttttatcatataataacaataaaaataataatcataaaaaattttcaaataagacgaacggtcaaacgttgaagatgaatagtgcaaaactgcacttattttgggacggaggtagtagtattttgttgttatgagatgacaaaacatgaatattactttatgcgtgacttacgtttttaatttttttcaaaaaattttcaaataagacggacgttcaaagttaggcacggaaactcatggctgcacttaaaatagaacggagggagtattaaacaagacatgcaattagattttttttttcaaaaccttggacataataaacatgaagttgttgcataaaaatcataaaactctcaacttagtatattgttagtatattaaaaaaatttgatattattggttaagaagttctaatttatgtgaaatgctcttaaatccaagccagtacattttaaaaataaccaatacatctagcatatttataacatactcccttcgtttttaaatataaagatttttagattattaagcaaatactaaggtttggttgtttagttatttcagttggaagttgtaattttgaattgcttagatctttttcctagcatgtgattggctttggacccattgaaacagtgatgggaattagcgtaagaatgcttatattgtgacacaaaatttgaatcatataaatcgttatagtttggattagcgaacaacaatatatgtaactcacggggttgatgtctaccttattcaaatagcataataatagcataatagtatctccattttatttatgaatgaatgatttaaaataacaaatgttgtcattattaaacaaatgattttttttctggccaaacaccccaataggttgcaggcaggtgggccataagtgttcacgtctacaaaaatcaacctccattttcgcatatcgcaggctcgcatgtaaaaaacaatttttgcaagcgggtcttttaacaaatcagatattttcgcatgcgaacatgttaagtgatatgcatggaaaaatcacccattttttattctccactcctccctctgtctaactcctcctctcccctactcctccttactccggatgactcctcctcttccctcgaatccctcccgacggcaggcaccagcggcaacgtcagcggtgggcgagggcaagggcgacagcaacggccctcaccctccctcacatggatctggcggtgggctcaagcgggaggccagtgcaggagcggccccgcgcggatccgtcggctgcatcctcccctgcactgatctggtagccgccgccctcccccacgtggatctggtggtgggcggtgaattagggtttgggatgactccggcggtgacaacatctggcagcagcgggctagggtttgggaataaatcagggagctagggtttcaacttttgaatttttgagattttattgttttcagacttttatttttgcatgtggatgacataagcacccatacgcaaaaatctgattttcatgtacaggtgcgtcacgaacacagaaataacgatttttgtagccccctaggtgcgtgcgggttgcccagcctcctgcaaaaatctaatttgaccgtatggaaaaaaaatacattttgtttcagatgggcaaaaaaaatcaacatattccctctattcataaacatttttatgttcaagacaagatttgaaagttttaaaacttgaagattagtgtacaaaatctattaagtacatataatattatatatgacagtaccttttcaggataaatctacatatagcttttttttttccaaattaagggtgagatgttattggtgatcaaacttttaatagtttggctgaattttactctaaatatcaaatatttatgacctttgggagtaatatgtaataagcttaaatataattataatgaaatgtctcttggtgtgacatgaata

SEQ ID NO: 75544 - DNA, 12414 bp, Oryza sativa
aaagcgcttcccaaaaaccttattgccgccttctcccggtgcaggacgttgaaggcagaggttccggagacctgctctcccgatcgcaagtgcacgccggcgagcgggatggagtaatctacgagcgacggcgcagcacagagtaggaggtaaaccctagattgatttcgcgtgtgttgtatgaagacggcgggtcggtttatatagagaagggtcgcttgatcagggcgcccgcacgatctccactacgcgtaaccgacccgcataagtcgcgcgtaacttatccggactccacgccgtttgcacgcaccggattttttcggaacgtttccaaaacaaaaacgaatccgaatttgcagcaaaacaaaactgcaaaaggaggctacatctgcgcaaggtgaagaaccaattttggcggaccattcgacacgtacgtcgtgcacgcgcaccgcctgccctgccaggcgaggcgagcgagcgcgcgcgtgttccccctcttctctccaccacacatacttcaagtggctaggagggcatcctctcttttaaggaggtccccctctcctagaataagcaaggtggtactaaactccacatgcatgccatcccaggaggtgggcttttgtgattttccaaagaattaatcttcgagtggactaaggcccatacattaattccaacaatcccccaccaaatctcaaaatcccactgagatttgccttttccaatgtactgtttatataccagcggttcgatggagaccgattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcgtaggtctttagtaagcttcctagaagattcacccaaaatcttcatagactgcgaccaacagtcaagctcacaaaggtgagttctttcaagaatgctctgcaggacaacatcttcgctaattaaagccaacagaactcattaaggcatagccaacctgccttgcagctcacgagagtacatgcatcttcacttggagagggtatgtattggtactctcctctagtttactaatggtttgttcttcccaggatctaatttacgggatctctgatcacatagactgggttaccaccatagtataactcacatgggtctcaaacccatctccttcgatgcattttctatcacatttcgtgatagtcccttcgtgaagggatctgctaggtttctagctgtttggatgtaatccaacgttataactccggagtttcttaatttcctgacagacttcaatcgtcgtttcacatgtctagacgatttcatattatccttagaactattcactttgacaattaccgtttgattgtcacagttcataaggatagccggcaccggtttttcaacaataggccgatccattaatagatcacgcagccattctgcctcaacagtagcagtatccaatgctgtcagctctgtttccatggttgacctcgtcaaaatggtctgtttgcaagacctccatgaaacaacaccaccacccaatgtgaagacatattcactagtggctttgatctcatccacatcagagatccagttagaatcactataaccctccagtaccgcaggatacccaatatagtgaagccccaattccacagtacctttctgactaagtgtcaaagaaatattcgccttctttctgagtatagcccttagcaacaagccgagccttgtacttttcaatagtaccgtcaggcctaagcttctttttgaacacccacttgcatcccacaggtttacacccatagggtcgctctgtctcctcccaagtcccgttagcgataatggaatccatttcactacggacagcctccttccagtagtctgcatcaggagatgcatatgcttctgaaattaacttaggagtgtcatccacgaggtacacagtgaaatcatcaccaaaagacttagccgtcctttgtctcttactccttcgaggagctgcactgtcatcctcctcagtgacatgttcatgtgtatgttcagtttgttctggtggtgtgattgaactaggaattatttcagatgattggctcgaactactatgtgtattcttcattgggaaaaagctctcaaagaaggtagcatcacgagactccataattgtaccaacatgcatgtcaggtacctcagatttaactattaaaaatttataggcaatgctttgataagcatatcccagaaagacacagtccacagtcttaggtccaagtttgcgcttctttgttattggtacattgactttcgccaagcacccccatgtgcgcaagtaagaaagtgatgattttctcccaatccatatctcatatggtgttttgtccttatttctgttaggaactctgtttaacacatgattcgaggtcaacaatgcctccccccaccatgccttaggtagtcccgcagtgtccaacatggcattcaccaagtcagtcaatgtacggttcttcctttcagcaatcccattagactcaagagaatagggaggcgtcctctcatgtatgatgccatgttcctcacagaataagtcaaactcgtttgagaaaaactctccaccactatcagacctaagtctttttatctttctgtcaagttgattttcaacttctgccttataaattttaaaatagtctagagcctcgtctttcgttttcaacaagtacacatagcaaaatctagtagcatcatcaatcaacgtcatgaaatatcgttttccaccctttgtcaacaccctattcatttcacaaaaatctgaatgtaggagttctagtggtgccaagtttctttcctcggcagccttgtgaggcttgcgaggttgcttcgattgcacataactatggcacttagaacctttaacaatggaaaacttaggaattaaacacatgctggaaagccgagacatcaagccaaaattaatatgacataaacgtgagtgccaaatattagcctcatcatccacactgccacaaatatggttcatagacttattgcagaaatcagaaagggaaaagcggaacaggcctccgcactcataacctttaccaataaaatatccatgtttagacacgactactttattagactcaaaaaccaacttaaatctgtctctagtcagacgggagccactaacaagattcctgtcgatagaagggacatgctgcacgttcttcagctgcacgatctttcccgaagtaaacttcagatctaccgtgccaacaccatgaacatgcaggacggtggaaccccgagcgacctgataagaagaaaacaatgagatgtcagcacaaacatgtacactggccccagtatcaacccaccaattagtagactgattaactgaaaaaacagtaggtaaattaccatacccgcttccatctccagtgttgccaatggtcacgttagcaaacttagaagtctgccctgcaggtgccttcatccctttgcgctgtggacacttcctagccagatgaccaagttggccacacacaaagcaagtcctctcatcctgattaagattgttgttgttcttcttctgcttcttgaagttggtggtctgctaagctttgtatttccccttgctcttgttctgggccttgtgcacaacattggcactggactgcccaccatcgcccttagacgcggcatctttttcctgagctttctccttaacatcaagagacggtatcaagccctcaacggagtattcttgtctcttgtgtttgagtgcagtacggaaacttctccaagatagaggtagtttcgcaataatacaccaggccacaaatttgtcgggtaagacacacttaaggagttcgagttccttagccatggtttgtatctcatgagcctgttcgactacagaacggttgtcagccatcttgtagtcatgaaactgctccatgatatacagattattgctagcatcagtagcaccgaatttagtattcagtgcatcccacaactccttagcgtcggtcatatgcatatacacctcgaccagacaatcgccaagaacgctaagaatgcatcccacaaagagagtagtggcttcctcgaattgcttctgctgttcaatagtaagaactccttcaggtttgccaatactcacccagaagcatttcatagctgtcagccacagaatgaccctgatctgccatctcttaaaatgcataccggtaaatttatctggcctcagtgcatcggcaaaaccagccatagtaaaatcacagtgcctataataaggtttttggattgttgagattataggcatataatgatttaatctattccataaataaatcatgacattacagatgaaaactagcatgaacgcatcattagatctacacatgtaaactacacagtataacatgaacagatcaaatatgcgcaacatattgaacacgtaccgaggtggcgggaagaccggctgctcgatcgaaacttttcgcaggcgtctacgaaggcacgcagcacgcgagcgaagaggaaggcgagccgtcgcggacgaacagggagcagtctcgcaaagcgcttcgcaaaaaccttattgccgccttctcccggtgcaggatgtcgaaggcaaaggttccggagacctgctctcccgatcgcaggtgcacgccggcgagcgggatggaataatctacgagcgacggtgcagtacaaagtagcaggcaaaccctagattgatttcgcgtgtgttgcgtgaagacggcgggtcggtttatatagagaagggtcacttgatcagggcgcccgcacgatctccactgcgcgtaaccgaaccggataagtcgcgcgtaacttatccggactccacgccgtttgcacgcatcggattttttcggaacgtttccaaaacaaaaacgaatccgaatttacagcaaaacaaaactgtaaaaggaggctgcatctgcagcaaggtgaggaaccaatttggcagaccattcgacgcgtacgtcgtgcacacgcaccgcctgccaggcgaggcgagcgagcgcgcgcgtgttccccctcttctctccaccacacatgcttcaagtggctaggagggcatcctacctttcaaggaggtccccctctcctagaataagcaaggtggtactaaactccacatgcatgccatcccatgaggtggtcttttgtgattttccaaagaattaatcttcaagtgggctaaggcccattcattaattccaacaacagcaaccttcgagttcttgcaaatggtacctattcaattataaaaacgaaatcttggcaggagctctgcctattcaattagtagaagcaaagactactaagatcataatataatgtcagagtatcactcaactcttagtacaactcaagagtagctagacagcaccaggagcctcccaaatttaatttacacagcatcggttggtatttgtagtaaacacctttcagtaaactagtaaggtagcccgcgcagttgcgcgggcatcttatttaaatttgttattaggattttgaatattatgactgtctctcaatgaaagaatttgaatgttcctttataacacatgattgaaaaaaaaagtataaaggccggaaacatgttagaaatacatgtgtaaaacagcgaataaacaaatttcggacagtaaacgaattttgtacagaggacataaataacatgaattttaaaatttgttaacccacatagatgaaatcatcatctttcattgcataaataaactgcagttaaccaaataacctttccgttagcagcttgattttatcgatcccatgcgaacggaaaaaacatacgcatgcatcttattactattttattaattttattgctatagagatataccgtaaccttttggatatcagctaatcgttatgtgcaccgtgcatggatacctcgtaagcaatatgatttagggattagtagatagtggtagtgtggatatatctcgtaataattgatcaagtatattgtatactacatattaagcgttttagtagctttctaaagagcttatcggagtagctactcccttatcctatatatctataaagttcattctcaataagtgttctcagtaagtatagttaatgctaattctctcttctctcatgaagccataacacctcaattgtttttagcccttggatgattcatcaagggtgcaaattgcatctcttctccccaaaagccactccatacaaatcaaccatttataacttttgaataattgatgaaggtacaaaatattcaagcacatgaaagaaaatcatatagtaaataagatattttttctactactcatatctactattttatcacacaattctcctacagcaatgtgccggccatctagttcatagtgataacgtttcccggactgctaaacgtgttatattttatctttttctgataatttctattattttctctaatttattatagtactatgtacaattttaagagtgttcataagatgtttaatggactgaaacttttctatgtttatttttgcatggtatcagtaggatatgaattttttcatcagacttactataatgtattcgtgcaaattaaaggacggtatagtgatgcaatcaataggaatcccaatcgcacactttttttactataatccaaaggaggtttaaatttttaattttaaatcccaactatagttttgagctgagttcaaactttttaacaaagtattgctttttggatttcacagagaaaacaaaacgaaagagaggaacgtgggacctgcgtgggtacatgcttatttgcacctagaagtggggacttttagagataaattaaattggtagttttttaagatagattcaatgcatggataaaacaatggtctagcaaaataaatgaaaaccaacggttaaatgttgtttttcttagaatttatgtgatttattatagcgccacgtgatagcttagaagcgtttataggatgctatgtggcggcttagaaccatttatagagatgctatgtggtggcttagtagcatttagacgaagtttattggactttcaatatataattaatagatagatggtagattgtcagtaataaaacgaattaagctgagcataaaaccaacatatattttttataagttaatacatgcaaggatgcacgcatgcatgtaaccctccatgaagaggacatggacagatgtaaccatggtgcttttgctctcaacaacttatgaaaaaaaaaagaacagatgatgcatatacatgcttgagaggtgagcagattgccggattggacgttttatatgttagatgttaatttttcttttcaatctgtaattgttttttggttttttatcttttttttatttcggtattttttatcactttcggatgtattttctctcatatagaaacggtatattagaagtgagagattatattttaatggatctaataatctaatggtccaaaataacagctccacagtttaagtgttagatgtttcacttttttcttacaattctctaatttattatcgtgtcacatggcgatgtatgagcgttcgtaaaaagccacataacaacttgagagtgttcgtaggatgtttaatagacttttagtatataatagatatattgttatacacgatgtttaatttaatggatatttattatttgctagctagaaattaaggaggccaaagtgagcaaggagagatgacgtaaaattatttgtgaccacatgatagtatatgttattattttttgctatttgtaggagtatttgtcaaacgatgtatttcttatatatcaaaacacatggctaatatagataaatagaatatgttgtagaaaattataattatttagttatctaattattttttacataataaatttattatctaaaaattagaagatggatgggatgaagaaaagagaggttgtgagggagtaacgtacgtacacgtacatgtacgtgaggagtggaggcccatgaggggagcgggagtggatgggatcttggtttattttgtttaatatagatctaatggtgtaaaataatgggcccgctatattaagtgaaaatcaagggtgagatgttttgcttttttctagaatttcttggatttctctaatttattagagcgccaagtggcggtttaggagcgtttgtaggaagtttaatggacttttagtatataatagatagaagatagatagatagatagatatgatctaaacggtagttaaaattctttgaaaattttgaatgaatgtaagtcctctgggtagctggtgactggcagtggttcgagatcaagcagcttagctagctttcctatatctgtatataccaccccagtatgggagtagagtttgatcccttaagggatgtcccctcattatttgcatgtcactcaaatagttataaaaaaatttaaaacaattgagaatatatattaatatgtgatatattactccacaaacatgtaagttcaaattcaacttccacatcacgcaatgaaaaaacaaattaattagggggttaatttgaggatatctttaatttgtttgaaaaaacaaattaactaggggttaatttgaggatatctttaatttgtttttttcattgcatgatgtggaagttgaatttgaacttgcatgtttgtgaagtgatatatcacatgttaagacatcttttgaatttttttttcaaatttttttcatagttgtttgagtgacgtacaaacaacgaggggacatttcctcgagggatgaggggtaagatattttccctttgaactaccagttgagagcaattaattaaaaatcaaatgaagatatcgctcttttttaacacccttcaaagcgaaagaaactgcactatctcgtaggtatttgggaaaaaaattagtacatatacgattttttttaactgtgtgcagtacacactgtctgatacacacattcactaattaggatttaggaattaactacatgctttgaaagaatatgggacatctgcaggaacccgagcccactttcatcgtcgtgctccgcaagcttccactgaacttttgctgaagaatctcttattaataccgtatttagtctagtctggataaagaacaatgcgttgatcattgctctttccaacattaggtgaccatgcttcgtacggtgcatcgccgttttctgctaccttccaatcctaagctccaacatcgagcagaaaaaagtgaggtgattaattagcttcagtagagacaaagtttctacccatggctggccatcagtctcaactctcaccattagcaggggatgcataataatatcactaaagaactttctgatgatccgccactgtaaatttaaagtcttccatacaactcttaattacttacgagttgtgtgcgaatttagtttttttgaagcaagtcacccatgagagattgtaccgtggataaattcttcctatgtgtccacctatttattagggcatgctctgctctgaggagcctattgcgatgttgtgccagaaatgcataccattgaggccttgtccggtttggtggaaattaaaggggtttggagaaaattgagtgggaataattccataccacattatgtgtggaaataatcaccttcgatctttgccacttggggattaactgaatatgacctcactactacaacaaccatttttctatgcgggtgtttcgattattccgtgcgggggtttggcccgtctgcagctggtcgtctggaaaaatcaccattttcacgtgcggacggaccgaccacacgggataatcgattaacccgtgcggtcgtgttataccgaccgcacggaataataaaaaaggaaaaaaatcaaaatccacccacgaaccctaaccaaaatccacccacaaaccctaataaaaaatcaactttgtcggcatcggcgccgccatcaccatcgtcgtcgccgccttcccgaagcccaccgccatcgtcgccgccttcccgtcggaggcgggcgacagatgcggcctccccgtggcggtgggcgacggatccggcctccccgcggcggccggccacggatccggcctccccacgcacggatccggcctcctgccgatgccgccgccgtagccgattcaaccgccgccgccatagccatagctgtcgccgaggacgagggagagagagagggtgatgggaggagggggaggagccgtagccgatgatgtcgccgatgccgcggccgtagtgccgccactgatgctgctctatccgagggcgccgccatcgccgaggacgacagggagagggagaagtgtgggagggatttggataagtgtggggtgggaggagccgggtggaccactttatttttgggggcagctattttcgtgtgtaggtcacttaacagacccgcacgcattatttttgtatgcgagtctgttaagtggcccgcacatgaaaattgattttcctgtgcgggtgataaactggcaccggtccttttattttccgtgcggtttaacttacggaccgtctggaaacaaaaagaggaggcgtgcatgaaaatcaatcatgtagtagtgcctaagacagctctattagtattgatgcctagcccattggtatggtactcaatgcatctgtctgtccaaaatttgtacatatgcctgtttatgagctatgtactagtcattctactgagtttttgcaggttgtattttaattgagatagttacatgtttaaagtttatttcaaatacatacttttaaaatttaaagtttatcttccaaatcttgtgtggacctaagtcttgtccacttgtctaaacaagtagaaaacaccaaatttccaagggccgtcttttgagcaagcatttctattataacgagatttcgggagaaactactatagtacattgatatgcaactaataactaagcgcacgttaatatttctcctcaccgctatacaccgccatcctgatgagccattgagctactgttttgcggcaagttgaagtagagcgagcaccgaggcatatctgtctcccgatgcctcataagcccttacttagcccgtacggcagcaacatatatatcaaatttgtaatgaacaagatgatcaaatttcatagcttatacaactttgcttgtgctttttctagtttggtggttggtatatcttcgcttgtgctgtaactaaccagctagggtggacatatataccggtatgtcttctgcttttctttttcccctgaaaactgagggaaatttgatgcttcaattagacaccagtactcaagtacccattctgcttctgctggtaatatatatactgcatccgtcatgactccgtggtaggttattacagagagctaattaaacatgggcccagacactagctagctgccagcatgccacagctgttgagattataggcatataataatttaatctattccataaataaatcatgacattacagataaaaactagcatgaacgcatcattagatctacagatgtaaactacacagtataacatgaacagatcaaatatgcacaacatattgaacacataccgaggtggtggaaagaccggctgctcgatcgaaatttttcgcaggcgtctacgaaggcacgtagcacgcgagcgaagaggaagacgagccgtcgcggacgaacagggagcagtcgcgcaaagcgcttcccaaaaaccttattgccgccttctcccggtgcaggacgttgaaggcagaggttccggagacctgctctcccgatcgcaagtgcacgccggcgagcgggatggagtaatctacgagcgacggcgcagcacagagtaggaggtaaaccctagattgatttcgcgtgtgttgtatgaagacggcgggtcggtttatatagagaagggtcgcttgatcagggcgcccgcacgatctccactacgcgtaaccgacccgcataagtcgcgcgtaacttatccggactccacgccgtttgcacgcaccggattttttcggaacgtttccaaaacaaaaacgaatccgaatttgcagcaaaacaaaactgcaaaaggaggctacatctgcgcaaggtgaagaaccaattttggcggaccattcgacacgtacgtcgtgcacgcgcaccgcctgccctgccaggcgaggcgagcgagcgcgcgcgtgttccccctcttctctccaccacacatacttcaagtggctaggagggcatcctctcttttaaggagg

SEQ ID NO: 75545 - DNA, 10696 bp, Oryza sativa
gtatttgtcaaacgatgtatttcttatatatcaaaacacatggctaatatagataaatagaatatgttgtagaaaattataattatttagttatctaattattttttacataataaatttattatctaaaaattagaagatggatgggatgaagaaaagagaggttgtgagggagtaacgtacgtacacgtacatgtacgtgaggagtggaggcccatgaggggagcgggagtggatgggatcttggtttattttgtttaatatagatctaatggtgtaaaataatgggcccgctatattaagtgaaaatcaagggtgagatgttttgcttttttctagaatttcttggatttctctaatttattagagcgccaagtggcggtttaggagcgtttgtaggaagtttaatggacttttagtatataatagaagatagatagatagatagatagatagatagatagatgggttacgagtaaaatttaaagaggtgggctaaaggaatgagatatgcttttatgtcattagtgcatatctacatagcaatagtattcagatatctgtactatttttgtccgtcggaaaacatttgcgtttgtatcaaaaaaaaactagatgtaccttgtatctgtgtgcagattatctgatattattggctttgaattgtatctgtaatatttttcgtgtagctgatggaaacaatctgaaaaagtgatcaacaggaacaaaattcatggcggccttttttcatttagagaaaaagatgtttaatcaaaatgtttcacaaatatacaacattcatcaataacccactgcatgaaacgtcaagtctcaacgcgaaaaatactatacaataacaatagtgcaatagcatttactaccggttgaaataattcgcttctcgtacatgaaacactaaattttatggtagatcatgttgtaatgattcaattacaataaatataatggtggaattggatcataggtcggacaagtaatttaggaggaaaaaacattttaggtttactataataagccgtatctttattttaaatgcatgcatgaatgggaaagagatgtgctagaccctgatttctgcatataaaagtatcaatttcaagctagcaacatatttgaattttgtttggttgtgccattaagatctcaatccaatcctccaagaaatttgatcccctccaaattcaaaaaccatccaaattcaaatttgaatttgttaaatatgtgatccaaattttgggcccacaatatattcggattagtttgctagtaggagttcctattaggtgtctttctatttcccttatatgtagtattgtaagccgtacgggaaggggtgacgtttccattgttattcccctacgattataatcaactcctctatagtgatcattgccggtcggtgcccgtggtttttcccgcaagggttttccacgtaaaattcgtgtatccgttgtgcatataggattagagatcgatctacaccacgtcgccgccgtcgccggttttgctttcgtcgtcgctgaatcaatctgttcggtgcagtaccccgtcgagtccgagtcgctgccgtcctcacacacccgcgcgagaaaagcagaagctgcagcaaccgcacagccgtgaggaggaaaaagggccggcctactgcaactgtagggcacgcgacccgaggaagtcagggactacatcgttcctgttgagaaggaatttctcgatttttttctgctaagcgcaccaaagcttgtgtaccaggaaatctacatacttcgctttgtgcacacaggaagtgcacccaggtttcgtgtttttgctaggtttaccctaatttcttacaagcaaattcaggattaattctcatggcaagtttgaagtatgatctaccgctcctagaccgagacacaagattctcactttggcaagtgaagatgcgagccgttcttacacaacaagacctcgatgatgcgctttctggatttgataagaggacacaggattggtccaacgatgagaagaaaagggatcgtaaggctatgtcatatattcatcttcatctatctaacaatattttgcaggaggtgcttaaggaggagacagccactgggctgtggttgaactggaacaaatatgcatgactaaagatctgaccactaagatgcacctgaagcaaaagttatttttgcacaagttgaaagatgatgggtctgtaatggaccatctctccgctttcaaggaaattattgctgaccttaagtctatggaggtaaagtatgatgaagaagatttatgccttattctattgtgttcattgcctagctcatatgcaaacttcagggataatattctttatagtcgttgtggagattatggataccccatatctacacggcggttatatttaaactggatataggatgcccaatatagatagaatatctttatttgtatctcgggtttgtttcttaacttgtacgtcaaggaaataccctgaggtttagtcggttacgattgtattttatctgtattttcattttccgttagggatatgagctataccttgtaatacggactccttcccctatataaggaggggtccgagtccttcttgggacataacttcttatggagatcatacatccaataatacactcggcggattcatccccggacaagagtagggtattacttcttgaataagaaggcctgaacctgtataaatcctttgttgtcatgcccggaaattcactagtaatttccgaactaatttgtgcataaaatcctcgtccaggaatcagccgaggtacacaaactgacaatttaatatacaaatccatcttaataataacgttacatacttacaaagaaaagaaaacagcagcggaattaacggtctagcgatggcttcagctccactcccacaggcagctcaactggggtataaaccaaacgtcttctccttctggatcctttatcttcaactgaggtttgatgattattgcaagaatgagcatatgacatactcaacaagccacacagcaagtatgcaagtgcacaaggataccaaaggatggcataatatatgctaatttgcaaaagcagcattaagcaaaacatttaagagaagtaaaacagtagagtaattaatcagaaattttaatcaacactgaacagcacacccatgctgcacaggcccaaccatcctgaacaaccaaccccggtcgtacagatcaaacctccaaaccaggagctaagcaaattattaccagatataacatccataattattgtgagaggtgtgagactaatcacgaaaaacattgctcaacttgcccataaccgcgggcacggctattcgaatagttttactctggccagaggtgtaccactgtacccacaagacacgattccacacatgttgccatgccccgaaataccaccacggcattgcaaaggggaaatcgtgacaataccctttgcacaacacaactcaaaacagtgcaccgttcctggatcataatcacccccttataaaacaaggcatggactccccagcgacccccacggacttcttgccgcttctcagtctggcacactataatgaaccatgctatacaaaaggtaaagccgttgcccatgctggcttgtggttggcacgataaatgtctcacaacagtagctcgcgaaccggtccttaattgccatgagcacaaccatcaaaaccatatgctcacaacccaccttaaccagattttaattatcaattaattaacatcacacgattaatcatcgtgagctaccattaaatataaccataattaataagaataatataatataatttatatttaatcccctttaattagctaatgtttctaagcatggctaagcaaacatacatataacatttagctgaaccaaaccaatatataaggttcatgctaatcaaattataacccataggaaaataagatcatcttcggccattaattaacggggaaaggttcaccacccgatgacattcgaaaacaatgcatagttgaaataaaataatagctttaaatgggttcaacatgctcaaagggttgtttgggatctgtgtgacttgccttgggcttccgcaaacgcttccgaaccttgctcaacgaaaacgctctcctccggaacgtcggaaactaaagcgaaagaataaaaaatcaacaaaacagtacaaaaacaagcataaacagtacatgtgaatatttttaacatgtagatcttgattttagaaaaatttagcaacttgaaccacctgaaacggatctacggttatttagttatgattttccgaagatttcatctataagaaaaaggggaaaaaggaaaagacgatgatgccatgatgacatcatcaatggtggccggctcggatggcgacctcgccggagctagggtggtcggccgggattttggaggacatgtacacgtagaggacgacgaggcgaacccaacggtactcaccaacgagccaaacgacgaacgacgacggccagcgacgaagaggcgacggcggcggctcgggataaccggcgacggcgagctacggcggccggagacgaaggagaggtggcggccgagcttctccacctcttggcgaaaccaacggtggcgacggcaagcgacggcgacggcggaggcagcgtggcggcacaaccggagttcggccggcggcggcggcggatggtttcacgcggcgacggctctacgggtcacgggagaggacgggagagggggcaaacgaaagaggaggactaggggtcctatttatagccttggattgaagagatcggactcctcccgcaagaaatcgatccgggaaatcaaaaactcggttttggagataaactcaaaaacgagttcgattcggataaaatactcaacggtttgctccgattcttgggggtaaagatagaggaggataagaggaatatttcccctcaactaattttgcaaacggagctccggatgaggcggatttaacggaggaagcggcggctgcacagggcacagcacgggcggctcggctctgtccagagctggaagatgaacagtgccagggaggtaaattagacttttggttggctgagaacagaacagggcacttgacttgggctggcttgggctgcacagcacgcgcgcgagggagagagaagaggaaggaatgggccgaaaagggcccaagctgaggaggaggatttttattacttttccaattaaaataatcacttaaatgatctttcaattgttaaaaatacttccaatgctcaaataattccaagaaaaatcttgaacatacttggacactcaaagtatttaatataataatatccagatcatttaatgattaatttattatttaaataattgctaaactgttctttgtatgattaaaattaataattgagctccgaaaaatccgagaatattccagagagtataattaaccatggagaatttaataaaaattaaatccatccatgctttatatttagaaaattttatttcccacatttaacttcacttgtaaattaatgaacatttaatataaattttgataataatttattaaataattttataaatcctgaaacaaaaatcaggatgtgacatttgtcttcaaccccctttttagcttgatagccacccccttttagtattgccgaaatcttgtttcgatagttggcgcgccaggtaggggttgcgtcaagcttttcgccgatcagtgcaatgggttccgtctccggcatcgatgacctcgtcttccctcccgggcaggcatttcggttcggcagcctcgacttcatcaccaacgacttcggcaagatctctctcctcgactcggaatcagaccagtcgggagagagccgtatctcggccccgtttggagttctgaacgcggctaagatctactccaagtctatctcgatcgagtcggcttcaacatcaccagatcgagatgatagggcctacccaccgatcctaatgaagctccccgacgatttggcggccgtcttcaccaccacgacgtccccttcccgtaagcctaggcggaggtcggcttcaacaccgatctcgcctagctccaggaaagttggcgtcatcctccagccactcggcacagtttcgacggaccagttggagggctactggagctctctcggcgtcgactcgcgtccgactgagatcttggagtacgatgagttcggctttcgcagcaacgacccagatctcgacaactttgacgaaagcttagaagacaactacacccctctctatttcggcgtcttcatggccgataatgagacggaagagcaacgccaagcccgagaaaccgaagcacgacgcgaggccgaacgacgccgactggaggaggagcgtcaagcacaagaacaagaacggctgcggtgtgagcaacaggagcgtgagcgggccgcaaaggaggctgaagaccggcggctacgagctttggaggcagggcgccgagcgcgatatcttatcggccagcaagacgttgaggggacaccggttttccgcaccccacaacagaatgttgttgccgcgatcaccctcctcaaggagaacgagctcaatcagtctgatcatgttgtcaacatcttgaaccagaccaagaccatgattgcagcttcggtcccagttaactccggaagcgtccgcacgccgagtggcagccaagttccccatcttcgatctcatgaccaccatcagccaagcctcagcatcaccggtgcaggatctaatcgcaggagcaggggccacgacgagcgatctgttcacttgccccccgagcatcatagggagagccgagtggaacgacctcgctcgccgcctcgtcgtcgccccgtcgatcttcgtgacacgatcattcagcgccgagcggcccgaggccaccatcattcatcggatcgctacgacgatgacctagatggagttgccgctttcaccaacgacctgtgtcgagtggattggccagccggctttaagccgactggaatagagaagtacgacggtaccactaatccagaatcatggcttaccgtctacggtctcgcaatccgctcagcaggaggagacaacaaggccatggcaaactatttacctgtggctttagcggattccgcccgatcttggctccacggattgccctgtggtacgattggatcttgggccgaactacgcgaccactttattgcaaatttccaaggcactttcgagcgccccggcatacaatttgatctttacaatgttatccagaagttcggagaatctcttcgagattacatccggtgattttctgaataacgcaacaagatctccgacatcactgacgatgttatcatcgccgcattcaccaaaggaattcgccacgaagaattggtcggcaagttcgggcgtaagcctcccaaaacagtcaaactcatgtttgaaaaagccaacgagtacgccaaggctgaagacgccgtcatcgcatcaaagcagtcgggctccagttggaagccaaaaaaggatacgccggctacgggagggggtggaagtaacaaccataaggaccgcaagcataagcctgaggaacttattgcaaccactactcactcttctcgacagcgttcacgcatcaatacgttcgataagatcatgaactcccaatgcccgcatcatcttaactccaatcacgcggccaaagattgtttcgtctacaagcagttcgcagaacaatacaccaagactacatggaagaactccgacgaagaacaaagcacgtcgaagaagaaggaagatggcgaccccccggcaggttttcaagaccaccgcaaagagcttaaccatatctttggcggccccttggcttatgaatctaaaagaaagcaaaagttgactgagagggagattaacgctgttcagcccgacaagccccaatatcttcgatgtttagaaacagcaatcaagtttgaccgctcggatcatcccgaccgagtggtccacccggggcggtaccccctagaactagacccagtggtccgtaacgtcaagcttctcagaaccctcatcgacggcggcagcgcactaaatatcctcttcgccaaaaccctggatgatatgcagattcctcgctcagagttaaaaccaagcaatgcgccctttcacggagtcatctcggggctatctgcaactccactccgccagatcaccctcccagtaacctttggcactcgggaaaacttccgcacggagaatatgtgttttgaagtcgccgatttcgagacagcgtatcacgccatactcgaacgcccggcgttagccaagttcatggccgtcccgcactagacttacatgatgatgaagatgcccggtcctcgaggagtcctatccctacgaagtgacatcaagcaggccgtcacatgcgacaaagaaagttgcgagatggcccaaactcgcgagatggcgaccgcccgagaagacatccgactagctgcaaccatggcaagcgaaggagaggtgcccacgaccaaggtctcaaaaagcggagaaagcgaagccaagacaaaaaagattcccctagatccttctgatcctactaaaacagctgtaataggcaccgagttagattgtaaataggaaagcgcgctcatcacctttcttcaaaataataaagatatctttgtgtggaaaccatctgatatgcctggtattcctagagaagtgattgagcactctttacacgtcaaagaagacgctaagcctatcaaacaacgactccgccgctttgcacaagacaggaaggacgcgatcaaggaggaattaaccaagctgttagcagcaggcttcattaaagaagtccttcatcccgactggctggctaacccggtcctagttcggaagaaaactgggcaatgtcgtatgtgcgtcgattataccgacctcaacaaatcttgccctaaagatccttttgggttgcctcgcattgaccaggtagtcgattcgaccgccggctgcgagctactcagttttttggattgctactcggggtatcatcagatccgactgaaagaatccgactgcttgaagacatctttcatcacgcccttcggggcctactgctacatcaccatgccattcgggctgaaaaatgcaggagcaacttatcaacgcatgattcagagatgcttcttgactcaaattggccgcaatgttgaagcctacgtagatgatgtaatcgtcaagaccaagcagaaggacgatttaatttcggacctagaagaaaccttcgtgagcatccgtgctttcaggatgaaactaaaccctgaaaaatgcaccttcggagtactgtcagggaagttgcttggctttatggtgtctcatagaggcatacaagccaactcagagaaagtcaccgccatcctcaacatgaaaccgccgagctcccagaaggacgttcaaaagctgactgggtgcatggcggcgctcagccgattcgtttcacgacttggcgagcgggggatgcccttcttcaagctactaaagaaaacagataatttccagtggggacccgaagcacagaaggccttcgaagacttcaagaaactcctcaccaagccaccagtcttagcctcaccacactcacaggaaccgctgctattatatgtatcagccacctcccaggtcatgagcacagtcttggtcgtcgagcgtaaggaagaaggccacgtccagaaagtccagcgactgatctactttgtcagcgaggtcctagccgactccaaaacgagatatcctcaagttcagaagctgttatacggtattctgattactaccaggaaattatcccactatttccaaggtcactcagtcacagtggttacatcgttcccgctcggcgatatactgcataatcgtgaagcaaatggacggattgctaaatgggctttagaattgatgtctttggacatatccttcaagccccgaacctcaatcaagtcccaagcattagcagacttcgtcgccgagtggaccgagtgccaggaggatattcccggagaaaagatggagcactggaccatgcactttgacggatcaaaaaggctttcgggcactgtagcaggagtggttttaatttccccaactggagaaagattaagctatgtactttggatacatttttcggcatctcacaacgtcgcagaatatgaggcgctcctccatggactatggatagcgatttccctagggatcaagcgtctaatagttcgtggggattcacagctagtcgtaaatcaagttatgaaaaagtggtcttgccttgacgataacatgacagcatatcgacaagaggtacgcaaactggaaagcaagttcgatggactcgagcttagtcacgttctccgacacaacaatgaagccgccgacagactagccaactttggatccaagcgcgaggcggccccctccgatgtattcgtcgaacacctttatgagccgaccatacctcagaaagaaatcactcaagttgtggacactcaagacatagccatgattgaagccgactggagagagcccctcatacgatttttaacctcccaagagctccctcaagataaagatgaagccgagcggatttcaaggcgta

SEQ ID NO: 75546 - DNA, 6505 bp, Oryza sativa
gttaacaaaaaaaatggtggaattcaaataaattttataaagaaattgatttttagtttgaatatataaattggctgatttactaacatggtgtctgcaactgatgaaaatgagaactcattacacgtttaaacaaaaaatgctataagtgcatgattaattaagttttagttattataaacttaaaaatatatttattcaatatttcatagtagcgtttatatagaaaattttcgtacaaaacataccatttagctatctatttatctattatatactaaaagtatattaaacttcctacaaacactcttaaaccgtcttaaaccgccatgtggcactcctataaacgtttctaagccgtcatgtggtactatctaatctcaccattgatttttacttaaattggtggacccgttattctacaccattaggttagatctattattgcgaaatatagaaacgatactaccgttctcaggtctcgtacgtacgacgtacgagtagtaggtgcaatttaaatttcaactgttcacggaagggaaaaaaaccatactacttcacaaatataatataaatatatatagttaaactaagatatataagaaaaacatagaatacccaataaatgttctttaaacaatcttctaaattattttgaaattatatatccaatttgtgatcatgttgtatttctttaattaaattataaaagttatattatagtcctaaatacaccatggcacatgaggctgacatatgtatgataatttttcaaaaaaatacatcatattttagggagggaaatatcacttcacaaatatacaacattaatttaaatctgcatatgtaaaaaataaaaacaacacaatttagttgtgtttttcaagtaggtctgattaaattataatttatttgagattaagattctcaaagtagctttatacttttagaactatttgactatatatatttgtcaaaatataaataataacatgatgctctggttattatcgtggtgttatgtctcattagatataattttttaaaaataccatcgaacgattgacctcagtcatattcaaaagagagtattctatctatataataaaaaaaatgagttgtaatgatcaacaacataaacaaatcgtgtctacactgcaccacaaatctactcaaaacatttttaaaaactactttggtcacctccatcttctctttgttcttccctaaaggacaccaaacatggacaacaaagtttattatggtgtcgcaagtttagtatggaatatacggctaagttaagacagtcccagtggagaccaccattgctaatagtactcaactttctacttaccaatgcaaaactccatgagtcctatttcattctttggttttccaaaagtctaaatcctatttgtagtcactatgtgctatattaaattttttatcggaaccaaaaagtcattttaatacttattgcttgcatgttcattggttttgtcacatgatgaatgagttgactacaccttgatcttagtgaaaaagaaatataacttagacttttggaaggagggagagtacattaaaattatgctccaagctggtcttcaggagcatggctatatcgatgcgggacccatgtttcaaggcaatggagaaaggaagtcttggtggctatgatcgactttacccatgatgatgtgaccatcaagtatatgcatacatccaagcacgagaaatataaaacatggctaaagaatacatcgagtgaatggaggatctacaagatattaaaatccaacgagttttggaatctagttcggcctccagagatagcactgacttcaaacggacctagcgccttcatgccaactccgatttgggtaatcttggacttcatggaaagattatctctctacctttcaaacgcatctggtctcatgtccaaattcatctcgagtcaacgggaatcgccaaaacaagacagtgctgttgctgaaaccaaacttgagccttaggctttgtaatagactaggcccatctcggaagtgtctccctccacctccacgaattagcacttaaccctagctttgttttcctctataaatagctttgtacatcctaaaaaaacaattgggttttgtttagttgaattttgccaagtgccattcactttgtctctagtcctcgctcgattagtcggcgactattgattcagagcccccaatagttggtgtgttgatttgccgggtcaattagatctactacttcaatcgcaactattcctttgtgcttaatcacctattcgcaatatttagattgcatcttatcttgttcttgtagtgttctctcgtttgcattgcagggatcatcaaccgcgtatcacggttggtacgacatcgtttgtggtgtaacgattgcacggcgtcctggacttgttctggttggtagccacgtcgcaaacgtcgcactcgatcaaagcgagagttatcccctcaccagaagatcgggccacgagagagagcgtcatcacatgagagtagtattcatgtttaactttaatggtgatattccattaatggatagaagtggtcgtatttttacaatatttttaaatggatttagaaaaaaaaatgagacataaaacgtaagtagtggataatttagtgtattaataatgtattaggttttagggtttgttgtcgaaccgacaactgcatcacgtcgaaatgcgtggttctctcaatagtagttggaagtaaacacaattgtattacatagtgaaaattttttaatctccctattacgtggccttagggggctatttatagccctattacaggttcctcctttagggtttaggttttacaggggaatttacatggttacccttatgatagggacattattgggggcacacagtgtcctttacatgtatgggcccctattaggctaaatagctcggccaatttatttggcaaaatcccccgaaagcgcaatggcccactgggcctccttacggtggggttcggtacttggcgaagcctgtgccttcgtgccaaggctttcacctcaccgtcttcgcccatgcggccttctaacgaggtctttgcctggcgaagcccgcgtgttccgagccacggttttcgccatgtggctttcgcccatatggttccattctcgaccttcgctgcttgcctccggtttgagcctgtcgcctaagttcttggtttcggtagatctggccgaaggccctttgtggtgtacctccaacagggttaattggttttaaagcataatttagtggtgacaatatgagaatttatatgtcactcgatcaaagtgtatttttaatctgagatatattcttattattttataacatttaagtagaaatagtgagatgtaacttcttttatcattatttttataaaacattcaataagatgcctgcgcatctacgcgggctttctttctagttttagaaacatgttaattgaaattaaggtagaatttgttcttgaccagaagaacgggccctaaatttatcaatgcaaactgacttagcaaggctaataacgacaattatcacatcatgcgtttacatgtacggttggatccatgccataacaaatttaccatattagaaaaatgccacccctattcgtgatatcagttgagtgccactggaattttgtaaaattggatcaatgtcatcgccgtcacagtttccatttttcacatggaccaaaataaccctgaacgtgggacccacacatcagtttcatcttcttcctccatcctcctctcttccggagggcatgacgatcctcccgccgcctctctccaatgggaacgactgccctcagcggcggcgcgcggggagaaggctacaaccacagcggtctccccccattagatctagttgggaagcgaatcggtagcctcgtgggcatgaagtcatcggcaagcccaatctccccaagtacactctcccattccgccggcgagcctaagctgctcctcgttgatttcatgggcatcgctgatgagtaggaacgacatctagtggaagagctcattgatgacgagggaaggaaatgccatggccgcctcaccctgtcgccgcagcccacggatagccatggcccgtcatcgccggcatcgtcttgccctctcgctgcatgaggacatccatggctcgccgcccgccatcgctgtctttccctcttgccgccctcacacatccatgcccgcctgctaccatcggagtcaccttgcccacgcgctgctgcggacggctgtggcttgccacccgttgttgctgcctttccctctcaccgcccccacacatccatgcctggagaggagaagagcgcctggccgacgaggaagaaggagaggagaataaaagaagagagaataaggagagcatgacggaaaatatgacgacgatggtatggatccaattttgtaaaattttagtgacacccagctgatatcgtgatttgcaaatagtaatagtatttttctaaatagcaaatttgcaatgataggatccaattaaccctaatactagtagtagtaaaatagtactaataattaaatgttcatcacttcagtcttcagtggtaataaatagtcgagcccagcacaggcctcaggggaagcgaaactatggcgaacgcggggctgcgcgcgtaccgggaggtgctgcggctggtgcggcggctgccggcggacgcgcggccgtactacgccaagtacgcccgcgagaacttcgtcaactaccgcgacctctccgctgacgacgacctcgccgccctcctccgccgcgcctacgcccactcctcctgggtcctctccaaggtgggtggtagtacggtacctaacctacaaacacgcccgccgcttgagcggagcgcgcgcgctcgctcgccttccaccgcatcggcgtgctggttcaccgctctttgctgccttgcagtactcgatcgacgcggatgctgcggcggggcggctcaaggaggtgtgcggcgccgagggcggagcgtgagcacgcgtgcgcgcgaggtgttcgacgaaatgcttcgccgcgtcatgccagcgtcagttagctctaccccgttgtttttacttgccttgctagcggttggcgggcatttggacttcttgttttttgcaacagtttagttgatagttgataaaaatgtgtggggaataagttgaatactctgcttctgcacaccgtattttagtttgatccctgctgccgcctgcctgtttcagttggtgttgaactcaatttgccgggattagcaaattgcgtgtttaactgtgggataaccaagcaaacacactttgcaaattttgttggtcaaatctagatgttaaattgcctaagagctccaaatgattttgagatagaattacttttgtgaagagtgtgctgtgtgaatacaaaacaaaacaaaacgaactaaaactactggcaaaccatatttcttgtgactagtgagtgtgcacgtgcaaggcacgttgaaatgtaggcgtataggcaattgtcaaagtttctgttgtagaatgtgcacaaaggtcgacttataggcatataggttagttaaagtttctgttgtagatcatgcacaaaggctatgtgaagcattaggaggagcgccaattggtgctgcaagtcccttttgtatctacctcataatcatttgcctcttcaatggcatttttaatgtcatcgaaagtccattgcaatgatcattattagcagtttatctttttttttagcaaagggactgagccctccatttccattaaagaaatgatgtagctaatacaaaggagtcatcccatttaagggttcatgtcttcagaagtgaaaaaaacagaaacacaggtgccagagctctttgctcactacaatcattttgacctgacaaaacaaaagatcttctacttgcaataactcccagaactgaaccagactttagctgaggattccggtccacaaaaaaaactctatcttctgctcttttttgtccatccagcttcatgtgttgtccagcctgcacacgctcgatctccatccatatcttgatttaaagacttcacttgttacctgctttaggagcttggctccccaaagcaactttctttgcctttcctccgaaatctgtaaaataccccaatcggagatccaattacaagcagcaaacaaaatttcagaaggatcagatggcagtttgttattctatcaactccaatcagcagtagctgtgatgtcattctatcacagttttttgttcaattctccaaggtttgatgtaaatttctgattggtttaagatcaaaagcacaacaaaccatattccaggtaaatctagccatagggcaatcaaaaatacaaattctgcaaagtctctttttttctcacagaattgacatgtttctgttccttttttccatcctctctttctcaagttatctttggtta

SEQ ID NO: 75547 - DNA, 2904 bp, Oryza sativa
tatgcatctcgcctaaagagaaaaaaggacatcttgtatgcatcatgtcacacgttttcatgccccataacttcgatttcatgataggaggatggaccagcgccatcttcatcaccataggctcctctagcatgagaagtcgatgcaccaggagcttgctctttgccataggagtctccagcatgtttagtggatgaattacctgagcgtgctccgtttgggagctctgctctcgccagcttctctgccaaggtctccattcccatgtaatgcagaaggagccagacatagcttaggaactccccgcctgtgccgagactcttagcgtgcaggtagcccctgcatctggctgcagagaagcagagcatctctacccacactccttcaatcaccctccacatcttctcctcatcttctaaattcaggagctcttctgcaatggaccaagcatcatcgatgagctctccttcattctcctcgtgtggctgctgaaccttgacgataattctctgggcaagttctctttcattcagtgacaggttcttctccttgacgatacccttcaattgtttgtaggcatcagtgaacaagtttcgcctgctgcccgccaatagcatcccaggattcacaaatagctggtacatcatgtagttggacatttcttggcactaaactgcacctttatggtgaatagatttttggcaccaagtagggcatccttcgttgagaccagaggaaccttgtatacacaagtcgtgagatccatgttggaattaatagatgggctaaggcccattcgaagattaattctttggaaaatcgcaaaaacccacctcatgggatggcatgcatgtggagtttagtaccaccttgcttattctagaagagggggacctccttaaaagggaggatgccctcctagtcacttgaagcatgtgtggtggagagaagagggggaaacacacgcgcgcgctcgctcgcctggccgggccggcggcgcgcgcacgacgtacgtgtcgaatgctcggcaaaattggctcctcacccttgcgcagatgcagcctccttttgcagttttgttttgctgcgggattcggatttgttttgttttggaaacattccgaaaaatccggtgtgtgaaaacggcatggagtccggataggttacgcgcgacttatccggttcggtttacgcgggcaccctgatcaggcgatctatctctatataaaccaagccgccgccttcacgcaacacacgcgaaatcaatctagggtttgccttctactctgtactgcgtcgtcactcgtagactactccatcccgctcgccggcgtgcactggcgatcgggagagcaggtctccggaacctctgcctttgacgtcctgcatcgggagaaggtggcaataaggtttttgggaagcgcttcgcgcgactgctccctgttcgtctgcgacggctcgccttcctctccgctcgcgtgcttcgcgacttcgtcgacgctcgcaaccgccagtagttcctgccgagcaaccggtctttccgccacctcggtacgtgttcgatatgttgcgcatatttgatctgttcatgttttactgcttagtttacatgtgtagatctaatgatgtgttcaatctagtttacatctgcaatgtcatggtttatttatggaataaattaaatcattatgtgcttataattataacaatccaaaaaccttattataggctctgtgattttactatgattggttttgccgatgcaatgaggccggataaattcacaggtgtgcactctaagagatggcagatcagggtcactatgtggctgacggctatgaaatgcttttgggtgagtactggcaaacctgaaggaattcttactgctgatcagcagaagcaattcgaggaagccactactctctttgtgggatgcattcttagcgttcttggcgatcgtctggtcgaggtgtatatgcatatgaccgacgctaaggagttgtaggatgcactgaatactaaattcggtgctactgatgctagcaatgatctgtatatcatggagcagtttcatgactacaagatggctgacaaccgttttgtagtcgaacaggctcatgagatacaaaccatggctaaggaactcgaactccttaagtgtgtcttacccgacaaatttgtggccgggtgcattattgcgaaactacctccatcatggagaagtttcggtattgcactcaaacacaagagacaggaatactccgttgaggggttgatagcgtctcttgatgttgaggagaaagctcgggaaaaagatgccgcgtctaaggacgatactgggcagtccagtgccaatgttgtgcacaaggcccagaacaagagcaaggggaaatgtaaagctcaacagaccaccaacttcaggaggtagaagaccggataaattcacaggtgtgcattttaagagatggcaaatgtcgcgtcccaaatcgactctaaaatacatcctcgaaattgtgccgagaataattaaaattcatgtgaaagcctccaacaattaaaatgtgcaaagataaaagtcaaataaggcttggaggatttttgtatatttcctaaaagcctaaaatgcgtaaataaattttagtggaattttcagagcacaaataataattgagaagaaataaacaaagttgaaaaggtttataaaaagaaaaaccctaaaagaagtcctctttcccccccttcctttctggggccggctcggcccacttctcttccctccctctctctcctctcctccggcccatcggctcctcccccgcgcgcgcgccgctgacaggcgggcccgcccgccaccctcgctgacgggtggggcccacctgtcatcgccttcctcgcgccgcgcgc

SEQ ID NO: 75548 - DNA, 827 bp, Oryza sativa
  unsure (1)..(827): unsure at all n locations
tttgaaattagatcatttttttaaatttgtgtttttacaaagtacgcgaaggtccaccctcatggacaggaacaacgcttttttgcaacatatattttatacgaaatctatgctttctgtaaagttaaagcacactaaatctaaagcttaatatacaaccatgccacatcatcacccactagcaataattatatatttaatctcatacaagcatacaaatgatctacaatttatttaattatacaaatcaaaatacaagcatccaaccatcatccgtctccgtcatacatttgcacaatatttcaacaaatctatctattacttttacaatatttaacatatacttatcaatatgtttcacactaaagcacgagtattatttgactgataaaccctaatgttttgttttttttcttcgtaatcctagtttgattgtaaaaaaaacatattgagaatttcttagtaaattttacaacaaagcacgggaaagcgtgaggaatcacctagttatactatagttatactagtttcattgtttgtcgaaccacagtgaagaagaatctattgattaatagcaccgggcttgaaatcggtgcatttatacgcactcatgtgactgctgcaagcctgcaacggacaataattaaaatgaatgaaaaaaacgaacggtacggagtttacttactgttactggattataacaagctggtctgacattgcgcttattcttctccgtatcgncattgaccttgtctacaactaggtattgtacttgcatcctataaccacttactccggagcaagattattgcaacaagtacttgtca

SEQ ID NO: 75549 - DNA, 616 bp, Oryza sativa
attttattttaaacacaccgacaccacatgtcgggttttgaaggcttcacaaacccatttcccaagttttcgacaaacaacggtgtatgtgggttatttggtatacgcgctcagagagcacgaataccgaggtaccacaagggtggagagacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaagggtgacttgccttgctcaaggtcttcacaaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaattttatgtgaatactggaagttgaacggagtcaatcggaccagcggttggggagatatggatttcctaagattatttggattttctgtctaaaggaaaaggatttatcaaatcctttggaaaagaaaa

SEQ ID NO: 75550 - DNA, 13472 bp, Oryza sativa
attggctttgagcaactaaatgtctttagatgctgtttactgcaaccctatcccctttatattataattcccttgtactcccttgcatttattctgcatttatgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgatttgtatcaacttttggtgtaccttgcctcctgggacaaggattaatgcacgcacgtaaggaatgcccgttgggttatttccggtcgtgacaagttggtatcagagcctcccttgaccctaggacgagccgtagatcccaagccttagcagtattttcaaaaataaaaatcctttgttatttgtgaaaactgtctagtctctctctgtcttgctgcttcatttatcgtcaaaatctgatctttaaaatgttgtttctctttttgtttttgtttgtagatggccggcagcgtcacccgtcgtggtttggacatgactggcttcgtcttggagctgcggggcatgtgcgtggtcctggggtatccacatggagtggactaccaggccaggccgcttccggatcaggagggtgacgacgcggagccccacgctggttgggaggtcaccgcagtgatcctctctggctctcccgagcggacttcgctggcagtcaccgcgggtggagactccttccccgccgcttgccagaacgccgctctcctcgccatcggcacccttcaccagcgctacccggacgagttgcagcactcgccctaccgctaccaccctcgtcgcggaggagcctgcgactacgccaccttccgggatgctagctcggaggatgacgctaccatcgtgcacctggcgcgcatggtggaggcgtacgacgcggctcgtatcgacttccatcagatggtgcgtcgcgggatggtcaagagcaatctgatgatcctggagctgcgtcaggagaacctgcagctcaagaagaacctcgacgcagtggaggcgcagctgcatcagctcaagatcacccagggagagatctgccgccccaagcgtcgccgtgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagccttcggcgttggtagcacggagggtgcgctgttgctcaccttccgtcctggcccgtcgcagcagtagacgagcagttagtaggcttgcgcgtgtgtttttctcgtttgtcttcttgttgagtcgtgtggggcatggttatgccggtgtgtggcataactatgtcggagcctgtcttattttatttgcctaaacaacttgaaccttaatgaaccaatttaatagcagtaataaatgtaagaataatggttgtcgtgggtggttagttttaattgttagctccttctctgtttgctggttctgtgtggggttttcagatggtgacgaccaggagaaacgctgctaccggtgatggcaatcaacctgaaggcagcaccacaaccaccaaggcaacccacctccacctcctcctcatcagccaccaccaccaccagacaccaacgccattctcacccaaatcctcgcccagcaagccaacatgatgaatgctttcctccaccacctccaaaatccgccacaacagaatgctccaccaccacctccccaacactctaaactcgccgagttcctccgcatccgcccacctaccttctctagctccaacaaccccgtggatgcgttggattggttgcatgccgtggggaagaagttagacacggtgcagtgcagcgatgaggagaaagtcgtcttcgccgcccaccagctgcagggacccgcatctctatggtgggaccatttccaggctacgcagccagaggggcaacctattacttgggctcgcttcaccgccgctttccgaaggacccatgtgcccgctggagtcgtggcacttaagaaaagagaattccgagagttgaagcaaggcaaccgctccgtgatggagtatttgcacgagttcaacaacttggcccgttacgccccagaggatgtgcgggaagatgaggagaagcaagagaagttcttggcaggaatggaccctgagctgtccgtccgtctagtctctggggattatccggattttcaacgactggtggacaagagcatccgcttggaagccaagcacaaggaactggagtcgcacaagcgccgcttggcaaatttccgcaatcagcagggtgctaaccagagggtccgctacaccaatccctatccagggggatcctcctcgcagcagcaacaacagcagcagcaacctcgctccgcgcctcgacctcaattcgtggtgcgcgtcccacagccgcagcagtagcagaatcagcaagggactcgtgcgccccgtcctcctacgccaactgtgcagtctggtcaaggccgcagggacgcttcaggtccgcagcgtctgtgcttcaactgcttcgagcccgggcactttgcggataaatgcccaaagccaaggcgtcagcaaggccaagcgcctccccgctccaacaacggcgggaaggatgtcattcggggtcgtgtgaatcacgtgacggccgaggacgtgctgacaactccggacgtcatcgttggtacgttcctcgtgcattccatccctgctaccattttgttcgactctggagcttcccactcgtttatatctgtgccgttcgtggggagaaatcagttgggggtagaaaggcttagaaaccctctgctcatcaccacccctggaggggttatgacagcaaagtattatagccctgccgtccctatagaaattcaggggattccttttccctcggatctgattctgctagacaccaagaatttggatgtgattcttgggatgaattggttggctcaattccaaggagtagtggattgcgcgagacgcactgttactctgtaccgagggccggaacaaccagttgttttctttgcacccccaaccaaggtagctcgatttattcctgtgaagaccacctatggagggaacaaactagcggagctctacttcgctaggatcgtgagtctccatggcgttcccaagaaaatcgtatctgataggggaagccaattcacctctcacttttggaagaagctccaagaagagctgggtactcgattaaatttcagcaccgcctatcacccgcagacagatgggcagaccgagcgtctaaatcagatcctagaagacatgcttcgtgcatgtgtactagatttcgggaagacctgggataagagtctcccctatgccgagttctcctacaataacagctatcaagccagcatacaaatggcaccttatgaagcgttgtacgggcgcaaatggcggacaccgctattgtgggaccaagttggagaaagccaagtgttcgggactgatatcctgagagaagctgaagctaaagtcagaatcattcgggataatctaaaggtggcacagtcccggcagaaaagttatgcagataaccgtcgccgtgacttggaattcgcagtggatgactttgtgtaccttcgggtcacgccattgcgaggtgtacacaggtttcagacgaaagggaagctcgcacctcggtatgtgggtcctttccgtatcgttgctcgacgcggagaagtcgcttaccagttggagctgcccgcctccttgggcaacgtgcatgatgtgttccatgtgtcgcaactcaagaaatgccttcgagtgccatccgagcaggccgactcagagcaaattgaagttcgtgaagatttgacctacgtggagaggccagtgaaaatcctggacaccatggagcgcaggaccaggaaccgggtaatccgtttttgcaaggtccagtggagcaatcacgccgaagaagaagctacttgggagcgtgaagacgagctgaaggcagcccatcccggtctcttcgccagttcttccgaatctcggggtcgagattccgtttaaggggggtaggtttgtcgcgtcccaaatcgactctaaaatacatcctcgaaattgtgccgagaataattaaaattcatgtgaaagcctccaacaattaaaatgtgcaaacataaaagtcaaataaggcttggaggatttttgtatatttcctaaaagcctaaaatgcgtaaataaattttagtggaattttcagagcacaaataataattgagaagaaataaacaaagttgaaaaggtttataaaaagaaaaaccctaaaagaagtcctctttccccccctccttcctttctggggccggctcggcccacttctcttccctccctctctctcctctcctccggcccatcggctcctcccccgcgcgcgcgccgctgacaggcgggccgccaccctcgctgacgggtggggcccacctgtcatcgccttcctcgcgccgcgcccgccgcccgcccgtgccctagcgccgccgccgccgccgaatccgccgcatcccgccgtccccgcgcgcattaaagtggggggaattactccccgcgattccctctcccgattcccccactttcccctctctctctccctcggattcgtccgattttgtgcccgcaaagttcgccggcgcaatcaatggcggccgagatctccgcgccggtttccatctcctccggccgctttccctctctcccgacgctatttaattgttccccgtgcctctctcctccgtttccgccgttcgccgctcgccctcaccgtcggaatcgcgctcgcgccgctttcctctctctccgccgtcgccgacgagttccggttcgccgccgccgtcgctccggacttcctcccctctcggcgtcgcctccttcggcttcgccgcgtcgtcgtcgaccccgtccgctcctccgtttcgctcgccgaccgtcggagcgccgtcgtcctcgtcgtcccgaaccgcgccgccgccttcctccgcttcggccgccgttcccgtcgtcgccgtcgaccggggtgagccgaagaccgctccattcgcttcccccttccctcctctctctcgggtgccgctccgccgcgccggtggtcgccggcggtgaccatcggggcgcgggcgcgtccccctcccgtcggccgtgccggcgaggccgccttcgggcgcgccctcgcggctgccaagtgggcccggccgtcagccgcccgcgcccgcgggtgcggctgacgcgtgggacccacggcgccggccgccgtcagccgcgtgcgcccggtccaccgtggaccgagaggctgacgcgtgggccccactcccgtggacccggtccgcgcgccctctccctcggctgacgcaataaacccggtttttaattaaaatttaaatgaagaaattcgtaaatatccatttaaagagcatataaacttcaaatggccatatcttggccaattgaactcggaattggaccgttcaagtctctaatttttccttaagaagtcaagaacccatttttgtgctttgtttctgctgttatgtggagtttattagagtaaaagcctttttcttttccgttggttgtgtagacgctgcagcttcggaagatccgctcttcgtggaagtcgaagccgtcggttgggaaagcgagcaaggcaagtcacatcatctttgagcatattgaatcccagtttataaaattatgttgatttaaattattgcattatcgctttatttaaattcccgcgttaccactgttttatttagccatgcctatttacctttgttatgaccatattattattgttattgttaatattattaccttgttcaccctagatcaaacaaaacctcaactagtggacactctactcatggcaccactagtttaattttaggtagatgcttcgcaatttaattaggtaacattaggtggttttacaactctagactttgggatattctcatcacctggacacactggaattgttggatcattgtggaattggcttcacaccgccccctctattcaaaatcccctaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctagtcataaacaaaagtacacggattggagatggatgaagtcgggggtcgatagacattctccagggcaaatgaaggttacacgagctgcggcccggtagtcgagatgtcattggcagagggttggtgccctgctgctaggggctcagtcttgcctgcctgtcccgggggtttcggccgtaggcaggattgggtcggtactcttgtctatggctaggatgggttggaaactatgtcacgtcttccgtctgtataccatggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacctgcttaacaactaaaatgtggaatggttggcctaggttggcttaggacgagctgggacccagggtcgggttgccagttcggtctgaatcatcataggccttgggttaaggcaggttcgtgtgggttcacggccttgattaataatattgtatagttctaggatcgggtttacaaattggctttgagcaactaaatgtctttaaatgctgtttactgcaaccctaacccctttatattataattcccttgtactcccttgcatttattctgcatttatgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgatttgtatcaacttttggtgtaccttgcctcctgggacaaggattaatgcacgcacgtaaggaatgcccgttgggttatttccagtcgtgacagcaaatcagggtcactctgtggctgacgactatgaaatgcttctgggtgagtactggcaaacctgaaggaattcttattgctgatcagcagaagcaattcgaggaagccactactctctttgtgggatgcattcttagcattcttggcaatcgtctggtcgaggtgtatattgtcacaccctaaaaattcaaaatctataaattgttgtttaattggaatttttagaaatgattttaaaagccttgaagagaagatctaattttaattaataaattccaatataaaatggggccagataaaatttcattaaatactttgcttaattttataattcctagatttttctgggatttatttgagctaagtaagtatttttaataaatgcaattgcatttaaggaataatttaaattgaaaaaggttttaaaaagtctcttttggctttgggccgaaagtcggcccaaaacccttctctctctcctcggcccaagtcggcccagtccgcagccgcgcgcgcgcgccctcgctcgctgtcaggtggggtccgcctgtcaggtcgtcgtcttcctcgcgtcggccgctgcccgaaaccctagcgccgcgccgccgccgtttccttccaaatccggccgctcctttccttttccggtgaaatcaatagaggggaaatgatcttcgagatctcctctaccttttcccctttggaaacatcggctaaatcggtttggaaatcgatggattcgagtttgcttcggattcgtttttcccgaagtttccttcgtcgtcgctggtcgccgtgggccttcgccgtcgcccttgaacccctttaaaaggatccccgagctctcctctacccgtcgccaccctcgccttcgcctctcgtcgtcggaagcgccctagcgccgtgagacctcgagccgcagtcgccgccgtcgctccagccgtgcgccgccgccgttccggtcgtcgtcatcgctcgggaaggccaccgttgggatcgccaagtcgtcgccgtccttgtccacccctccgccgtcgctgttgaccgccggagcatcgccgtcaccgtcgacccgaagaccgccgccgcttcaacctcgtcgccagtgctgtccgttcctcttccgccgtcgctttggtcgccggtgagttcgccgtgccgtccgctacccgttggtgccctccgatcgtgccgaagcgccgccgttcgccggcgagcttgcgccgtccgagctgtcgagccgccgagccgccgccgccggtggtgacgtcatcgctgacgtcatcgtccccgtctcccgtgagccggtcgtggaccgatcgatctcggccgtccgttttggatggattgatctcggccgtccgttcgcgtgaaccgccgccgtgcacccggtccaccgtaaccctagccgctgacgcaataaatcccctttttcttttcaaaaataattcattattgcgtcataattcaattaaaatacatataagtgttttaatccgattaaatcttcaaaaattcataactaattcatcttagctcggatttagttggttcaagtctctaaatttttctaaaattgagatctacatgttaaaaatatccacatgtacagttcatgcttgtttatgtattgttttggtgtttttgcttctttctgtttagattccgacgtttccggagagtccgttttcgcaggagaagagtttgaagagttccaaggccagcaaggcaagtcacacagatcccgaacaaccctttgagcatgttgatcctatttaaagctgttgtttctattcaactattgcatctatttacgaatgtcattgggtggaattaacctattgtttgttatagccctttttgttcttgattactttactccttgatacctcgggttattaaaatttgactagttgggctatatatattggttcagctagatattagatatgattgcttagccctgcttagaaacattagcacactattgggataacttatgattcacttttatttaatgatggcttaatgatagttcacgatggtcaatcgtgattggttaattaattaacgtgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggagcaccagactgagaagtggcggagataagcccacgggggtcgctggggagtccatgccttgtttataagggggtgattatgatccaggaaggtgcgctgcagtggattgtgttgtataaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgatttgtctcacacctctcatcataatgcaagatactataactggtaataatttgtttagctcctggtttggaatggtatattcctggtttggagatagatctgtacagccgggtatgttgtatagtgttggattaatattgtttaattattacttaactgttttattaaattctcaaatgtttgctaaatgctgcttttgcaaatgaaaccctattatgcgatcctttgttatcctgtgcacttgcatatttgctgcgtggcttgctgagtatgtcatatactcaccttgcgatcattcatcagaggaagagttctacaatgatgctgatggtgtggaggattaggtgtagccctggtcaagttgcctgtggagtggagccgtctgcgccgtttattttattttccgctgcttagatgtcgcgtcccgaaacgactctaaaatacatcctcaaaattatgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaagggttttataaaaagaaaaaccctaaaaagtctttttccccccccccttcccctcttgggccggctcggcccacttccctccctttctctctcctgtcccccgcggcccaatcggccccctccccgcgcgcgccgctgacgggcgggcccgcccgccaccctcgctgacgggtggggcccacccgtcatcccctacctcgcgccgctcccgccgccttgcccgtgccctagcgccgccgccgccgcgaatcccgccgcctcccgccgtccccgcgcgcaataaagagggggaaatcactccccatgattccctctccctttccccccatttttccctctctctctcgcgttcaaacgggcggatttgcccccgcaaacctcgccggcgccattgatggagcccgagattgccgcgccggtttccttcccctccggccgccatctctcactcccaacactatataaacgatcctcgtgcctccctccaccgtttccgccactcgccgctctctctctccgccggaaccgagctcgcgccgtcgccctctctctccgccgtcgccaccgagctccggtccgccgccgtcgtcgccccggacctcctcccgcttcggcgtcgcctccttcggcttcgccgcgtcctcgccgacctcgtccactcctccgtttcgcccgccgaccgccggaacgccgccgtcctcgtcgacccgagccgcgccgccacctttctccgctccggtcgccgttcccgtcgccgccgtcgacccggggtgagccgtggaccgcccatttcgtttcccccttccctcccctctctcggccgccgctccgccgtgcctatggccgccgccggcgaccataggggcgcgggcgcgccgcctcccgtcggccgtgccggcgaggccgccttcgggcgcgccccgcggctgccatgtggggcccggccgtccgccgcccgcgtcgtcgggtgcggctgacgcgtgggacccacggcgccggccggcgcaagccgcgtgcacccggtccaccgtggaccgtgaggctgccgcgtggtccccactcccgtggacccggtccgcacgcccctcccctcggctgacgcaataaatccgattttttaattaaaatttaaatgaagaaattcacaaatatccatttaaagagcatataaacttcaaatggccataacttggccatttgaactcggaattggaccgttcaagtctctaatttttccttaagaagtcaagaacccatttgtgtgctttgtttctgcttgttatatggagtttattagagtaaaagccttttcttttccgttggtcgtgtagacgctgcagcttcggaagatccgctcttcgtggaggttgaagccgacgtttgggaaagcgagcaaggcaagtcacatcatctttgaacatattgaatcccagtttacaaaattatgttgatttaaattattgcattatcgctttatttaaattcccgcgttatcactgttttatttagccatgcctatttacctttgttatgaccttattattattgttattgttattattaccttgttcaccctagattaaacaaaaccccaactagtggacactctactcatggtaccactagtataattttatgtagatgcttcgcaatttaattaggtaacattaggcggttttacaactctagactttgggaatattcatatcacctggacactttggaatggtttggttattgtggaaatggcttcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggacgaagtcgggggtcgatggacatctctaggacaaatgaaggctacacgagctgcggcccggtagtcgagatgtcatggcacagggccggtgtcctgctgtgtcacgcccggaatttctatccaaaattccaaacgcttacatgtgtgttaaaccctcgtccaggaatcaaccgagacacacaatgacaatattgataatagagtacaattaaataactatttaatattcgcaaataataaaatattacagaggtagataattcctcccaaaaatataaaacattctacgcagcggaaaaataaaactataacaaactacagaacagctatgacgactccactccacaggcatcttaaccgagaacaagcctaatcctccagatcatcaccttcactgagatactcctcttctgatgaatgaatattgcaagaatgagcatatgacatactcaacaagccacacagcaaatatgcaagtgcacaggataacaaaggatggcataatatagctcatttgcagaaaatagcatttaataaacatttaagagaatagtaaaacagttgaataattaatcaatattaaataaacaccatacaacacacccatgttgcataggcccaaccacatttgaacaacccaaccccagttgaacaaattgaacctccaaaccaggaattgtccattccaaaccaggaattaaattaattaccacattattaccattaatgagtagtgtgagactaatcacgaaaaacattgctcaactcacccataaccatgggtacggctattcgaatagtttaaactctgatcagaggtgtaccactgtacccacaagacacaaccccacatcatgtcaccatgtgcctcaataccaccacggtacctcggaaaggagtcgtgacaataccccttgcacaacataacccatacagtgcaccttttctgatcat

SEQ ID NO: 75551 - DNA, 3940 bp, Oryza sativa
ggaaaaacaagggaaaaataattaattaattttgcatgtctgatggttcacaagttcgatcatattgtccatatggaatatatgccttgtagtgatacgatatttcttcagatgtaacactgcacttgttctgaaactatattatttgagggggtgttatgtgggtgattgcttaccttaatggacacatcatgcccaactaaaatccgtctctgaactttcaatttcttgttgaggacacagtacgtacttgcattgcttgcttcaaagacaactcttgtctgagagagagaggagatccagcagcagtgttctgcaattctatgcgtatggtagaagggaaaagatcaacacacttcctagtctgttcttctggatgggcatattgcaggaattgtgtggatttcatcagaaacaataggtgaaaaatgttgttttttttctggtaaaaagggtcgctttggtaattaacttggtcggctgagtcttgatcgggtttggtctcctgttattagtgcaaccgggcaaagcacggcaggttagagtcgagactgaccgattcttcagtggacacgagtgggttgacggtcacgcgtgctcgttgggtttgggtttgtactgctccgtattcactatctattgacattttaggaagacttgcaaaaagtgatagtatactactacctccatcccaaaatatttgacgccgttgacttttttaaaaatatttgaccgttcgtcttattcaaaaaatttaagtaattgttaattcttttcctatcatttgatttattgttaaatatatttttatgtatacatatagttttacacattttacaaaagtttttgaataagacgaacggtcaaacatatttaaaaaagtcaacggcgtcaaacatttagggaaggagggagtagttgctgagttgagttaggaactccacctccacatacggaaaacaaatattattattaacacatgattaattaaatgttagtctaataaatttaaaaaaatggattaatatgatttttaaaacaactttcttataaaaaaacttgtgaaaaaaaaacatatcatttagcaggttgaataaacgtgtgggcggaaaaaaaagtgtgttgggaaagaaggacgaccatagccttaaaggagattttcttccttctttctcaacttatctccctcgttttctatgcgcgtgcttttcaaactgctaagcagtgtaatttttttttaaaaaaagttatatacggaagttgctttagaaaatcatattaatctatttttaatgtaagccagctctcttgcacactgctatttctaaaagtctggtctcattctaaatgttaggatttgagtttaagattaatttttagtggattttttcggcgctcttaaaaaaattctacctaaacttattctcaacaatcacatttaaaaatgttagcatttgagaaaaagcattgtcaagcgacgccaatgttctaggtatgattccttataatgatcgaatggtagatttttagatatttttttaagaatggttctaacttcgaaatttaattttaggtctagaatgaaattttgaagttacctaaacgcagctatgcctatctaatttattttgtgagagctcttcagccaactccattctatttttgagtgaagtttggttaagcttatgatctaagagtgatggagctgaagataaagccgtgcaaaacgggcctaaatatgtcttaaaaaatactacaatgaaacgtcttattaaaaaataaaataaaattttgtaatatatttttccaatttttgcaatgaaacgtggagggcaatatccacacgagccacgcatcatccagcaaccaaccaaccactactaccactggctacactatgccgttatcctctctctccctcctccccctccaccgcgctccgctcccgccaacttcaaattacccgccaccgccgcctccctctcgcgccctcctcctccccctcctccgccactcgccgctcgcgcgccgctcgcccgtctcccgggcgcgtgccgtagcagccgacggcatggccgcggcgaccgcggcggcggagacgccgcccacgctgctcgagtacatgggccaggctggcgcggccgacgacctcgtcgtcctcgtggcgcacgtccagagcgcgtgcaagcgcatcgccgcgctcgtggcgtcgcccgggaacgccgagctgtcgcgggggaaggcggggggtggtgtggcggtggcggccgggcgggacgcgcccaagccgctcgacgaattgtcggtgcgtgcagtgtcagggttgcgtgggttattattgtctgcattctggttctcgcatctatctacatgcatttcatccttcttcttttttttaaaaaaaaaagaataggtccattttttgtgagattgttatcacatctcagtcatacgcttagcagctggagtagcactcatttggagtgtaaaatgttcatttactaattaagtttacttgaggtaagttgtgcaaagtgcacacaagagactttccccacattttcattcttgcattctcaacaaaatactacttgcatttgtggtgaaccatcaacagaagcacttcctatttgcaaaaaaaaacagttattgtttgtctgatgctactaacttgcattatagcttccaacaacatcaagactaacatatttttcaatttagaatgagatcatcttgtcatcactccgaagatctggaaaggttgcagtgatggcttctgaagaaaatcatctccccatttgggtttccaacgacagcccgtatgttgttgttacggatccgcttgatggttctcgcaacattgaggtatccattcccaccggaacaatatttgggatatacaataggctggcagagcttgaccatctacctgaagaggagagagctcagctcaattcactgcaaagcggcactcaccttgtcgcttcggggtatgtgctgtattcatctgccaccatattctgtatcagcttcggtgcaggtacccatggcttcaccttggatcacttgactggagaatttgttctaacacatccttccatccaaatacccccaagaggtaactaataagctgtaattcaataatttgctaattcccttagtcttcattaaatgttaaccagatgtcacctaaattcacttacactagtagcgcaagttttctcaatttatggattggtggatgaacagtttatcaatgtcagtaatttgaggagatgttttagttgaacagcggcaagagtgcttgcattgtgtttgagaacatgacgtagagaaatttcttataactgaacgactgaaatattaactgtgttgaacttagaaatgcatgctttcatctttgctgaaaagctgtaatcctgagctatgccaggacagatatattcggtgaatgatgcgcggtatttcgactggcctgagggcctaaggaagtacattgacacgatcagacaaggcaagggacagcatccgaagaagtactcggcacggtacgtgtgctcgctggttgctgatttccaccggacgctgatatacggtggagttgccatgaaccccagggatcaccttcggttggtctatgaagcaaatcctctgagtttccttgctgagcaggcagggggcaggggttcagatggcaagagcagaatcctctcgattcagcctgtgaagctgcaccagaggctgccattgttcctgggaggcatggaggacatgcttgagttggaaagctatggagatgtgcaacagaaggttaatcctggatatgaggtgtgaagatatataaccttagataatgaggtctgaagataatgtagcatgcgaaaagagaacagggggacctactggagaactctgtatttgcaaaaccgatgtttttacc

SEQ ID NO: 75552 - DNA, 2473 bp, Oryza sativa
ccccccctaagctagccagattaccaccacctttgcggggtgaaattgcgaaaagaacccagctactaactactacatggacttcgctctcagcaacagctctgctcatcgcatcctgatcttgcactaaggctagacgagacaagaagcaagcaaagaagagcaaagagagagagagatctcgcgcgctcacacttgggcatcttggtgttcctcctggccgcgccgccaccgccgccgccatccccgtcgaccccggatccgccgttgctcgtgctcccgcccgccgcgtggttgttcatcgcgccaagccgcagccaccaccacccaccacctcctcgaccccacgaccaagaaacctcaagaaccgggcccccggagcccgaggcccgggcaggcgggcctccctcgaggctagcttgccgcgatcttggagcttgctaggattgcaagcaaggaaggggaggatttgacctgtggagagaggggagggaggaggaagacgaagagaggaaaggaagggaggctttgctgtggtggttggcttgggaattgggagttgggattaatttttttttcatatggtcaaaacaggttttattttcactgtctttgttctagaatatttttttcttttcttttttaaggacttttcttataaaggtttaggccctgtttgcaactgataaatatgaggattaagaaagtatacgcaaaaacgaaaaaaaataataacatatgattattgagttttgattattataaatttagaagatgagttgatttgatattgtagagcaacttaatcagaaaataaaaggcctaatactaatatatagtttgtttttcttttttttagagattttttcacagctatcagttagatctattttgttccttttcaagcacttttcttcccatgtttagtactaatgggttttttttaaaaaaaatctttgagatttttcgtagctactatactcatatttacgtagttgctaaaaagttttatgataatatgttaatacctcctcttagaataaaagaggttttagagtttgacacgattgttaagaaattaggtagaattaaatagagagatattgtgattgattaagaagttaagttaggtgaaaaaagtgaatggtggaagagttgttattggttgagaagagaatgttggtggagaagttattgtattttaaaacaaattttaagtgctagaaatagttatattttggaacagactatacctaccataatagcacatatagtccctgtattatggagaaaacgagatagaaggacagtctgtactctgacaaagcaagattatgtgttacaaactatggcagaaatagtgatacggaagtatcatttcaaacaaatctgcacatgtgattttagtcagcacaacaaaaatatgaaaggtactcaaagttcaccttagactaatctggcccttatgacgaactcaatatacggaacatttttggtcatgcatgtgacacctggcaataagatattggtgcttttgtgctgcgcctctaccctctagcctttctagaagatgaacaccgttagtcgttaattaattaatcttctacagttgtagtttgacttgttcatcactctcttgctgataatttatcattatatatggaatcaatgttggtcactcattttcgtacttacggtagaaaaatcaacgaccataaatgatgtatcgtatacgttatctcacatgaccatgacctatagaacattgacacttaatttcaagttaacagtcatcgttatcatcgccgtttaggtttgggtctcgttgaaatttgaaaattcaaatgtcaaggtcaaacaatgtcatcttggaagacaaaataaaatgcgattaattagttgccctcttgtgcatcctgtccgtccaatgccattttccggccatccatcaggtaggagaatattgcgttgacgttgggaagtctttggtgggccccggctgcaggccgcgctgtattgggctgatagtgggctctagtatgggccctgatgggctggatacgtcgtttcagcctgattcgtattatagctaatttttatatattttttacgagggattgcagtttataaaggatgagtttcaccaccatctcgaataaatattgatattataagttgataatggcacaatgcctattggagactctaggatgaaaaataaaaataaaacagagaaagaaaaacaaaagaaactccggttgcgcctaatttttagcaaaatcgtttggttataggttattacatttttggactctgggagcagttagcaggtgctgagtcatatgcctctacaaataaattcggatatcatattattaattatgccattttggaacaccatcaaacaagacagtgtacatatacacacacacatatgcttattgagtgatcatgcaagaggtttattacacct

SEQ ID NO: 75553 - DNA, 2388 bp, Oryza sativa
aaaaagtttagaactaacaaaggccttagggtgtgtttagttcacgccaaaattagaagtttggttgaaattggaacgatgtgacggaaaagttggaagtttgtgtgtgtaaaaaagttttgatgtgatgaaaaagttagaagtttgaagaaaaagtttggaactaaactcggccttattatctctacttccatcctcacattcaacattagcagaatgacaacgcaaaagaatcgattgtgatgttttctgctatatattcacacttattgcaagtaattaaattgagggatagccatttatttatctacgcgcatggcatgccagaaatcatctgcacatctagcacgaatagttgcaaccggttgggaccctgtgtcatgtgtccatgtagcgtcaaccagctagttgattgatggcttaacagctcgcagcgataggttcagtagctttcctcagccattccttctcctgctcattcaggtaaggttgcaaaatttttctgcaatccgagtgatacgcatttacccattcaatctcagcaggggtaagtaaggtggtgtctatcagttttgtctggtacggagtctgcatagcacaagaaattcatcaatacatgaacatgagcaaaacaaatgacgcagatacatggtgagcagcattttgtatttagagatcatgaaatgccagtcgaactggcaacaaaggctgactttaaaatggtcatacaggtataaacagagcaacaaaacaagaatacaatgtattatcaaccgggatatcttgtgaaattgatacggagacttggagattaccaaagagaaagttaataatttaataaaatggagattgaagaaacttacccatgttatatgttcaaaagccaaataacccttatctccaaaattaaatttagtattggcttctttaactatcagaacattctccaaccttataccaaagcttccgtcttcatagtaaccaggttctgcaagaaaagattgtgcaagttgaactttacatcgatcattgcagcaagagggactatcatcgaagtaagaattacaaagtagtttcacattaaactgttgatagtcctattaaaataaatagtggttaatttaggatatttactgaccatctgttacagtcatcgatgcttgtagtggtacatttctagcagaaggtctgaagctaattagatgaggacctgggttgtaagcacaaacagaatggattaaacatttcaaggtagcactacaatcagataatttactgtcatagaagaggatgaaccagcaattgagtatctgaccttcatgaacattcaaataagatccaataccatggcctgtaccgtgccggtaatcaagaccacttctccaaagtggtgttcgtgcgagaatatcaatagcatgccctgttaaggtttaagtaacgcacaaatatcatggattttgttgaaatataacttgaaaaagtaagtataacacaatgaacataaattggtgtcaaaacatggtagtataaatcattttcttcatcacttgctagtttctgtcatctttttttttttcaaatttagtgagatagtctatcactaaataacattagtgattactggaatcttcttacagtttccaaatgttaaagaaacaatggagtctatcactaaataacatttgtgattagtggaatcttcttacagtttctaaatgttaaagaaacgatggacatgatctctgaggcaacgaggctttgagaaaacatgatgtcgcatgtttataagtaaatgcactcataaagaacaataatgttatcacatactacactattaggtgatgttaaaactccatggtacatctggcagctattttatcattgggacacatgatcaatgttaaatctcctgagttcatatagatggaagtataaaagctcaaaacactcactcacctgtggttccattgggaaatacagcagtgtccagtgcaatgtggcctttcaaaacctatttccaatgttcgatatcacttgcattagaaatagattaaatagtagcaaagaaaattaaaacctcacagacaatatcttgtaaactattagattcaagcatttaatatgatgtttatttctacaagagaaataaagtaacaagtgtgtaaagaaaacttgaccagccactgttgacataatattcaacaatggaattttcagctccattaagtaggggcaagtaatgcaatacaggaaatgaggaaaccaataacattgcaacgtgtcagaaaacaaactttcaacatgttgcatgtcagccactaagctcttaaattcatggaaaataatactacagttgtcaaataaataaagatagctagcagttatgca

SEQ ID NO: 75554 - DNA, 2924 bp, Oryza sativa
ttgattgctgccacgttttagagcaaacatgatccataaactttgccgactttctacaataaaatagtccactgcattttcattgttcctttcaatacacatgcttgagtataattttgaaatttgatttttttaaaaataatttcaggtataatttttactcgtcttcatcgcaattatgaaaagagagttgggtaacaaaaaacaagcgaataaacttataaatttggttctaaaattgaaaatctgaagaggtggaattgtgagaaaaaccagatcatcacaaaatcttccaaggcctcacctaaaatagagccatagcaaaattagcaaaggacaataaatactccactggaagagaggctctctaatttgagagatatttatcctccacacctaccaaccctactgtcactaataaatcattgtttattacttaatcacacgacatcaacctcattgtcccctaacagcaacatccaatcccatgcaccacgacgattaattactgaacaggaggaggagtagtagagtacagagataacacacacagacaaagacacatccaaatccattctttctccaccaccaaccagatgatctcctcttctcttctccaagagaaaccattccattattacaaagctcatttttctaattacaaagtccatttctttttatgttttctgaataatttttcttcttctccctttggcatgttgctgtaggtcccctacaaaggtctagaggtcactagtagtacacactcctacaaaaggttgtaccaccacaccaccagcctcattgctctcattgcattgtctcctcttcctactgctgctgctgctttctctctctaggctgcttgctttgcttgcccctctctctctctctatctacaaatgttctcttcttttgagagaagagaggaatagctgcaacacaaaggaaggcactgcttgcactgtgcagtgtgcaggcacagccaagttttcaaaagaacccgccatcttctttctctctctactgtcctagcaattctctctctagctccagtattaatttctttccatcctccattttcttgggcaccgtgcgagcttagctctgcactgtttgcctcagttgggttggtttggtttggttgcttcttctctgcttcaacggttggtcgacttcaatgcaagaaagcatcggcagcaattgctcctcccgttgagtttttcgtcgtcgtttgaaagcgaaggagacggcgacggcgacgaggaggaggaggagggattaatgtcgtccatggcctccaacgaaggtattcttctcttctctctcaaatattctgtttctcgcatacaagtttgctcctcttttttctttcttcttctgctctcttctctcttcttcttctgtccgtcttggggaagagagagagagagagagagagagagagagaaattcagaagaagaaattgttggtgatgacgaaactgaaggagtatttggtgattgaatctgcagaggtcggtaatgaagatgggaggcaggaggatctgcttgttaaggaaggttagctgtggtgattttgattattttttttactgcttaatttcctcatctctttgctgcatgtgtggcacaattagtgcttgtctgtatcttctctttctttcttgctttagtctaagtgctccattagtcctggaaaaatcatggcttttttttccaggcatgctcacagctttgaagctctaacatgtcattttctaagagggcaacaagagattaaaaaaaagagagatgtcagctgctggattctggtcttctttgtaacttttaaatatgctattatgctgggcaggcttgcattccctatcatcatatagaagatgggtagattgtcaagtccttccaattcttctcaccaaacccaaatcctttgacatcgacatttatgttgatttaagcaccctcttgatgatctttcgcaaattgcaagcaaatcacagagatgcacgggttattttcagacttagttgtgtgtctgtctgtgtgtgatagatagaaagaaagcatcaattttggaagggtgcagagggtggtgcgcatgtcaattcttggtgcaaatctctgaattatagaaatgcctcagatactgtcgactggcagcatgtggttttcatgggaaacgagacaaacacaagcctctccccccttatcatccactgtcaagggatctgagagcctgtgtttgtgtgtgtgatgatgatgtgtttcttgccttgacttgctttgcactttgtttgtcttgatgtttgtagtagtaggtagttaatttgtcttcttgataaaattcagttttgtagcataacaaacctatgataatagcccatgctatgtctacatctcctttgctgtgttcagggccaggggagcaccaagaaaacaccatcagagattccgacgaagcgaaaaatgaggattgcagcaatagcgggtcagtaaccgaagccgtcgtatcaagcgaagaacccagtgacaggagcagcactgaagaacccagtgacaggagcagtactgaagaacccagtgacagtagtagtggtggtgacagtagcagccaatctgctgattctgatggaggtagcaaagaggcgcctaagatggattcgaaggccggtaacgatgacagcagcgagtgcaccgatcagagctctcctcgcgcggtgctagacatctcggtatccggtagtgtcgactccgatgagagctcctccgttgagcagccagcggagtcgaatcacaatacgcagtggaggaacctgatcagtggattgatactcaggaggaggaagtcgatggcgagagcggggacattccctcagagaaccaagaccacagggcttaagaggtacctggaaggatgcgga

SEQ ID NO: 75555 - DNA, 905 bp, Oryza sativa
tgaaagatattctaatctatacagaattaccaatgcaaatggagtgagcttaacttctgttaaaaacaaagggtgggagtctattactttcagaagaaattagacaggagatagacttgcagactggatcaatataaaaaacttatgtgagacggtaatattaccaggagggagagacaccttaaaatggattttgacaaaaaaatggagagtttagtgttaaatctttttataaagctctgaaaacacatgacacaatccccaggccaatagggatacacaaaaaaatctggaaaatcaaaattccttttaagataaggatttttatgtggctgatgatgcaaaataggattttaaccaaagataacttgagaaagagaggatggaaaaaaggaacagaaacatgtcaattctgtgagaaaaaaagagactttgcagaatttgtatttttgattgccctatggctagatttacctggaatatggtttgttgtgcttttgatcttaaaccaatcagaaatttacatcaaaccttggagaattgaacaaaaaactgtgatagaatgacatcacagctactgctgattggagttgatagaataacaaactgccatctgatccttctgaaattttgtttgctgcttgtaattggatctccgattggggtattttacagatttcggaggaaaggcaaagaaagttgctttggggagccaagctcctaaagcaggtctcaagagaagtctttacatcaagatatggatggatatcgagcgtgtgcaggctggacaacacatgaagctggatggacaaaaaagagcagaagatagagttttttttgtggaccggaatcctcaactaaagtctggttcagttctgggagttattgcccgtatgaagatcttt

SEQ ID NO: 75556 - DNA, 959 bp, Oryza sativa
atctgtacagccgggtatggttgttcaggatggtcgggcctgtccagcatgggtctcctgttcagtgttgattaaaatttctgattaactactctactgttttatttctcttaaatattttgctaaacgctgcttttgcaaatgagcctatattatgccatcctttggtatccttgtgcacttgcatatttgctgtgtggcttgttgagtatgtcatatgctcattcttgcaataatcaatcaacctcagttgaagaaaaagaatccagaaggagaagacgtttggcttataccccagttgagctgcctgtgggagtggagccggagcttcgctagattttattttccgctgcagttttcttcatggtgaggactaagtgcctcttaagtaagtatttatcgttgtaattaatttgatgaatctgtatattaaattgtcagtttgtgtacctcggctgattcctggacgaggattttatgcacaaataagttcggaaattactagtgaatttccgggcgtgacagtagcgcccgttccgtcgtggcgcctagcggaaaaactatctcttaaaaaccctagttgcgaaatctgtttctttgcttgttgtctagtgtccgtgccatctcagatctcaaatccccaatctatcgtcgagttcaatcccgaatccaaatccttcccaaatcaaatcgctccgcaaaagtctatttagcctccctcgggttcgatgggccgaatccctctcggcccatctccccctccctcccggctctctctctctctctctccccgctctaccgtgagccgcgccgagccctccctcccgctctcgctgccattcccgccgatgccgcccaaatagtcacgccagccgcgcgcgcgcgcaccgtggtggccgaccggccagtcaccgccgccgtcagcgcctgccgcgcttgccccgcgtctgccgcccatg

SEQ ID NO: 75557 - DNA, 5184 bp, Oryza sativa
atcgccgaccgacgccatcacgtgtgccgaaggggagtcggtgcgcgtttagacgcggaacgggactccggacgcaccctctccttcctcttccccggcccgaggccggagagatcgctcccgtgccgtcggcccatcgtcactgcgccccgtccgcacggtagtgcatctccccgttctccttcctcaatccatctcttccccttagttctcggtagtagcatgtgtagcctccccgtagctagccggcgccgccccgactgctaccgtctctcgccgtgtgctcgccgccgtcgccgcccgagctcggcaacgcctctcgtcgccggcctccctcgatgcgattcctcctaatccggcgcaaggggtgggttcccgtagccgcgtagatgctctcgccgccgggaatcggcccctcgtgacctcatcgccgtttcccccttctcccgccgtcggttgccgccaccgcaatccgccaccgtcaagcatcccccgtcgaatccgagccattggctcgtctcccctcgtcctgtgcaacatcccggtgtgctcgccttcgcctgaattgccatggttcgctccggccctcgccgccgtcgtccgccgtccgttccgaccggcgtcgtcgtctacctcccaccggcccgcgtggcagccacataggcgccacgtcggcgccacctcgggcgtgaccgggtcaagcagaccccggtccggcggtttcctcccggcccctcgcgcgcgcggtccaccgcgagccgtgaggctgcgagtgggccccccgcaccgcgtcctccgcgaaccgcacgcatgcgccgcgcctccctccccaaaccctagcacgccccgcgtgcacctcgctcacggtgagccgagtcgacgacaagcgggtcccacccgggaccacgcgggatggacccggcccaccggctctctctctcccctccccgcccgcgcgcgcgccttgggccgccttcttgggccggccggcccattaagctcggccgagccgcccctttctctcgggccgcgccctagccgcccgagggaagtgtaatttccctccctccttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatctaatggcacgcttagaggtcaataatagggctttattttcgccgtttgctgagtcgtcccgtttcgcgtgtagtttcggagcccgaagacccgcagtgcgaggattttgaggatcaagctcaagatctcgagcgaggcaagccacctttgaacatcttgagcctatatttgaacttaattatgttgcttgaaaaatattatgcattgataggatcgcacttaatctgcttgtcccgtctgcaaggcagattagcggacctacctaatttgttgcatttgacccttccattgtaattgttataccatgttcccttgtacccacctagttgcgcctcggtaatcgtgcactctgcacgggtatcgacggtcgccttcaaacttaaaatctgagaaacatcttgggtaaaacttggattttacaaaagacttggaaaacccgacacctgggtcggtgcttgcgaactaaatgaatttccaaaatcgcggaccggggaacgtaccgggtgtacggtttcccgttcttgcacttaaggaccatttccttggaatttcatccgaacacatgacaagtacgaccacatgggtggaatgggacacccctggctgagtaactagcttatcgggggagccatgatgctaagagacatgtggattcgccggggtggtgtcggagaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtggccgttctgcacgggctcgatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttgtgaaatttgctgttgtggaatgggtttgatgtttggaaaatttgcggctgatgggatcagccaggcccgggtggccgtttgaaagctgttggccgggtgccaatcttggtcaattcaaaagactaatacattgcacatactccgaccggacgagacgcactgtctcatccgtgtcgtttgagaagcactcacttagttgtttcagaaaagagttcaaataaaatcaattgcaaaaacaacagcctttctctgaagcctgcattaaacacttatttcccatggctggctgagtactcccgtactcacccttgctctatataaataatcccccccagttgctgaagaagatgaagcggatcctgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagttgcgctcgggactagttcggggcgtgacaccatatatgagagacaccattcacctatacttcaaatacaattttctaaactactcatctaatctacgatccgattacaccgttgtgttcataacaattaaatctttacaacaagatctcacattattatattttgatgaaaaatcacaaattacttttatgatatgtctaaattacttttagatttcactaagttacttcttagacatacaaaagtaaattcagaaagctttaaagtaatttacatatattatagaagtaacttataaaaaaaagtaactttaattaatacactttttcattgaacaaattatcatatatttaattatcatatatataagttactttttgatttgattaaaatacttcctataaattcataatgctctgaggtgattacttttattattgtttttagttaatttcataatttgtgctgattaatttaatttctagatagagtcatgtttttatctctacaacggatttacttcaaataacatgccaaagttacattcgttttgttctaagttatttctataatatatgtaaattacttctaggctttactgaatttacttttgtatgtctaagaagtaacttagtgaaatctaaaagtaatttagacatatcataaaagtaatttgtgatttttcatcaaaatataatcatgtgagatcttgttgtaaagattaattgttacgaacacaacggtgtaatcggatcgtgtaatcggattatagatcggataagtaatttaagagaaaatttcataagaagaaaaaaatatgcacaacctaatagcaaaaactacttgcatgcatgtctgtaatgctactagtacttttctcacgtaactgtccgcgtcgctcgttaagtctaaatcgaaatgcctcttgaaatagtttttgcgattgctctatgttcattttttcttatgtgaattattagagctatttcttctacttcaagtgccaagttttatgtttccatattataaggttcataacttggtgattctacggaaatttagttcatccagattggagctaaaatgaattttatatgcaatttacaagttaacctatttttctgttgattagatattcactaaggcattttccttatattttccagattttaaaaacatagggcccactggtcagtgagagatcttttgcagaaaggtccctagagtgtgggggaatcaaccctcactccaaaaacgtgtctatgacatagtttataaagactcccccattttcttttatatttacgtttcagttcttgaccctcctgtcagtgatttagatgtttacatactgagacctacagttgttcgaattctcaaaacaaagtccctgcttttctctacctcgttcattcgatacagaggctgagcagagccatggctgagctcgatctcgagctcaccggcggcaataggtggctcctttggggttgaggtcaaaagatgaaatgaagagcacgctctcgggattccattcctctacttttctcggattgcggtcatcggagtaacgccggcggcgagtccgagcggcggctgtgcacgggctgctactgcatgtgcgcctatagccatgtagtgatcaaatggatgcatgaatgtggcattaggaagtgctatgacgctcaccgaagcttgaccgcggcttgaaaaggtctggacagcggtgacagtggaggagatggctcggcggcgatggatagcgtcggcttcacggcgacggtttgttccggtcttcgggctgccaaggagaggaggggaatggatcaaagatcatctaaggatgcttcatatgcgaggaattgcgccgaagctcacccgagagcgaggaacggacgacgttggccggcggccggacttgaggaagaaagagagaatctccttgtcggcggctcttcagcgcgattaccttggtaggccttctcctggaaccttggcgacgatcatggcgcagcggctcagtcggagatgcactggatcatcgggaacggctaagcgaccgatggcggcgctctggacaccgaggacgccgacgagctcgacgcaatgtgttcgatccatggaaagggaaaataaagaagaggactgagttaattatgatccgtagatacggttgttaggattataatatggcgaagctcactagagaagatttgtaacgaatcaaacacctttggttgagagaaaggattggatgtttttggagatttcgagggagttcttcatggcttttcttagaggaacacgatgagggatagatggagattagaatagcgagttggtttggtaaatgg

SEQ ID NO: 75558 - DNA, 2706 bp, Oryza sativa
cagtggcaaagccgctaacggtttggcgggacttctagaaagtaaaaaatgaacccaaacaataattatgttcgattttaaaaatcccaataacaataaagaaaggaggcaacggatggacattagaggagtcgagtggcagtgtttgatgggatttctaaaaattataaaaacgaaacccactaagacaataaactctaaaaattataacatcaaaattttaaagtttccaaggagaatgaataggaaaagtgatagatcgagcaagcaaataaagaatagggtaacttttaaagactataatattaaacacgaggatgatatggtttgatttttaaaagttttaaaataatgagataactattcaataaaatttaagtaaaatcatattaaaaatagataatttcatatggatgctagccgcgcaattgcgcgggccacccagctagttaaaactaaaaacatctcgaaacaaagaccacagcttctcccctgcatcccaaactgtgtttttctccataggtacaagaccctttcaagatttcgtgccgcaagcgccgtgtcgtccatcccatgccgcaagcgcaggcctccacggcgtagcggccaacgcaccggctctatccccggtctctcctgatctcctcgcctttcctcgtcccacttggagaagctcacgtcagccgtcctcaccgcacagggagccaccgcagagcaacagcactcggacccagccgcccggtcaattggtacaccaccatccatccccgtgagcgagcccatcccatcatcccacctcgccaaggcgccacgtgtgtttccatttccatattttttgccatttctatttttgtttcggtcgattaccaatttcacatggctcggccggtagaaagtcgaaaacaaacaccggtcggctcacccctgactaggcttccttatttctcgatcctatcttatctctttcccatgtatttctatattattcaacatcatatcagagcggatcatttagtcaactctctcacgcttccgccgccattgtccccgagtgggttctaatctcctggggacagccatccccactcgtttttttcttcatcgatgtcgttctcgtcctagagagatcaatctcctggtgctgtgcgtcgtcgtcttcgtgtcgttgaatcagcagcaacagcaccagcgacctccacacgtgcccggccagtcccttcatagacactgttccgttatcaaggacatgtcgacgctggtgccgagtcgctgctgccctggaacccctcgaccccgacctcatgccgtcacgggcggatcttgtcagccctcgccaaccatcgatcccgccgcccgatctggaggacgagcgcgccacctccggctcgtgcagcccaggttgtcgccaacacgctgccatcgactcctctgcagtcatcaccgccactcttaattaccaccactagccctcacctggattccaccggtcgagcacgcctgccgggccgcctcctttatcgacttcagccgtgatctgctctgcttggcgccctccaccagcccccacaactctgggatcctctactccatggccactgacttctcgctcgcaactatcaaacctagcaaacttatatcaaggtgggctatatatggctttcattttggcataaaagcaagttttagttcacaatcttttgcaaagggattttataaagcaattcaaaccatgaatatgaatatatcacaatatttataattgtaataacataacacttgttgtcctccatggcaacaagtctcatgatcatcgtcatagtcaccaaaactcaacacaaatcatcattccaatgccccattttcataaacacatttataaatcaagtactcatgacactccaccaagtcgctcatgactctgcctatttggtacaactttaccaacatgatgtgtatcactctagtctgtccggtacctgttggtaccaccgcacaatacacgttgaatgtggtctagaggtcacaacacaacctttatattatctaatgcctagccttgcaccagcacgatgcatgttactccacattacacctagaatgtagtgtcgctaggtggtgggtccatgccttgaacctaacaacgtaggcacaaccaacgtggtcccctacgaagcacaacaccattgtattcgataaacttagacgcccatgccgtgaggcggaatagttagtcgtcccctcccccgaacacacacacgaatgaatcatccgcacatcaaacacacatacacacatggatagctcctctagacaggtcattaaataacttaattggctaaggccaccccataaatagaacttgtggatgcacgatatactttaattggtgacacgaagtttagtccttaacagaggaacttgccttattctttggataaatcggacaactcctaaatctctccttcaccactaacgcaattaatctatacaaaatgacatgatatgcaaataccgagagatgcaaaaaaaatccaaaatgctctaaaatgcatgatttgtgcgcagtgggttggtactgacctatgatgaatttaagtgagagaatttctattttatcacttttcttttgggagttatgaattttataattatgctctattaaattttttatgcagtttagaatcaagtttttttaagtttcgggtc

SEQ ID NO: 75559 - DNA, 14027 bp, Oryza sativa
  unsure (1)..(14027): unsure at all n locations
gtagatgttacctaaatgaaagatggggtatggggaaaaatgtgagtgaatctctcttgctctttcttcttttgataaataccaagtggattcaatggtgtgtctaacccaggtggtttgctaaagattggatggcatatgggtccaagttgatgtatcctaggtgtacgtgagaggtagagtagtagctagtttaggtatgaaatgatttttattcctctctctcacctttagaaaaatgaaatataaattaaatgagaggtgtgtagatgatgtgttggctgtgagtgtatgacacatgggtcccacaagagcatagtcccacatgtaagagagagatgtgtagaaggagaaacctagaagctctaaattttgagtgttaaaactataccaacatgtagtttatttcctactcctctcttccatttaatttagaattttggggagacaaggttgctacaaggtagacaagaatttgatggttcaatgtgccaagttccaagatttaattactttttgagttaccatggtaatttagtaaataggcctaagatactatgttgactgcagtctaaatactgtttaagcaaattatggctctcatctcatgtggttacattttgaatttaattcagccattgaaccaggtggtagagcacactatgattagcattctgactaagtggtttagctagataagttatgactaaattttggtgaatgttcaaagtatgctaaatgatatgctgttttttccagatttctagatgagttgttggaattatttgagataccatttgatgtgataaattcaaactaaaattactatagactcagaatgttgtgtaatatttatgagaattttggtgctatttattgttgcttaatttagttttaggaatttttgtttagacatgacatgcatatgaaacctattatgagatgcaccaagaatatccaaaaacaaacctaaaataataaaatgcacataccaccaagtatatttatttccatttaggtttttcttattttaaaacatatatttccatttgtttgcttttagttcgaatattttgcttaggttagaatgcaaaaccaaaaggcttaaatttctatttaaaatttaaaccaacttatttgatttggaatttgttaactcaagattttataaaatctaattttggactagctctaatcttgtcccaacaaaactttgtgttttatcttattcacaggatttaaactctaagatcaactattatatatgctctcaaatgctttggttttcaaaaagttttaaattttcctaaaaaattttccttcgtgaaattcctggtatcttacagccgattattgtaatgaaccaacacttacagcaggtacaatcactgcaacaaatatgtcttataaagacatttttgtaatactatagacacatttttaaaatgactttacagtgttatagacaattcacagccaattcatatagacccattcccaacatcacatcagccaattcacattcatattccatcatagcatagccaattcacaaaatcaaacacatatacattcacatccacaacccattcacatatatatgtcattcacatccattattctctccaaaccgccgacatgcatcaaaacctgtaaaactaagttataaattggaacaattttatatgtaactagaaatgcaaatatatacagagacgagctacctaggactttactctaaagaatttaattgtattacaaagaatatttacaaaaatcaaatgtttgtcgcatatgcattgcaaatgttctgccattccgagacgagctaactaggacttcactctaaacatccctttcggtgacaagatatcatctagtatgaattgtgctatctcctctctaatgatttcgaagttaatttccggaatgcttgaaataaattcctgcatgttcggccccaagttagtctacatacttgtaaatttgtcgtcctatgtgtgtataaacaattgaaatacacacctcagggtcgagcaatgttaccttttctgcgaaactcctcatgttatggcagacatggaacccgcactagtcgccaacttgttgatgtattgggaagtctttcttgtgaccaagtttgggatgcccatccttatgcctcccgcctcttgccacatattggttccatgcctcgttcaaggcagatttgatggcttgatattggagttaaggtagtgtacccggctccacttcggcgttattaccagaagaatccagtgtcgcctgcgaaattattaaattgctagttacatactacagttgtacgcgtctagtatttgagtataagtacggtacatgcttacagttgattgtaggcacacataatgaagtccttgtcttgacgggcaaataaacagtccttgatatagcccaccatgtttgctcgatcgtttttcagtgttgtctcgatgaagacaactggatcgagtaaggcaacatggggtgctttacgatggacatgcttccaggttaacctacgagcaagacaagagtcagggtaagcttaattcgtggacagtcactaccatatcgcgtaccaagaaatacttacaaggagtagcacttaaggaggttggtgtcgatcgctcgcaccctgtagaggtcccatagacctttgaagtctacggcgatgaaggcagtaggcccgaggaacggctgaccatcatgctggcccaacatggaggtctctctattcttcctccttgcgttggacttctccatgtagtacccgtgcaactccttgcatgcagggcccatcttgaataaggcatcgtctccgaccaatggcatgcccaatgttgaattcggctgnaaggctttggagaagcctactggcgccttgccaagatcaagttctttggggagatggcacctttatttttcctctccccgttccagcagcttttctgcgtgtgtcaagcttgggtggagaagatttcaccctcttgcttcttttggcaggagggggaggtgtggcctgctgtcaacctccatactgtcgtccccaaaatcagtatcatactgtaattggatgtcacgccctgaaattcccctttccagctttaaaatttgtaaaataaatcgtccgaagaaattgttgttcttaacctagagatgaatccctaattaataaatgcaaaaaataatcggaatcgacatgtggaattttttcttggattctacatgttaaaatatgctaacaggatttttagtggaattttcagagccttggaaataattttaaccaattaaaatgagtaaagggtaataataaatctctggaaaaatccttttttctttttctttttctgcattttttatatattnttgggctattggtcaagtccattcgctttctgtgatggctttccttagggtggggcaagtccaagcagattcctccatcctccataacccatcagggttacggacaggtggggcccacctgcggccccttcttccacctcccgccgtcgaaaccgccgcctactgccgccggtttccccgcttcccgcgcccactccgaccaataccgcacgcccacgtcgccgctcaccttccccacaccttccgctagctcgcgcgcctgcaaatggcgggggatttgctcttttcccccactctctctctgctcctccacttcccccacgtcgccggctaaatcggccaccttcccggcctcgtcgcccctcccgaggccttataaaccatccctccattcccctccaccttttcctctttccaccgctccctcccgtgccctctatcgctcccacgccgccacacccgccgncgncgncttttccactcctccggccgccgctcgccgccgctggagccgccacgagccaatccgctgccgccattagcttcgccgccgccaaagctaccccggccgccgcatccccatccaatcctgccgtcggggcccgcttctccccgcgcgccggtgagtaccaccatagccgccgccgtcagccatggctctcgctcgtcgtggacaccctctctccctctaacctctcacacttcctctcttaaggtgtcccggagctcggccgccattcgccgtcgccctccggtcgctcatcgtcgccgtttgccgtcgtctcctcccgcgccggccgaaccccggtgagaactccctccccttctcttcctcccgcgcgagccgccgctccccgcatgcgcgtcgccgcgatgcacagtcgcctgcgtcgccggccgccgccgttggtggccgcttgccgccgccgccctcgccataaccggccggctggcttgaagccgagccgagccaggccgccttcctccttcccccatgagccgccgcccggtgggccccacctgccagtacccctccctcccccttgagccgctgaccagtggggcccgcatgtcggcgccgccccaccccttgctgacgtcagccctgggatgaattattgcgcaataaatacattaaggctttttctttattagtaaaaacacagataatcttcgaaaaatcataactaattgatccgagcttcgattaagttcattcaagtctcagtaaattcataaaaatgtatagaatccattaaaaatggttttgtttcctgtttcagtagtcttatagcatgttttgcttgtgtgctttgtttgtcgcgtaaattttgcccgtttcgtcgattcgcggtttctcgaagacgttgctgtggttccatcagtgcgagagcaaggcaagtcatacattacaattgatcatattgtccccaatttacaaatgtcccacatttctattaaatattgcattgttttacaatatcatgtgggatgggtcctattactcagctatatgttgtttcccttacgccattgataacttgggtattaaaatgactagatgttggtttaggagatgcttagccatgcttagttcaactagtgcacaaaaggggatcacattaaagcatagactttgattattggcaatagctttggattagtgccaccgcaatggtgttggttaattaaaatacactacatggtgggctgtgggtgcatggttttgctagtcgtgcacatggcgattaaggaccggttcgcgggatgccctggaagaacttatcgtacttaccacaagccagcctgggcaacggctgggcttgtagtgtagcttttctctagccgacgtacccaggcgagggtgggcgtgatggagttgggtcggccggggtgtccggttgatcggcttccggattcaccgcggcacaaaaggggggctgcccgttgcctgctggggacgggcgtgaaccctaaggtgtggtgcgatcggttagagagggttatgcgaagggtcctgtcacggcctcttttcggtatgtcgtggtggcatgtcggcgcacaggaacgtgtcgtggggctgtgtcttgtgggtacagttgtacacctctgatcagagtaaaactattcaaatagccgtgcccgcggttatgagcggtcgaccagattcaccgtgattagtctcacccctagtttagcttaatgaactggtgtagttcaggtggttggttgggcctgttgcaacgtggtgtagcattggacagtgattggttaatactgctatattgctacaactgttttactgctttcaacttctgcttttaaatgctagctttatgcaaaagaacctttagcccccttggatatatcctgcatcatacctcctcttccggtacgacttgctgagtatagtgggtaatactcagtcttgctcttttcccccacaccagagttgaagttcttctcagttggagccgtctcagagaggttggttccgtcgctgccgtcaaggattgcctgtggaatgaagtcgccttgctgctgaagtcaagcttcccggtttagctcgcttttatcttttccgctgcatttgtaatcttttatatttttgtaagacgtggatctgtatgtcaacaattgtcgtttgtgtaccctggctagtcctggacaggggtttaatacacattcagcttagaaattctggttcttaaatttttgggcgtgacattggagatcttcatctctttgttcaacggcaggagggagagatacaacagtttgatggggatgcgtcggcggcggacgagaacttggcgctagccttggagttatattgatctcaatgctgtgcttgggccattgaataaaggtcccacgtgcagccccaaggatcagaatctcgtcattaggtgagtgtgggatagtgtagccaacccaatcgggcttcactaagtccacctgaactttggcattgccggcttgcagctgcgccccatacactcgggtctccggtgtaggcttgaatgcttgaccctctatggcaggaattgcaaatcctggtgtcacccaatcgactagggtacacgatgtcggttcctgcgatagattcattagtgtccttagtatatgttgcaatgtattgtggtgctaatacaatatatgcgttattaagttgtttttaccggtatgtggtccaccgcggcggggcctttaggctgttctgccggagcctcagttgatgcgcagctgctacgcctctgcgtgggtctcacttgtactatgggaccgggagtggcatcgatcgacctatccctgatgcgtgcctccatccgagcctccatacctaacagctcggcggtgaactcttctctaagctcttctttaagctcctcccgaatttgggccttaatgcgtgcagctttctgcgccttggaaagcttgtgcttcttgtaatgccacgcatattggggaaacccaaacttccatggaacattggaaccaatgccccttgttcgtccccggtgttctccgtttcccaacgcttttgtgaggatgtcatcctcgcgtttttgcgagcagacctcttgggaggcctgtctctcagcattcagttcgacctagggtatagttaggacgcgttagacgaagaatatgatataacataatgaaacatattctatgtgttcaacttacgattttctggtacaccgcttgatcttcgggatttgggaacgaaagagttctgtcactattcttctttacccttgcccttgcccagttccttgcccgctggaacgggatatcagcaagcacttgcggggtgttagattccgctgcagcttcatcctccttgtcccgttctgcctgtttccccgcgtagcctccggtgccaagccggtgcgggtgaaggttccttgcctgcagatcacggtaggcctggctttttacccgagactctttcgttggtttggtgggcatggaactcatcccacacgggtcgggtgatgaatgggtatttctcaaatggttctggctgggcggggttgaggacgtactccgtgaccagcgttgtcttgaaatttttccaacaattccctatcttgcggatagcctgccgcttgagtcctgcctcgggctctgtagggtatcggaagctttccttgaactgcctccaggcctcttctttttcttcttgagggaccagatcgatgtggtccttcagaatagtgaagttccgcctccctaggattccgcatatcgtagggaactttttgacagctttcgtcggagccatcggatatccaacatcgtccacctctattatggtgtagacttccttaggaatcttattctaggccctaggattccggctcgatgtagtggtcgttgacatcggttcgtcttgctgcgacatgtcctatgtcactgttgtacggggagaaagtactttttaaacacaaaattgcatctacacacattctctgatggtttgatatacctctatctcctacctgtgttcgcctcgttgatggaaccatagcatccatgctcaatagggccagagcagccgggaactcgacgtcgacatcagtatcccactcgaacttgctatcaatgtcactaccataagatagtggcaacggtagcaggttctagtgggatatggatgtcgaggtcaagatcccgtctgctccggccctaaggaatatggatgctacatatctgctgacgaggcggacgcagatagaacacacaggcaaccaaaacccttcctatccaagatccctaacgttatcataagcaaactcctagattgcatccaagatcatttcgttatggaacctttattcccatagatacagcaaccatctttggatactgaatttatgggaatggggtttgtcggagatatgggcccgggggtatgtgaagtaaggggaagtcatcttcccatccagccgcgtggctctacagcctggccctactcccgcacctcgcgagttacagaagcggccgggggggcctcggggtgccacgttttgcccctcggactctctcgctgcttcgccccggggccctcgcccagctgccatgtggcgggtggagcgagcgggaaggggacctaggctgaatagccatcaatgcgcggcgccccaactatccctcactgcgtttaatgcagtaagggcagacgtgcggtgccgcctagctgacccccatcaatcggacgtgaccagtctgtgaccggcctgtcgccggtcacgtcggattgaacgggcggctatgcccccccccacgtcgcctctgtatccagcggagtggaggtaggtatgacccgtcccgtcgaaacgtcattcggaggaggaccaccacaagtcttcactcatttatgagagaatgacagggctgcctcccgtgccaagcgggcggctgcgctgggtcccactccaggaagggctgctgcttagcttccaagcgaaggcacggatcgtgacctggtcaaggtaaagtgggtccccctcccatggaagggtaggtagaggcgatgcatgtggtatccccttgaactataaaaggaggaccttgcccaccgaacaaggggacgattctgagaaaacctaaactctaggagaacaagggcgagagagctcatccggagggaaggcgtccttgtaacacttaaccataatcccaaacacaggagtagggtattacgctccacagcggcccgaacctgtataatccgattgtgtgcaagcacattagcagccttaggggcggatacgtgatttctacgaagcgagcttcttcccccggccgaaccacccgctatcgagggacttcccccgacagctggcgcgccaggtaaggggcagtcgcacactttgaagagaagtcattttcttctgccccaagtttcccggggcccttgatgatcatggtcgaggtcttggaggtggaggaggcggtggcgtttacccccaccccatccaggagtggggactctagtgggagccacggccctcgtcaccgtcgccacgactccccaactccttcccgtcgcgaaccctcgcggagggaggattccacccgttcgagtggtttcgccctctctctgcccctgggcgaagggaggccaccagccagcccaagccttgcaggtcatcccactctcctggccttttgcggtctgggggctagacatccttggaccattcaaggcggctcgaggtgggtttcagcacctatacgtcgccggtccacccccgggacgacagagtgctgctagatcccccgcgagactggggcctgctctcggccctccttcggcacgaccagccccgagcgcgccccaaatgcaagggggagtggctgtccctctcgccccccgcctcgggtcctagggtagatttggcctcggcctcgggctcaggctcgagcccgtccccaattttggccttgacctcgggctcagggccgccttggcttccggccttggcttccgagagcgacctccctcgccccccgatcccgggtggcgctccgcatgcaccccagtctcggagccacccccgggagggacgtcaccaccatcgcccgcagcgagtcgagtcccggctgaggttggctcggggccggacccggtatgcggccgtgggcccgccgaggggctgtgaaggcccccggccttggatcggccaagcccgggccgctccgatcgttcggatttggtcccccgcgaagggtcgaaccccgagaccccctgggaaggaatctcgctgcaagagaacccggatcgcgttaatgaaggaaaagaaacggagggaacaagaaacctaagatgagtaaaaagcatcgaagtgggtgccggcagttgtacctgcagggagggcggttaaaagtccacttcgggggctcaatgaagctcccccgacacggctccgtttgacctatcttccggagccgcttcttcttccgtccggcctcagcaccggcggggcgcttgtggcccgctggcggtcggtccgccacgcgctcggcgccccctccacgcggaggagagggcggtcgagattcggaaatcttccgtttctctttcgggtcgctagctgagttcgtccccgggtccgcggtttgtgccgggagacctggagctcccacccccgccgggtccgcatgtccgactcccgcctgcggtcgcgccaacgccacccatgccggcagcgctaccaccggtgccgccccggctggaccagcccctgccaacgccgacgacggacatcacggccaagatgctctcccggtcgcggtcgcagcgaaggggaaggatctcatctggaattagcatttgctcggcggagtctaggcccagcacccgttgaatcaccatcttcgcgtcctcctccccccagtcccagcgcgcacccacatgcgtacgcatggggttgttgggaccagtgtactcccacacaccacgggatcgatcctggagaggtgcgatccggcggcggaaatagtcaccaaagaccatcgcccctgtgaggcccaggcttcgcaggcccctaaggtgatcccacatcgcgtcgtactccttgcccagttccgaaaccgccagccatgcggcagatctttcgggaggaccggcgggaagccgaagtcgcgggtggtccggcaacgcggtgtagaactagtccttcttccagtcctcccatttcttgcggagatgactctcgatgtattgtcccgccgtgcctggccggggctggaagtaacatccccctaccaccgcaccttgcagcagctgcggaatgaagaaagactggaacagccgcatcgtcgggcgcaccccgatgaacatatcgcacagatgtgcgaagatggccagcgtcatcacggcgttgggtgcgagatgcaaggcatggatttcatagaaatccaaaacctcatgaaagaatccggagaacggcggaatcaaccccgccatagagaaggacaggaggtgcacggatcgctccagataccgtggccgcggccgccactcccccgccctcacgacggcgccttccggcatgatcttacgggggaggataaggtgtctatccgccgtaatgcgtgatgccgggagcactgtgtcaccagcgtcttgagccatgatggctggtggagaagcggcggagggcttggcgcgcgggatattgtgaagtggcgagaatattagggcttaaggagcgagaaggcaagtgggcagttggcgaaaggaagaaggcaaagtccttgcctccgtatccttttatcctcgcctcacccacgctcacctcctcatgagttacagaagcggccgggggggcctcggggtgccacgttgtgcccctcgggctttcgcgctgctttgccctgaggccctcgcccagctaccatgtggcggggggaacgagcgggaaggggacccaggctgaacagccatcgatgtgcggtgccccaactgtccctcactgtgtttaatgcagtaagggcagtcgtgtggtgccgtctagctgacccccgtcaattaggacgtgaccagtctatgacgggcctgtcgccggtcacgtccaattgaatgggcggctgtgcccccccatgtcgcctctgtatcggtggagtagagataggtatgacccgtcccgtcgaaacgtcattcggaggaggaccaccacaagtcttcactcatttatgagagaatgacagggctgccccccgtaccaggcagggggcggcgctgggtcccactcaaggaagggctgctgcttagcttccaagcgaaggcacggatcgtgacccggtcaaggtaaagtgggtccccctcccatggaagggtagatagaggcggtgcatgtggtatccccttgaactataaaaggaggaccttgcccaccgaacaaggggatgattctgagaaaacctgaactcatacggagggaagacgtccttgtaacacttaaccataatcccaaacacaggagtagggtattacgctccacagcggcccgaacctgtataatccaattgtgtgcaagttgattagcagccttaggggcggatacgtgatttctatgaagcgagcttcttcccccggccaaacccacgaaaggggggtctcacgacctcccgctatcgagggacttcccccaacagggttccataaagaaatgaccttgaaatcaatctaggatattggtaacgataacagatttctacaaatgttgtatttgaacgaaatgttctttttaccaatttgtcttggtcggtaccgtgcagacagtaacccgaccaaaccagatttggcgaccgggacacttcatattctcctaaatgccataattttagtaacttcatttaataatagatttctatgcatatccatcccaattccctcaaaatgacccaaaacccaaaacagtcacatatatattatttttgtacctaaaaacacaagtcatgacatataataagtttggcctcaattttgctcaaaaattatgcatcaattaccatcatttgcaactgcccccactgtccttattggacctaaaatatcccaaaattttgcaaacaaccatataaaaacaagtgtagagggtctgtccttatgcagtaaaaaaatagccataaaaaacataccaaaactcacatttcctccaaaataattcaaccatcacagcccacatcaattcatccatcccattgaacccaaaatatcccaaaaattttgcaaacaactatataagaacaagtgtagagggtctgtccttatgcagtaaaaaaaacagccatagtaaaacagccataaaaaacataccacaactcacatttcccccaaaatgattcaaccatcacagcccacatcaattcatccatcccattggacccaaaatatcccaaaattttgcaaacacntatataagancaagtgtagagggtctgtccttatgcagtaaaaaaatagccataaaaaacataccaaaactcacatttcccccaaaataattcaaccatcacagcccagatcaattcatccatcccattggacccaaaatatcccaaaaatggtatgttcttgagcaatcatgactggccattcttccatcatagcccacaatatttcatcatcatagcccacatctgaacaattttcccaacatcccattctctcccaaattcacaaattcatccatcacagccatataaaactttatcagtagctaacacatatagaaatgcacaagtcattacagccatataaaaatttaccactatcggacacatataaaaatgcacaagtcatcacagccatataaaaattcatcactagctaacacatataaaaatgcacatgtcatcacaaccgtataaaaattcatcactacctaacacatataaaaatgcacaagtcatcacagccatacaaaaattcatcgctagcacaagtcatcatatgtagacattagcatctaaacattgaatcagcaaataacggcagtcttgggcggcgccgggctcggggacggcgtggagggaggcgccgggctcggggacggcggtcttgggcggcgccgggctcggggacggtgtggagggaggcgccgggctcggggatg

SEQ ID NO: 75560 - DNA, 2796 bp, Oryza sativa
ttcggcccaacccaccatgccaccgttggatgcaggttttgactggacggttgagatgaagccccaatgacagttggagggtattaccgaccattgtaaccatcacaaccgtcatagttcagctataaaaggagctcctcttcttacttcactcacacacttcaagcaagagctctcttatattctctcaagttagtttagtgttcttaaactagtggaataggaatagagtagaaataaggagtttggaagtcttctgaagagttcgggtatggctctagtagctttcctttcctcttttgtaagccttgtactttatttagaatactcttctttatacatttatggtattgaaatactttccgagtatattaatgacaactttacattatgttcgtgttatactgaatatactgctagcttatctaggacatgctttggtgcgggtataatgtttgcatatgcaattactctatgtcgtgacgatgatattagagtagtatccggtagtttagacgtggtgtctagattacgggatatcattatttggggttatatgctgcggatgagatgtgggccgctgatggtgacagctcagtacgggtattcctccgcgcgtgtatataatactacgttaattccctggggagggtactcctacgtatttagccccggttgtatggtcatgacgggctgtcataagaaactcagcagtcaggggtggcttttcgaagtaccaggagggcattggatagagggtattagctagtatatcagaaaactagaatgtatgtatactatgtatactagaagtataggagtagattatctttctcttttctttccacttagcttatataatttagtatgagaatgagtagctacagcttgtgtgtcactctacccttggattatcttaactcctgcttaggatatgattatcacaagtaatatataaattattagtcaatttctttctacatgatcttcccacgggataaaataaatatgatactcttagaatactctcgggtgaaatggtacaatggtatatccgtgcgtttgtgggtgaactctataaccataatataacatgagtatttatgcgccattgctgggaattatatttttagtaatgtcgttaagaaataccaacagacaccatgttgccacgatgcactaggtcccacgttgcaacaaaccgtactctcgtgaccgtgcgtatcggctattagattcgtttgtaaatggattactacgaatatattgcaactgaaaaccccctatagccagtaatctatttactactgcctccgtttcaggttatttgactttcctgaaacggaggaagtaacaaacgaacgagacacgtgtcgatctgtaaattagaattgagcagcgtttttgtcacaccctaaaaattcaaattatataaattgttgtttaaatggaatttctagaaaataattttaaaagtcttgaaaagaagatctaattttaattaataaattccaatataaaatggggccagataaaatttcattaaatactttgcttaattctataattccaagatttttctgggatttatttgagctaaggaagtatttttaataaatggaattgcatttaagaaataatttaaattgaaaaaggttttaaaaagttctcttttggctttgggccgaaagtcggcccaaaaccttctctctctctccccggcccaagtcggcccagttcgcagccgcccgcgcgcgcgcgcgcgttcgatcgctgacaggtgggtcccacctgtcaggcccgtcatcttcctcgggccgaaaccctagcgcgccgccgccgagctgccgccgccgttcctttccaaatccggccgttcctttccgtttccggtgaaattgattgaggggaaacaatctccgggatctcctctaccttttgtcctgtggaatcatcggctaaatcggtttggaaatcgagggattcgagttcgaatcggatcgggctctctctctccaagccgagctttccttcgccgttgccgtcgccgtgggccttcgccgccgcctccgagtccctttaaaaggctccccggtgtctcctctacccgccgccaccctcgccttcgcctcttgtcgccggaaaagctctagcaccgtgtgccctagcgccgccgtcgtcaccgtcgctccagccgtgcgccgccgtcgctccagccgtcgccgtcgctcgggaaggccgacgtcgtgttcgccgtcgcgtcgccgtcctcgtcctccccttcgccaccgccgaagaccgccggagcgtcatcgccgtcgtcgacccgaagagcttcgccgcttcctcctcgtcgccgtcgccgtccgttgatcttccgccgtcgttttggtcgccggtgagtccgccgtgtcgtcctggtggtttccgttttcgtcctcgcgccgccgttcgccggcgagcgtgcgccgcccgagccgtctgccccgcctagccgccgccgccgtcggtgacgtcattgccgacgccatcggggtcgtccgccgtgagccgccgtggacccgatcgatctcggccgtccgtttggattggatcgaatctcagccgtccgttcgcgtgaaccgccgccgtgcgcccggtccaccgcaaaccctagcccgctgacgcaataaaccttcttttccttttcaaaaataattcattattgcgtcataattcatttaaaccgatttaagtgttttattccgattaactctttaaaaatcataactaattcatctagctccgatttagtgg

SEQ ID NO: 75561 - DNA, 740 bp, Oryza sativa
ggattcgagttcgattcggatcgacttttctccctccaatccgacctttccttctcgccgccggtcgccgtgggccaccgtcgccgctcgctagcccctttaaaaggacccccgagctctcctctacccgccgccaccttcgccttcgtctctcgtcgcggaagcgctctagcgccgtgtaacctagcgccgccgtcgtcgccgtcgctccagccgtgcgccgccgccgttccagtcgccgtcgtcactcgggaaggccatcgtcgggatcgccaagttgccgccgtcctcgtccgccccttcgccattcgccggcgagcgtgcgccgtccgagccgtctgagccgccgccgccggaggtgacgtcaccgccgacgtcatcgtcgccctctcccgtgagccggtcgtggaccgttcgatctcggccgtcctttttggacagggttgatctcggccgtccgttcccgtgaaccgccgccgtgcacccgatccaccgcaaaccctagccgctgacgcaataatcattcttttccttttcaaaaataattcattattgcgtcataattcaattaaaatccatataagtgttttaatccgatttaatctttaaaaattcacatttgaactcagtttaatgtgggtcaagttgcaaaagttgtataaaataaagatctacatattaaaattgtccataaattgaatgaaatttatttaattctttgtaaatgggctttaaataga

SEQ ID NO: 75562 - DNA, 8541 bp, Oryza sativa
  unsure (1)..(8541): unsure at all n locations
gttgtataaaaggtaatgtcacaactcctttcgagggtcccgtggtggtttgagccacatggtgacataatgtgggttggtgtcttgtgggtacagtggtacacctctgatcagagtaaaactatttgaatagcccgtgcccgcggttatggccgggtctaacaatgtctttcgtgattagtctcacccttctcaccataatagaagatgctataactggtaaaacttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgtttttacaaatgaaaccctattatgccatcctttgttatcctgtgcacttgcatatttgctgcgtggcttgctgagtatgtcatatactcatcttgcaatcattcatcagaggaagagttctacagtgaagctgatggtgtggaggattaggtgtagccctggtcaagctgcctgtggagtggagccgtctgcgctgtttatctttttccgctgcttagatctttattgattgagaggaactatctacctctgtaatgatattttatacgcttaataattagagtaataactgtactctattatcaatttgttattgtgtgcctcggctgattcctggacgagggtttacacacatataagcatttggaattttggatagaaattccgggcgtgacagttttttagagcaggtacaatagcaggctataagccggctgtaaccatatatcgagaagaaaagagaagagagagaagaaagcgggctacagatttgtagccggttgcaacacggactccaagatattatgtgtgtatgagaggtgggaccgtgtattaatggtgcagtatatttttatagttaactattgatgaatgggctattagattggctatagatgttttggagccagtagttggctacactattgaccttgctcttaaagtaatccatttcctatcaacaagcgtgagacacgtgtcaaccaatttattaatcccgattattttgggacagaaccacccagtagtagtccgctagcgatggtttctagaataatgctctttcagtcccctcctttactcatttttgggagacggcggcgacagaccaaatcgggccgatgtagcaacccctgccgctccctgccgacggatccgtgtgaaagactgtcccaggtaattgttgcgctctctatcaacatttctgctattttaaatctcatttcttttttatcccaaagcgaagattggagacaatccccttcttcgttgctgacattactgtccctgccgccggccgccaccccgccagatcaggccggggcggcacggatctagcggtcgccgccgccgccaccggggcgactcccctggccaccggagcaggctggcgagaagccccgccgccgccatccttacggtctttgctggcgaccgctcaggcagcggcgaggtggaggaggaagaaggagcgggaaggggtggccggacttgtcgcctccggagccgtcccgggggtagggcgacgcaagagcgtgacggttgacgctgtgaggtcccttcagcggtgggaacttcatggctgcggatcaatggaggcggtggcgatgaccacggatcctgaggcggggcccccatttgccaccccttatggcggatctggctggtggcggcgcgccaacggtgttgccaggaggccggtggctgggtgagccagcaaggcttcatggtggctggtggcctggcaggaggacggcgcggctgtcagcgacggtgcgacggcagggacctctagggccggcgcgactcgggaaggtggcgacaacgggcagccgaagaaggagaatagatggggaccgacggcagcggggatggagatgatggcggggatggaaggcggcggcgaggatggtgacagcgggccggatccagtcgcgccggagtcgggcagatctggtgtgaggcaagcccgcagtggtggcggcgctgcggagttcgcgggctcatggcgatggtggtggcagcgactggacagcggcgacaacaggtggctggccaacggtagcatcggctgccggctactgtggcaacgacgctagtggctagacggcggcgaggtggctggccgtcagcagcagcgactactgtggctgcgatgggtggaggcacggtggtggtgaccgtgactgctgggggaggcatggtggtctcagacggctagctgggggcttggcagatggctgcacctagccagcgcgacagcgattggagcaagggtcggactccgaccatcggaggccggcttggcgcagagaggcgcagccgatggtaggaggccggactggtgcgagaggcgcgtctggtggcggtgcaggccggcttggtgcgacaggcgcgactgatggcgggaggccggactagcgccagacgcgcgtctggtggttgagtaggccagcggggcgcgatgaggcgcggtcggtagtaaaggaggcgaccacgatgcaaggaggagctactggtgggtgtggcgcggtcttcggcgcaagaaggctggctagcggggggcgccagtgcagtggtcccacatgtcggtagaggttgagcggtgttggatcatcggtgggtcagccgtggactcgcaggtgatgagcggcgggtgaaaacccagccccgccttggccagaccgaaaacaatggttcatcccccctcctaagggcattgtcgtgccgtctcatccctcaagggtagttgcgggcgaaagcccagtcttggctcttttgagtccctgacagatggcggcggtggttttccatcacttctctccttggagatgtcatttaggcatccccttgctgaaaaccactcgaacgattggtgcaagcacgctctaagatagagttgggctttgtattggttgtaagggcgttttttgtgcgatctcgtctatgctcctttgttggcctagcggcggtcggtcatggctagcggcagccggtccggtacagccttctcccggacctatgtgttggcgctatcggtgtgtgggtggtggtatatatttttcctttttcctggttacgaccttccaaggttgtaatcttgtaatttttttctgctctatcagtagaaccgcaccgtctcgtgtgagtcgtaaaaaaaaaaagaagataggagacaatgcggaagaagggacatataagtagaagcatcggttataattaatcgggttaaagtttagcagaactgatcggatgtttatatttttcttttcagccgcaagttgatgaggggcttgctaatgggcgcgggtgcgctagctgcctaactggcgcagccacgcacgtcccaattccacctctcctcaacgctaataacatgattagcattgatgacgttaattagcgctaatgataattgttagtattagtttttttaaataaaataatacataaatagaacttttaactcagatttggaaaactttcaacccggatttgaaactttcaacccagatttaaaaactttcgactcagatttggaaaactttcaatccaaatttgaaaactttcaactcagatttaaaaactttcgactcggatttgaaaacattaagtcaagatttttgaaaaacttttaactcagatttgaaaattttaaagtcaagatttgaatacttttaatccaattttttaaaaaaaattcaacttatattttgaaactttcaaatctcgatttgaaaaaattcaagtcaaatatttgaaaactttcaactcggatttaaaaacttttaactaaagatttgaaaactttcaactcagatataaaaacattcatttgaaaattcgaaacatttaactcaaatttgaaaacttttatcttaaaattcaaaaattcaactcaaatcttaaaaacttttaactcaaattcaaaactttcaactaaaattgaagatgaaagattcaacttctaaaataaaaagatcgcagaaaaaaaggcaaagagaaacgaaaaaggcacgtacgttaggtttaggtttttcgaaaaaaaaaatatggacgtgaacgccgtctgcgtgcgtacgagccagcgctgtgggccttatggcctaaacgcgtgccgctatcacgcacgcgcgaattagctctcgcgagttgatgagaccctgtgtcgtgttaaaacttgaaagccccggccgccagccccaagcccccgaaggcccgaacgtatcagattcctagcacaattcaactgtgcccaaaatcattgtgcctccagcctcccctggaggaggtcgcccgcccgccacctgcgccgatctccctcgatcccgcgagatcgtccgtcctgctccttccgccgcatccttgtgagcatcttgatcatctctctacaatatgcacctgttctcgtatttgcgttacccctagcaagcttctgctgtaggtctggaacgttagatccgctcttggtttattccaatctggatgcaaagagttcgttcctttcccatacgagactaatttcgtctaataatacacctatatcaaaataatccggtatatattctcaccgtattgtggtaccttttcagctaatctatatttctatatatgtattgaccctgtttaattcagaactcgacatttaacttccttgtcctgatatacaagcaacttcgttctgccgtactctcttttttttcggcgaatttgagcttgacaaccatggtgatgatgagctgcaagaggaggaaggtttcaccagccagtggtgctggtgcaccggtagtgctgccagaagagatgatgattgaggtgctccagtggctgcccgtcgaatccgtcctacgttttcgagccgtctgccgatcctgggccacggctctctaggacaaggaataatatacgcacgcatggaatgcctgttgggttatttccggtcgtgacaggagcggcgacaggtggcaggccgatgggcgggctagggtttgggattaggcaaccagctgtggcagaccgtcagcggcggggctaggtttcttctttttgagaattttatttttttcacaatattttgattttcatgcggttggcttaagcgcccgcatgaaaatttttttttttcgcatgtggttgggctgaacgcatgcaaaatcctgattttttgagcgtatgcctatccccatgggccttatgcaaaaatgaaatctgtagtgagcaaagcttattggatgtttagatttttcttttcaagccgcaaaatttgatgaaaccgtgtggtgttacaacttacaagcctcggccaccagcccaaaacgtgtcaaattcatctgtgccgaaaaatattgtgcctctccccctcgagtatctctcctccccgtcggcccgcgagggaacttcgcccgccacctgcgccgatctccatcaatctcgcgagcaggagcatcctggtgagcatctcgatcgatcatctctctacacaacacgcacctgttctcgaatttggtttacctctagggcaagcttctgttctaggtctggaaggttgaagcttttttctgaacctccatgtccacgttagatctgcaatttggatgcaaagaagagttcgttcctttcccgtatgagtctaatttcgtctaataatacacctatatcaaattattatcaatccgttatatattctcaccgtattgtgcattggaccttttcggctaattaatttatatttctatatgtattgaccctgtttaattcagaactcaacatttaccttccttgtcctgatatacaagcaacttcgttctgccgtactttttttttttggcgaatttgagccgatgtatccatggtgatgatgagctgcaagaggaggaaggtttcaccagccagtggtgcaacggtagtgctgccagaagagatgatgattgaggtgctccaatggctacccgtcgaatccgtcctacgttttcgagccgtttgcaggtcctgggccacggctctctcttccgaccaattccgcggtttccacacggccaagaacaagatcaagccgttgccacccaagctgttcttcgtctcgcagaccgcgggattcggctccacatcggtgcacacatcctcgccgctgtcgcggtcagtccccggcggtgacattcatcgtgatctgctacttccatctggacaatgtgcgcggcgatttcatgnccatgacgcctacaccgtgccatggcctcacctatctgcacgatgctatgggactagagtactacgttctcaatgcggcaacagggtcgatcagccgtctgccacctgccaaaccgtgccatctggatctgctggactgggattcgatgcccggacaggggagtacaaggtggttaggctgtttcgagagataatttctggagaaccgcataccaagtgtcagatatacactctagggggcaagcatggtgactcatggaggccagctagtggaggtgtacctttcaaattccgcactgctggaacttattctatttcagcttcacaacaacataaacttcttccagtgtttgtggatgggtttcttcactggcttactggctctttgttctctttcttgaggccacatgctgccatcttatccttctctgtgacagaagagacattcagattggtcaggtcaccgccctttcaggtttcaggagtgcacttggtggatctctctggtaacctgtgcatggtccgggaccttcgtcgcatgtcgtctacgctggagatttggaagctgaatgatctttactccagtgattggtcattggagcatcgcatcgatttgtcgacggagcatgttgcccgagatttaatgaaaccagattttatcagagttattggttctgctggcagtagtggtatgtcagggaagaagaatgtaatcattgctacatccaatcgcaaggcgatcgcctatgatcctacatctgaaacactagaaacaatccttgagatcaagggaactcctttgccttaccaaactgcacgttctgctcttggactgatcagtttgtttgaagacagtcttgctcctgtgtgtaaaaccaatgaagagatagcattgtcatctccccttgccaaggtgataaaggaggccctactacggcttccgggtgattatgccgtgcagttcaaacttgtctctaagcagtggcatagatttattgaaagttggagcttcgctcgtggataccacatgtataacaacagggacaggaggccaaagatcaggcttgtgggcatgggcacaggtggatcatacaggttttagttttgccagcatagaaaaattgcttcaagaatctcctagtaaagatacatggcttgatgcaaaggtggtttgctccaagccttgccatgggatgaatctcataagcactgagctggaggattatctatacaacccttgtacaggttaccgctatgtccgcagtacccgaggggctcttgtctacattccaaatagaatacctagtgatagatttcgtcacgatcatgcttttactaccggtaataagaatgtcggcctggggttcgatccactgatgcaggagcatgtcatttctatcagtggagaaacttcaaaacctgtcgttacaacataacatgctcgctttttacctgtaaatcgcgtcacacgtgtgattttttacagccgcctctgcctgtgaatgacatgcctccggcttacttggctggatttctgtactggatgagtgagccaaggttgagccagagtaagacaagcgccattctctcgttcgagatcgcgaccaagacatttgttgtcatccagtgcccttcgtgtgctctaacaagacacaacagaagcccttgcgaatcatttgtggtagagcttgaaggaatgctttgcgttgttctcgctaatccgtttgaagaggaattggatatttggaagatggagcatggtcaatgggatagagcatacagagtgtgtctgaaaggttggcctggttattcccttggagctaatgtcgtggttccgatggctgttgatccgaaggatggaaggattctgctcaacacagggagtaaattgggtctctatgatccaacgaagcgggttatcgaaaacctgtatgatcttgatgaggtgctgcgtgtcaaacagacagatgagacgctgcatgtcgaagataaagaaaaatcttagcagatccaagtccatgatggttcccagttaaaatgtcagcattctgtcaggaagtttcgcatatggctgtcacctctagaacatgacaggttctcttatgatgcgcctgcacccgcttcatctaggaagaattctgcttgctccaatgacactgagattatgccctttgttcctattttgtatgaggatagtcttgcgggttatcgcc

SEQ ID NO: 75563 - DNA, 3827 bp, Oryza sativa
agtgtaatgatgactgattactgattagaagttagaaaagtgagaagtattaaagtataagtgcataacactgtaataccaaatcattaacaaatagggcctgattttgttctacattgcggtaactctagcatataatacagaaatctagctgttatgctctgcctctatatcatagctccaagggtcatgtgatacaaagtacagcttttggcctaattatattatcttcatctatgttaaatattctctgaatcttttgcttcatgcttgatattactagaaaatttgatcggaaaaggcgggcatgctgaggtgtacaaaggacatcttgctgatggacaatttgtagcagtgaagagactaacaaaaggtggtaacaaagaggacaggattagcgatttcttatctgagcttggaataatagctcatgttaaccatccaaatgcggcacagctcttggggttcagtgtggaagggggcttgcacttggttcttcagttctcacctcatggaagcctggcttctgttcttcatggtatggtttcctctaaatattctttacttaatgaatccaatttctgagagatatgctgcattgctgctatgtggtggcatgttacatcatatatcattttttagaaaagtaagaaatatatagaccttactattaggaatcaactagagaacagatatctcttgacattcatgctaccatgtagtacaacatattcatttaggcagtatctgaactatgaaatgtagttctccaataagtatgtgcgaatttgtgatttccattttggtaggcttcatacaaattttacattatcacttcttgtagccctcatttcaattgcctcttaaatgcatatactataggccgtatcacatatctgaactcaagcatcatcctctttctaaaaaaaaaatcaatataagagaatacttagaatacccttagtctggtgataaaatggagttcagctgaacaggcacaaagggagccctcaagtggaaggctaggttcaatattgctcttggaattgctgaaggactgctttatctacatgaaggctgccatcgacgcataattcacagagacatcaaagcatcaaatatccttctaactgaagattaccaacctcaggtatgtattctactaccagtctcttgccgtagtcctatctgttatatgattcctagggttcttttaaatgcaacagtttttactccctcattgcacagatctcagattttggacttgcaaagtggcttcctgacaaatggactcatcatgttgtgttccccattgaagggacattcgggtgagttcgataagtttttttcagtttcatcacaatgatttaatcgtacccagaaaaagaaacaatgccattgttggttttaacttagactttacaccctttcttaggtatatgtctccagagtatttcatgcacgggatcataaatgagaagactgatgtgtttgcatatggagttttgcttcttgaactagtgacaggacggaaagccgtggattcctccagacaaagcctagtaatatgggtaataaaagcaaatctctaatatgctccattatacaaaaattcaaatcagctcattttatatcattgtctggtcatattgagagaggcaagtgatgatcaaaagttaattctacaatacttgaatggataacatgaactggtataatcacatacatctgaagcccttgaattcacaagctgttgtttgtcatgtgcataggcaaaaccattgctcactcgaacaacatgaaggaactagtggatccttctcttgatgttggatatgatccagaagaaatggctcacatcctagcagtggcatccatgtgcattcaccacagctcaagctcgcggcctagcatgaaatcggtgagtgcgatgaacacgctaactatacggccattgtaaaggctaaaaaagaacaatttggattgtaaactgacctgttggtttgatgcctgtaggtggtccgtttcttgaagggggatagggaatcactcgaaatgatgcaaatgcaaagaccaaaactcatgaaacccctcatgttcgactccggcgattcagaggattatactcgctcaagttacctcaacgatctcgaccggcacaagaagcttgccttggagcagtgatacttgagttgattttgactgccatcttttgtacatcatcatcattatcaacattgtgatcctcctcctttccaaaggtgtagtagtatgcaggctgtatggatggatgtaagggttcagtttatcagttgctccctttgttgctgatcaccatggtgtcattttggccaaatgcatgttgtgataccattattcgatcgatggaccatttcagccctcgcctgtgtgttctatctctgcatgaaccttgttcaccatgtcaaacaaaaaaaaaaagctcctagatccaatcaagtaacctgaatttcaaaaaggtaaatcagttcaatagaagagatgcacttgatattgtagcggtaaggggggtgattccgtgtttaattctaaacacactcataatttcttctaattattggataaaaaagctccttctcgatttcaattctctagaatgctaatcaaccaaccatgattatcacaggcaacaccaatttcgaatggatattctgaatcctaggttgcacctgtactccactgtacctttttttgtcgccgccgtcggatcccccagctgccccgcggactccggcgcagcaggcggaggctcccccgtcgcctggaagcctctccggcggacgagcaggcgaggcgcagcaggtaagagtgcgctcgttaaccctgcatggctgcatcgattcccgtggaccggcctcgcgcggcggggttcgccggaggtccgccgccgtgtggagtagaggagagaggaaaggcaaaaggaggatcgaaatgcaaaatgcgaatagttggagggtcagtcgtgcaaatatcggcccaagtaaaggccccattagcttctgattaggatacagattctatgcgtgcgaaaaaactttttgtatgtaaatttctttaaaacatcaaataaatctgtttcaaattaagcttgtaatgattaaaatttaattaattatgtgttaaaatttaattaatcatgtgttattggtttgttttatccatatcctaactttcatttttattagaaacgaatggggccaaggctcatcttttattaaagggtaaatttcacatctggtcatttattttgaccaagagttaaactaacattttcacttaacactatgcatcattttgtttggattaagggtaagggtaccgacgaaatatgtgagggaacttcatatgagatttacacagggatacatataaaaaacaaagcattgtactatgtttttacattctatttagtttgagtggtatctaattaagttatactttctattctatttttattcagttgccctccgtatagattaatttgtgacacttttaaacatattcacatcaccattttagtgtgattttttttaaaaaaaaggttgttttctgattttctaaaagaccatttgatgggattttctgagtttctaaagatatttatcgtgatactacaacactaagaatgatggtttgaaccatttctttgacattctctgacaaacacctatgatattccaaactgcaactgtaaagatatgtggtgtcaagtgaaaatgttggtcaaattccaatgtgatatttactctttattaaacttcagtgtgatgccgcccctgggataggaa

SEQ ID NO: 75564 - DNA, 3994 bp, Oryza sativa
cccccccacccctcacctccattcatgtttctctgtatggagttgcaacgatgttatttttgttttattttttcggatgttttttcacacttaggatcacgatacaaccaaccaccaaaaaaaatttcaactcgaactaccacttagctaagtctaccacttagtctactttgcaccttcactaaaattagaccataacttctttagtaaaaccttttgatcagcatgttaaacataggagagatcctttagtaaattagactatatgaaattacttacttaatctaattcaaaatataaccatataaaatgatagccataagttaaacagtatagagatgcaattttttatttttatttcattttttgatatttttttcacacttaggagaacataggaaccaaccatataaaaaataaactcaaacggacaaaatgtgacttgtagaattttccaaaactcaccgaaacggacaaaatatgtcatttattgaaataggcgtaactttctcatacggactcggaatcaggcaaataatatatccacggacatctacataaaaagttacacccgattctcccttgctttgccaggttcggcgatattaaaacctccaaattccacttgcaagattgtgtttttgaggagagaagtttttcggtagagctttgaaaaattccacaggccacatatttcgtccgtttgagtttattttttatatggttggttattgtaagttcctaagtgtgaaaaaatatcaaaaaaaaataaaaataaaaaagttgcacatctctctcctctgcactagttcggagagagaggagaggagagaaaaaaattctacgggttacatattacgtccatttgagtttattttttctatgtttggttcttatgtatccctaagcgtgaaaaaaatatcaaaaacataaaagaaaaataaaaaattcggggggggggggtggcgccagccattctggcgcgctctccctagtcacctcagcatcgccccgccacgtcggcggttatgggataagtttttttaggggtctatttgcgaaataagtttttcacaagaaccaaatgtgaaaaatccagatttatcctctcacttccttcctggaggtgagatcttcgcctgctcattggcggcgggccacgtggcaccagatgcgagggcttggtgtgctttctccatcatggaccgcatgtatttctcctgggcctcaaccctcatctggaggtgcttttctgcctgcatgcaaagaaatatattcactttctgggtgtccaaagaaaatgcatatgccaaatataatactcatgatgagttgaaagattattgaaaaaaaagttgtgctagcactagcagggtaaacttcccaagaatgttcctcttgcaagagacatatcatttaattttcagatagaacatgtgagaatttaatggggaacgttcatgcatgtaaagttcagaagcaacatgctattccttccgcaaatatcctcttttttatcaaatcctaataaaattatactacattttatatgctccgatcctaatacatatatctgctacttttataaatgggaggagcaaataatgaacttaaaggggtactaatttattttgagataaatgggaggagcaaataatgaacttaaaggggtactaatttcttatgtgaactagtcatcagtatgcaatgatgaatttaaaaatacatatgctctctcacctcttgttgttcttggctctgggccttcttatctgccccattcacatgcacgttgcggctgtgaagatcgacagaacagaaaattaattttgaaaacatatgaacatgcatggagctagatcgatcagaaagtatagacaaaagaaaattaattttgattgtttggctaaaaagagggtgcattttgaattaatgaacaacaaattaatatagccatggtaaatcaacttactctgaattcgtgcctgaagatggcgctgcattccattgattgtccattgctgaagtactgggaattgaaatggcgatggatcgatcgaatgcacgaagaagatgatgaaataatcagtactctgaccggtgtaataagagatatatataggagtacagtggcgcagttaaagggtttgtctatggtaatattctaaaatcatccctaattatcatcaggtaattaattagcatgatcagaggagccacatatatgttaatttgcatgcgcagatcacgctactaccaaggaaaaccgcttgtaataatacaagggacgagggcgggtgcatttcaggaacaaatatttctttcctgaaaccagaaatattccacctttctagtggatttcaggaaagaaatcgggaccatatataattgcaagtcccatgtactcaaggggatatgaaaacagccagtttttttatacagccaatataattggggtgcatgaaatgggctgattcatacccgccgttatctttactattgtacaacctgctcaccgcccctcctctttattgttattgggcttttaaaaatcaaacataatcgttattttggttctgttttatatttttttaatatcgcgtcaactgccccaccctatcatgttgcctcttctatttattattattgggattttaaaggtcgaacacgattcttgttgggattccccaacatgaattaacatacacgtttctcaaactcttaacaatacgtgatttttgaaaaatttgtacatatatgaatttcttatagtaaatactatttaatttaaatctatttcctaactttataatacttcattcatttatacctcgaataattaatcttaacagctgctgaaaaaaaaatagaacagttgcttgtgtccctgaccatatgatatgatctgaattctgaattgtacactagcacaagcagtgtgaagttcagcaattccaggggcactgtgtatagacattagactgtacatacatatgcagcattgcagaaaggaggcgacgcagaacaaacgaagcttccactctcagcaagaaaaggctgcatgcatcatgctatacagggctcagtcactgatataattggagcaaaattaatccaagctaattaactgtggatatatttgagctagctactttaaattaagccattgcatcgtgattcgggaacagtgcttaattgtgctgttatgcagtgttggtctttctctctccccttctctcccttctttgcttctctatcggtgagaggaagacagagcaccggcgacgagggccagtcccctccacccgccgctccgagctccgccgccccctcctcccgctgccccgaactctgtcctctgctgccccgagctccgccaccccctcagccctaagctcagctcaccaccgtcccgagcgccggtggttgcgggcgccctttgctgccgcccactccgcccgacatcgtcccgagctccgccgcccccttcgtcgctcctgcccgccgccgtcctcaaggtgaggaagcgagaagagtgaggattttggagagaggtagagaggtgaggggtaaaagagagggtgagagactgacatgtggggcccgctgatttaaaaagaaaaaaattgctgactggattgccacgtaaaccaaaaccgtttgtaaagctgctggggggattcatccaatatcgatagttgagggtgaaaattgactggttttcaagtttaggggataattcgtactcatccaatatttcagggggggtaatttatactttttccttttaataatccatagcaacaaacgagtaattttggctagtagttgatcgataaaaggaacgccaataatatataacatttttaagtgcttgggctcattaataatctttttaaatgcctacccccaggccccgagtaataatcatgaaaattttagaaataatgttaatataatctagatgacatgcaagtatatgggctgcaggaat

SEQ ID NO: 75565 - DNA, 3084 bp, Oryza sativa
cgatcgatcaagcacttgcacttaattatatccttaaaatattttacccatgagtaaaaacatgttatcacatgcatgcatgccgtactgtgacacgactccaaatacatatatataagaaaactttcgttaatgttcagacaagcatggatgaattaagacaacacaaaattaaaatttacaaactttaagccaaaattaagaatgtaggcacgactaattatctagatcaccctcctctctcaagaacttaattaattgcatgcatggatgcatcctaattaattgaacgatgcataatgcaatactacttttgtatactctcccaactaataacaagacagttacatatgcttattcagtgatcttgcaagatcagttcagcctgcttgctggtttcaccacaaaattaaacatgcagttaatataattacctcttcaattcatcatcaattagtttacccataggagatgttcctagccttggctccaacaattggactactcatcctctcacttcctacaggtagcactgtttgctgtggaggtggtgatctcatgtcaagcttagagctcatctgaccctcaaaccccttactgcccatggagtctcctcctgacatggtgatggcctccatcatcatcgtcgtcgtcgccggcgccgccatctggagctgatgatcgccggagatcttcgccggctcgccgccgccgtcgtcggcgccgggccacaccattgggctcttcccagtactggagctgtaattgaatgccaagaaggtatcaattgatggcctgatctccatctgctcatgctgctgatgcaggtgatctagatggcttcctccatataactgcagatcatcttgcagagaagggaagctcatggagctgccaatgtcaaggacagcttggctgcctagagatttgtatcctgcgtgccacgtggcgcaatctcctgaggacgagatggcttggtatgctttctccaggatggtctgcatgtatttcccctgggcctcaaccctcatctgaaggtgcttttgcacctgcatgcaaagttagttatattcacttcttttgtgtccaaagaaaatgcatatatgccaaactcatgagtgccacagatgagtataggaaaaaaataaagttgtgctagctaggtaaacttcccaagaatgttcttgcatggatgcatctcattttcagaacatgtgaaggacaaacattgacatataagctgtccacaagcatgtaaacttcccaagaacgttcatgcatgcatgcaaaagttcaaaggcaacatgtgaaggagcatatgcagaataaagcaaagcaaattaataagtaatttcttgggctattaagttcagtatgtgattaatttgacaccatgctgaattacagaaaattaatttgtttctgacaatgctcttaattacctctaattgttcatggaatcttctctgaacttccatcttcatccttagtgcctcattcacatgcacgctgcggctaacaattcatagaaattttgaataataagatagttattaaaaaccacattttgaattaatgaacaacctaatctagctagggtactctatgaaaaaaaaatcaacttactcattcatgcttcttcccatgatgcccgaagaagacgctgcattccgttgcatgtccattgctgcagtgggaaaatggacgaatataagtttgaatataattcaccttttgattatattcagagaaagtgtgaaattaactattctgaaagaatcatggtaagtaaattaagctgtttaaatagctagctagtacaaacgaaacagaaattcactgctaacatatatcaagtcggtaaactttaacaagcggaattaaaggaaggaaaaacatgcatgtgcgaacaaactaacaagctaactagccagctaattataagaacacaattaggaatgtaatatgctattttaacaagtagatcgtgtgtttaccatccttaaccgagtggtcgttgaaatccttgtgctgcttcccaagtctgaatttctgaaaaaacaacaatctacaacacatgagagatccagagatacagaagtctgaatttctgaaaaacaacaatctacaaaacatgagagagagagagagagagagcataagctaaccctagttctaaccatgctagctagtgcaactagaaaaccatatatagacatggatctatatatgtactgcacacacacctgaagatggctcttgagatggtaaagtgtgagtcccttgactcccataaccctcatgatcgtctttggagtcgcctctacaattgatcaagagtttgatcatgaaacatacaagtaatttacaattgatcaagagtttgatcatgaaacatacaagtaattaattaagaagaaccgaactcgaaccaaataaaatcaaatcaaattctcagcatcaagatcagtcatgtatagagcgtagctacgtactgtccgggcctccgagctgggtgacggcgtcgacgaagcggtcatggagctcgacggtccagcggaggcgtggcttggggtcggtggtgaggacgaggccggagtcaccctggacgcacaacggcggccgatcattcgagctcgccgccgccgcggcgccgccgacgccgacgccgccactgagctgctgctgcttcttggaggaggaaggagaaggagaaggagaagaagaagggaacattctattctcctagctagctttcctcctcctcttaagaacctctctctctctctagactcactagatctcctccctctctctctctctctgttacagatttggaagagattcaagaacaaaggaatagggttcgatcctctcgcggcacgcggaacgaggaggggagggggaggaggagagaaaggactacggtgttggtagagaagctgtactgctgctacggcgacgaccacatcacttgatctctcttagcttcttttcttgatgatatgttctcatctctctctctctctacacctctctttgttgcttttaggtgctttgattctctctctttctcctttctct

SEQ ID NO: 75566 - DNA, 2448 bp, Oryza sativa
taacaattattatgtgcgttcggcagcaacacaaggagaggaaaacttttatttattttttttaaaaaaaaggaagtctcaccatgttttttaaaaacaaagagaagaaactgttgtgtttttattaagaaaaatctatagaaaaattgtttcaaaagtcatatttatctgtttttcagttagaaataattaatacgtaattaattaatcatacgctaatgactcactatttttttcttaatattctctttttttctcctcaaacacaccctcagagcgccggtgcatatatacgtatcctcgaaaatattaaattagtttttcctgcatttattaagtttttttaaaaaaatcaaacaatatttgttaccatagggtgtataacttataaagattgttagataagtaaatcatatattgttgaattctcgattctagcaggtatacttcacccaatttgcaaaggtttatccattaataagcaggggtgaaaacggatcgagttcggtcagatctcaaccttttcatatcctaacccacattttataatcggaatcgggtcggacaaggatagtgtcaaatacggatacaaactcgtataatgtcgggcaaaaatatggaacaaatacgtaccaaaatagatacacacactattggttacgaatatttattcggatatcaagtcgaagcaacaaccttatatatcacatagacaataaccatttaacaattccatatatccataatacaattatattaggccattaggaacttaggaaataaatagggtataatacatcatagcagaaccaatacatagtaccaaaaaatgcctcacaaaaacataatataggtaatatccgtataattatccgggtaaaacccgaattttttaccggataatccgtatccatcggatactatatttccgaacccgatcttatatccgccaaaaaagacatgtattcggacctgatatccgtgaaaagtctcgggtacccgaatttgtcccgaaataatgtggccgggcaggagggcgggaaatacccgccccattttcacccctattaataagaagcattattaattccacatgcattgttcatctatcaatatatatattcttattgctatgctatgagaaggatttttttacctacttaattaattaccaggagatacaacatactccacattcttatgtcctccggttacacgaattaacactaaaattgtcgacctaattaagctgaattatgcgcgccaacagagaagctagattagtggaaacaagagatgacttcgtcttttatcactagtgcatccaatcatcatatcgttatatatatgtgggtcaaactctataatatatatgcatatatctagacacatcatgcaattagtcatggaaaaaggagtgtactcaaaaaacaccatcatatccaaatgatggcttgcagattgtgagggaattaaaaagacatgcatttgcattgagccccgtgggaatggttggttgcccaagtagacatcacaacatatacactgaaaaaaaaaaccctaaagtttatatagtgtgcattggggaccaatcaaccacaaccagtcaggcagctttagtttttagttttggtttggttcctacaaccataaaccattaattgccatcttgtggcacttaattttttttaagaactggctagctagatattcactggtgcatataaattgatagtaatatactccatattggtaaatcaaacaaattaattgttgtcaagaattgatcaggttcatgcatgattagttgactgaaccaaatagcaaattgatattgaacttgttggtagtaaattagtttatttccatcaatttcaatttttccttttgtatgttacatatatataatgctggaactgctagctactctttttctacttaaaagatgaataggtgaatgcacactctccttgatcttctaaacagtgtgttttttcagaaagaaaaaaataaagaactttctatacataaatttcatttctgtttttttttggcacactagtatgatttgttcaaagcaaattaatgtgatgaacaaattgtctacaggtattgatgccacaaagggtcaaaaaagtgagcagcttacaatcaatctcactgagagtagtctccctttagtacaatagaagattgtctcccatacatgcacacgtcactaagcatgcatcccattatgacacatacaaatccaaacaaaaaaaatggtggtcaaaattgtggcttgaggggcccatttgggagaggatgagtgagaacattataaagcaattaagctctagctcaatcgttcctagcttactcttccatgagggggatggacaagccgttttctttacacgagagggaatagatgctttcttctttgacaattaagcaaagattcct

SEQ ID NO: 75567 - DNA, 736 bp, Oryza sativa
gagctcattctcaggactcccctggaggctggctcggaagccgccgacaagaaccggcagcatgagcgcgtacagcgcggcacccgcctcgctcctcgactccaagagcagcatctgcgtctccgctggcacgccggcggcgtcctcgcccaccgtcgggatcatccaccagatcttgaacctgaacagggacagccacttccacccactgcacaccaaaacccaacaacgaatcagtaccaccgctgccggccgcggcgcacaccgcaatctctgctctgggggcgggggctctacctggcgagggtgccgagggagaacacgtggcggctggacggggcgggcgccgtggcgccaaggaacgcggcgccccccggggaggcgacgaccgcggggcggcggagggccacgctgggaggggcccgctccaggagctcccgcccgccgaccaccagcgacccgcgctccagccgcgccatctcctcgctccgcgggcacgcgacggcggcggaactgaggctgggacgcggccacggccggcattgcgccgggacgaggccgcgggggcgcgaattattcccgcgcgagggagtaggaggaggggcccgaagcggcgacctccagggcgccgtccccgtcatcgccatgtcagcttcgagctgggatagactaagatatccggtagtacttccgctgccatgatcgggacccccgcgtgtggatgggggcgctcgcc

SEQ ID NO: 75568 - DNA, 9842 bp, Oryza sativa
ggatggcttatgtcttaatgtgatccgagtggcttttccaagcagagatgttgacctgcagaacatctcagaaggaacacacctatatgagttcgactgctagtcacattctatgaggtttgggcgatctctagatactcatgaaaggcctagagtttgacttatatgctccaaacagaggggatgcgaacggcagcccagtaccagtcaaggttctgagtaaaacctgatcacacaaacttacaattcaaggcatagtccattgttcagttgtggtctgatgtagctcatttcctaggtggaagttcaacttaacagtctccaccaaaaccctggtatctcaaacaggcacaacattgagaacatttcttatgagccttgaaatttggtggggattgttagaataattgggctaggcccaacttataatattaaatctcaaaggcccataataagtgttgaggataataataccaccttaggatttaagcgagaaatatctcaacctaaatagggagttattggaggctccctgttgaccagttgaggtgggggccggaatgccacacgcgcgcgcgcgcgcgccgggccgggccgtgggcgtgggcgtggcgggcgtgcgtgcgtcacgtcacgtcactatccttttgcagccactaacccacgttcccacgattccctccgcaacagcgcgtccacgttctttctcctcctgatagataaggaggccgcgagtccgatccggtttaatcgcttctttcccggtgttagtttctccttctccacgcctgagttgctctcgcttcctcgcttctgatctcttgcgcgcacgagagattggaaggagcagtgcctccgaaaccacaccttcgcctgagttctgcaccgggtaggcgggtgatcaggtttttgtggagtgcctcccgcacgactgctcatcgccatgtctggagttgccgccgccgctgctggcggaggtggtgcgccgccgacaggagctggatccggagctggtgcgccaggaggtgcgtgaacgacaacaacaacagaggcaattctgcctcaccatccagcggagggctattctcggggtataatcttctcctcctgttactgttgttagcgctatcgctatactatgtgcgctatgttcttgttcctgttcttcatgatgcctctagcatgttattgcgttactgttatgttcctgttcctgacattcatgatgcgcatagtatgctactggttatgttaagatcaccctacactgcttatgccatgattattgctttaattttttggattaaaacatgccgattaatgactatatttccaacacaaaagagcgtcaaataagcaattatctctttttaataaatccataggtgaaaaactatgcaaacaaggaaacaaattaagttcacttgcacgccttgatctgcaacaagttgaaaaacactagattccttgtaaaaatatctgaaagacaagttgataggcaacagtattagatagctctcaaatgtaaacatatcttttcatggatacaatattgcctgctttgttgcttaattacattgtccatagtattatccttccatggtaacataatcatcctttatttaattcatacatcactattcatactactctttctgactgttgctagagtgatcaagagtgactgacaaaatattctgccattctataacatggttccctctcaggcttgctgcttcctgttgttgcttccccatatcactaaaattgtaattccaaagcagacaccaaatcccaacccagtgaagagaaaaagtagaacatctatgggatccttcttggaagcatgtggcatgatgtttggttcagatcggtcgctacattgtttagacaatgggggtccgcagagcccaatatttccctcaaaagaggcattggaaaatgtcgagaagtgtgacgattgtggtattcttccagccaacatattataggacaaattcaatgttgcaaggaagttcaacgatgctagctcttgtggaatctcaccagaaagcttatttgaggagaggtccaacgactcaaggttgttcaaattgtcaaactgagttggaattggccctgtaagcatgttatgagacatgttgagtccatgaagcaacgcaagttccccaatgcttgaagggatgctaccatcgaattcattatttgagacatcaatgagcacaagtgatctcaagatcttggaaattgttatgtcattgcctttgtatgtgagtgcagcagtaaactggtatgtctggccatgggaatactgatgttccatgactaaagtctcgttatctgacctggtcatcatggacttgagcatcttaaacaactcttctggcaatgtgccactgaagttgtttgaggctatgtcagcaatccgcaacatggaaaattgacagttgtttccatctctggtatacaaaggatccattattttcccatggaacttgttagacttgaggaccaggacttgaagttcaggaagtttactcatccaacatgggaagtggtcactaatttgattgttgccgatgtcaaggatctccagattcctacaggcaaccaaagatcttggtagctgtccttgaatcatattgccactgaagtctaatgcacttaatgcacaaccttccttgatattatcaggtaactcgccagtaagatggttttgttttagacttaatacctgcaatgcacttgcattttgcgtcagacatgatggcattgagcctgtcaagttgttattagagagatcaagtagttgtaaactcttaattgcatcacaaatcgatgagggaatgtttccagagaggctattgtcggaggctttgagaacgactgtactcttaaggtaactggagaaattaagaggcatagatgagaaccggttggttgagtaatcaagtgtgatacttcctttttgtggtactggtattgctccatcaaaattgttgaaactgagatcaaagtattcaatgtaaaggggaagtaaaggattggatccaatactcgtaaagttattatgtgataggttcaacaagaaaaagttcatcgtccatgtctcccatgtccactgaggtattgcaccttggatctggttatatgaaaggtcaagactagtaatattagggagatgcctcaagatgttagggaagctagatatgctgcaagatgctagacgtaagaagctaatactggggtaggacactactgaagaactattttctccatcaaccacaactagtttattatttgagagattgaggacagaaagattttgcagttttgagtatgaggctagctccactgtgccaataaagttgtttgaatggagcaggagggtttgcaagcgagtcaaatttgatatcagcgcagatacctctcctgaaaagtggcaattgtacagtgccaattctctcaatttcgttaaggatccgacagaagcaggtattggtccggacaaaccacaatggaagaacttgagaacattcaaaaaagtcagatttgaaatccatgacggcatggatccttgtagctctaacccagacacctctagtatacgtaaagatttcagcttaccaatggaagatggcagcattccagagaaaccactagctccaagtgccaactccttcagatatttgaggttgctgatggaagctggaattgtgccggagaagttggtgttgctcacagatatactttgtaagtaactgtgagcagagaaattaggcagttttccggagatcccaagattattagtgaggctaatactagttaatttctgaagctggaatatgatgggaggaaacaccccttcaagcatgttatttgaaagctgaagaacagtaaggttggagagagtagccaggagctcaggaactggaccagacaaatgattgtagtgcagctctatcactgaaagtgatcgcaaggccgagagtgagtggcaaatgggaccggagagtgagcagtacggcatgctaatgacccgcagctttggggaggacctggccatggcgtcgcaccaccgtgcgccgtttctcgacatgttcaccatgcccagacgaagctcctccaggttggtgaggtttgcgagcaaggtctccaagctcggttccgagagctgtgaaattgtgtctgagtagtaatagatgacgttgttctcatcgtccagctcatcttcaaagaatgttgtggacaggtcaaggtaggccaggctcttgaggcggccgatgccaacgggtacccggccggcgaagttggtgctgcagaggtcaagatgggtgagctcggcgagcttctcaaacccagtggctgggagcttggacgcactgaagtcgttccaagagatgtcaaggtactcgagggaggttaggctgaagagtgcatcatcaagacctggggatcgtagccatcggtatcccaagtcgagggaggtgacggcacggccttgggcgccgccgcatcggatgccctcccagcggcagcagtccgtgccagcgatccatgaccggaatgcggcggagtagtcgccggctgttgcatcgaatgagttcttcaggcggagcagcgcccaagcctggcctggaaggcatggagctggctgtgccgatgccgacgagctcgtaccgtcggcaagcgtgctcctggactgaacctgtatgaggaggatgagtagcatggctaggagaggcatggaactagtgtaagcaaatgtcatagaggccaacatgtcggaggttaggtttgttttcagttatgtgagactgatacacaagaagcgaagggatatctatccgtttataatctgtctcgtctagtagcatttggacacgcattagtcaaactttcgatagtaaaaaaagaatcgaatcgtgaatggtattgatttgtatatttgtgttgaaaatatcttatgaaatactgtaattctatcaggtcagtatatatattgtacatataaattagtggctaaaactgtactcccttcgattccattttaattgacgttttgaacaatgacacggtttacaaggtacatcttaatttgatcttatttttctataataatatatataataaataaatgcatgtttacttttattatagtactttcaaagacaaatctatatatcttgttccagttcctttaaactaaatatttttaaagttattgatggtcaaactaataaaagtttgacctcaaccttgtctaaaacgtcaattaatatggaactagagggagtaccatgcatgtagacaatgccaatgtctaaaatgacttattttcctgggtccccaccaaagatggtttaagtccttgcataatttctgaaaatgctggggatcgggtgcccgatgcggtggaaaaaaaatcaggccaccctcctcctccacgcgcgcctccgcctcgcctcccacgtgtccccaccactcacgccccgttgcaacaaatcccccacatattacggaaacaccctattaagggaatccgttttattttttttccaccaataatgtttcagctagtaccctcatgatattttactatgtatggacgaaatgttgcagtgaattgaaatattcatttgcaacaaatcacccacatattatggaaaccctctattaagggaatctgtttcattttttgttccacacaaaatgttttatctagtgtactcataatgttttcttatgtagatcaaatgttgcagtgaactgaaacattctttcgctatttgttgaaacattgtttttatatagactgaaacaacgctcgattttttagaaaccgttgtttcatatgttgtaccaaaatgtttcatgagctgattttgttgtgtttcagctttttaaaagactaaaacattttcgatctttttagtgaaacatgttcgatctacttaggcgcctcaattttcttttttttttgtcgatcttttttttcgctggtttataggagccgagcgagacagcctgggtggatggcaatcaggatgggggcagtgggaggatgggtatagaattgctgtgcattgcaatgggtaaaaatgttttttctgtgatacaataactattaagagctgagcaataaattgcatgtctctctttggcctggcccataagtggagccacaggctcagctcacacacacgtcgtcttcaacctacgaaagaccgatccaccctattaaatccagccaaatccttctcgatattctaaaattggttgaggctttttatctgctcgatccccttttgctatttttttctcgaaattggaataaatccataaaactcggaataaaaacgatcagggaaggtcaccggttggccatcatcgatgactgagatttaatctggcaaattaaagttcaattgaaaggaaaatcgcaaggaaaataataagagaagtatggaatcgatttttgcaattaattgaaagagaacgtttggtgagacaaattgacgatagtgctaggttcgtaaaaaaaactgtgatgaaaaaaaacacacggaccaaaaaaatggagggacagaaaaaatatggtataaaaaaaaccaatgaaaaaacggcgatgagaaaaaccggacgaagcctgattgggaaatctgcaacaaaaacaacaaagcaccgagacaaaaaaaaacagaagctttatgtatatattaattaggtatatatagatatagattataaaaactagctaaaaccaacttagacgtggatgacgtactaaaatcccgacgaaaacatcttcaaatttttaaataatagacatagagatagagatatatgtcatcatatttcataagtcaacatgcggcatatatctaataattgttattcacagttccgatcgatttgcaaaagttttcataacattttttgatgaaatttcatataagttctgtcatgatcaaactaatctggtgcaaagtgagactttatttcaacaaatgctcatcagttgcaaactgaaaagcttgtgctagctacacacccttttagtgaaacaaggtgaacacgatacatactttggttgtgaaatcgagaattaaaagcgaatgtccttgtgtgtttttgggtgtgggcatggcccaggatgattgccgcacagaaccctgtacttgaccgcccgcagttgacctggtaagtcgtggttgctgcagcagtgcggttgaaatgggacgacatcgtaagaattactagttgcactttcgccgtggtcgtgcaggagcttcttgccatgatcagcttcttctgaaggaaagcttgacgccgctacgggcgtcgtcgccgccgccgctgccgtcgtcgtcgaccccgacgcggcggcggacgcatcgcggggcgggagcgatgcgaggaggaggtgcggtgcagacacgatgatgatgatgaggaggaggagcgacgacgctagcccaaccccgcgcaccgccgccatcgatcaccggccggcgcggcgtcgtacgttcccgaaatcacacgacacaattccggcgttagcttttgttattgctggatgaccgtgtaaggcctcctatttgtagggaagtagcttactccctccgttgaaaaaaagacaaactctgagtttccgtgttcaacgtttgactgtctgtcttatatgaaatttttttatatttagtatttttattgttgttagatgataaaacatgattaatactttgtgcgtgacttgtctttttaatttttttcataattttttttaaataagacggacggttaaaaattggatacggaaatccagagtttgtctttttttttttggacggaggaagtatgttgggaaatgaccacatggaatacaacggaaacatcttactcttggatggatgaatatctgtacggttgatcgattgcgtgaccatgaagtatatgcaactaaaccattatatgcacgcatttattacttcaccgcattttttttaaaaaaaaaacagtacaaaataattgttcacaatgcgtgcacactcatatctacgaatacgcacacacactctgtttctatgagcatttttaaaagactggaccgacatatcttaagattaacatagtcagcgacagtctagagccaacatcgctgaactactttctataatttacttgattcaaattaaaaactaatatgtgagatcaatgagttaaaattgaatagtatatgttttttgatttgtatgtgagaggctttttaccgtccttgagggaagacgataccaaatcctagccgttgatttcacgtcccacctggtacagtgttcccaacgagagcaagtacgatcagtttctgaggtgggaggatttcattgtaatttcgcatcaatgcttgtctcgatccagcgacctgatcgtggaccgcctccttcgagtgcttgtacgctgcggcctatggcctccctcttccctctcctaccgagtaccgaccactgcctcctctgttgttcgggcttgctccaacacaccgcaccagtgtcgtcggctaccatcgcctccgatcatgctctagcgcggacaccatcggtcgctccctacttcggtcacgcggtctcctccgctcctcatcccctgcaccttcactctgtctttctctaaaataaattaatccagcccaattgatctcttcctaggttcatttggatttgattttttttccgatataggtgtatatgttcaattgctcgggaaagtcatgtcatctaaatagtcataaaaaaatatgaaaaaaatgacaacatagattaatataaaaatatatcactccacaagcatgcaagtttaaattcaacttctgcaagttgtaacaaaaataacaaatatagttgtgaatgtgcgataactattttcagtttagtttgttatttttgttgtaacttatagaagttgaatttggtcttgcatgtttgtggactgatatatttcgtattaatctatgttatcaattttttttcaagttttttttagtaattatttagatgacatgcaaacaacgagggtatatcccctagagggatgaaattccacatcccaattgctctgcgttcatagtagttctcaagcggtggcagtgggttagacatggcttgcaaggtgttcctgcgtttgcgtgctcacaagaagacagagagcttgtctatggtgatggagattcccgggctgtagtttcctctcaagtatcaaccaggattgacccagtgggcagttaatcggttgctaaggtgtctgaatccagctacactgagggcagctctacgcgcggtgacgccggcttcacttgcaaagatggcagaagggcagcatcaactagttacagcgacagtacaagacggtgacagctaagacatgtgaattttaatcctacccctttcaaatcaagggttaaatggaggtggtacctggtgatacctccctaagaacggtaaaaattcttatcaattaaatatgaagaggaacatgtatgttctttcgatttgaaaggcattcaccatgggttgggacacggaccaagcatcagcgaaatgggttcttcttccaagttttttgatgaattttgactaaattttgatcaaatttcatcaaaatttcactacctagaacgtagcaagttctacttaaaaaatggtattatgcgtagagggagtggttttattttggagaaataaagaagatagacaaattaagtctatgtaggatgaagggagtacgccatacaatgttaggcgtttatgagtttcgtgcgcttgcgctgctgccgaaggaccatgcgg

SEQ ID NO: 75569 - DNA, 7028 bp, Oryza sativa
  unsure (1)..(7028): unsure at all n locations
agccgtgtggccattactactgatttatggacagcaactcatcaaaagaaaggatacatgttgaggagggtgttggaacttcagatggagttaatgcttcttcaagtgttgcccctccagggggatttgatttggtggatgatatatttgatcagtatatgtctggacaaactgttgcctcttcctcacagattcgcactgagttagatttgtatttagaagagaaaccgttgcctaggacacaagattttgatattatcaattggtggaagtttgggggcattaggtacccaactttgagacagattgcccgggacattttggcaatccctattacaacagtagcatctgaatcagcatttagtactggttggagggtgataactccaaatcgtaatcagcttaaacctaatcttgtggaggcacttatgtgtgtgcaagcatggggtcgtgctgatatgttaggtaatttcatttttgcttttgtatcgttcaagtttaatttgtcctttcatgtttcttccatttcatctaattgcaaatcacattatatgttgatagctgaaattgctaacaagaccaatgcattgaacacggtacttgacgatgaatcagaatcggtatgtcctacactcccactttattgtttttattactataatatacaatgcttagttgcttcctctaattttgatttcaggaagcatctactgtcactgaagcttgaggtggagatttcataagtgaaggatgggctagaaagcctgcaattgcaaactatctacctatatattttattatgttggcaatgtaatagtatattaagacttctatatttctgtgagactgaatttgcttgctgtgtgtgatgtgttgaacaattcaactgttgaactttgaaggcttgattcgcttgaacagttgaactcatgtgtgttagtgtgtaactgtgtgaaatgatggatatcatcaatgtgttcttgctgaatttttatgatgaaattgaagtattcatgctatttttgatggtgtgttaattatgtacaatatttctttttgatgaaatgatgattgtgttgtattttttgagctgattggattgagatgctacccaatgcggggccccggtcgggttgcggggccccgcaggggtcgggggcgggggatgttttcaacccgcatcactggtcggggccgggggcggggggtgaagtcgggggtcagggtcgggggcnttncannccaacccanncccgccccgccccgttgccatccctaactacctttccactattcgcaggaggtgcgcgactacaacaaaacaacccaacggagacatcttatttgtaggatagagacgttttatctcgtctcctacagataactgagacgcttttataaatcgtcgtaggaacgtctccgtttgcaccgtctcaaaattatggaaacgctttttaaagcgcacctatattatttaagacgttgctagagacatgtaaattgcatctctataaaatatagagatgcttttatagaagcattaatataggcacgcacatcaagcattaatatttgcagattgcaaagttcatgcactaaccaagtcattaacgtgaacaatcttaaaggtaaatagatagttttttttatattgcaactctgcaaacatgcgtcctatagcagatactcttcttttttaatctgagactgaatattaaatattcatttttttttctaaataattataatattattataatggtatttaatgatgacgattaggaacagtgtgtttttttcttctttctctatataaataattatatattatctaataacgatgacacggatataataaaaacgtctcaaaactcatttctacacatgagacgttccaaaacgtctcaatattcctctctaaacgatttagttttgtgctaacctgtaaagcgtcttaaactatgtcctcaactaataaagcgtctcaaatatcgtccctattttaatttttcttataaaaaagagacgacttataaaatgacttaagtgaaacgtcttaaaacaatagttttgttgtagcgcgcgtgctctgcttcttcttgtatacggaaccactataggatccagtaatttattcttaatccgttcatcaagtcaatctcctacataggctgctatgttgcaaagcaaaagcatatactagtatattttaaaaagcgatttcatggacagacgatttggcatgcattatataactactctgagtacagccaggccagtgtttgtcacatggctgatggctcagatatacttttatgtcatggacgttgctggtttgagcaagtcggatgattaatttgatcgatccgacggcagtatgcatatgatgatgtgataagccaactaccacagagaattattagtgaagagtttttcactagtgactcagtggtattattggcccagttcctactgtataagcgaggatttattcgaggaaagagggaccctatatcataccattacccaccagttatcatcgccatctctagctctctcacacgttcgaccacagtctcgtcaccaccatctcccttacacgcaccattttcttcatgatcaccaccatctcacatctttatctattataaaaattaaagatatttttgcctatttttcatacgtcatctcagtccgattccctccccgtatgcgcccgattactcctagatcacccgtataaaaaacatgcaaggattacgtattttctttcttaaagcttttcatccgtcatcgatctcttgcgtaatcaaattcgctaattggctttcaatagagccttcgcccgccgcttgtgccatcatgcacagcataaggcagtccaaatcgatcatgtatttcataatgtaacacagcctaatctctgtccccacggaatgccccagtctttcctcagaccaactttgtcacgtattaatccatccacagccagcataagccgccgcctacgataactgatcttcataggtggctggtttaagatgggactggataaaaactcgtggcttgttagctcgctcggctcgtgtctatctcgactcgacttggctcgccgaaccagagttttagctcgttagctataacgagccagctcgagatggctcgcgagccgctcacgaggccatgaaaacatcagaccgagcagccccggatgacacctatccaaaccatgtaagcccaactaggccacggtagtacagtgcacatcctatattcagttaataaaggcgacagttgcggctcggcaccagaaaaaagaagagaaaaaagaaaaaagaaaaggagagaagaaacggtgagactccctcgatcccttctctgatgtcgccattcgccgccctgcgcccctgccgctcgcgctatccgctgtctgccgtcgctccctgctgttccccactgtcggagcaaaggagatccggtggccatcaacctgaggctgccggatctggcgccgttgacctcatggctaaccactggatttggtgttccatccgtgacaaagggacggtggtggccatgaggagaatttgttggccaacgaggagggagacgctggctggcggtgatgtaggcggcaacaccgtggcgcggtaggaggtgatgccagctcgttatcctaagccggctcggtatccaccctagtttaaggtgatgccggctctaatgcatcttcgttgggagcacctttattaagccacctgtggtaattttatatcagaggcgaaacctcaaatgtatcttcgcatggtggcctgctatcaaatcccttgtccacaaattacgtagacgggtgtttgcgccgaaattttggcctgccttaataaaatagctcgcgtagtcgaaactcatgtaacacacactggtggagaaaccatctttcgtcggtcggccgatttccacaatagtcccggatgcaataaaaaccggtgctaaagatgatctttagtcccagttcaaaagggtaacgggcatatttgatctttagtcccggttggtaataccaaccgggactaaatatcatctttagtcccggttcgaatgctgtcagggcatgtcgggccccccgggatctttagtcccggttggtcgtaactttagtcccggttggtattaccaaccggggctaaagatcctggtgatctttagccccggttggtgctaccaatcgggactaaagtcccacccctatatatatgtcttcttcctcctccagctgcccgagcaagcttcaaaatttcttcaaaaaagaggggaggtcatgccaaaatttttattgaatttattttgatgattacatacaaatcggaggtgcctaaaaggtttgcaacttcatcgtccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattataattattgtatgactgtcattattgtaagaataattatttgtgtacggtttttttttactcatgtagatggatcggcaatggatgtacactgaccggcggtccaaagagtttattgacggcatgcactattttttgagagtggccgaagctaacaggcaaaggggttttatttgttgtccatgcaataagtgtaagaatcagaaggagtattctgcatccaggactattcatttccactttattgagtcggggttcatgccaagctataattgttggacatcccacggagagcaaggtgttaaaatggaagaagatgaagtggaagacgacaatattccggactttgctcagtatgttggatttgaagaaaatcaaacgggtgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttcttgcaatggaaggcaaaaaatagggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgatcgattgtatcctatatcgcggtgaggagtatgagaacctagaagcatgccctgtatgcaaagcactacgatacaagattagacgagatgatccaggagaagttgacgggcagctaacaaagaagagaattcctgctaaggtgatgtggtatttccctataataccacggctaaggtgtttgttcaggaacaaggggaatgctagaatgttgcgatggcacgctgaagagcgtcaacaggacgggatgctgagacaccccgccgattgttcgtagtggcgaaacatcgacagaaaatttaaagaatttggaaaggacgcacaaaacatacggtttggtttgagtacggatggcatggatccttttggagagatgagcagcggccatagcatttggcccgttacgatgtgtatctataacctccccccctggctatgcatgaagaggaagtacataataatgccgattattattcaaggccccaagcaacctggtaacgacatcgatatgtacctaagaccactggtcgaagatcttaaacagttgtggaagaaagaaggtgtccccgtgtaggacgaggacaaacaggaggagtttaacctacgagcgctgctgttcgtaaccatcaacgattggcctgcacttagcaacctatccggatagtccaacaaggggtacaaggcttgcactcactgtatggatgaaacataaagtacgtatcttaagcactgtaggaaggttgtatacatgggtcatcgtcgattccttgcagcaaactacctggtacggaagaaaggcaagcacttcgaacataaggccgaccaccgtacaaagcctaaacatcgcagcgggaaaacagtgtttgctatggttaaagatcttaaagtagtgttcggaaaggggcctggaagccagcctatagagagcgaagatggtcacgcggcgatgtggaaaaagaactctatattttgggagttaccatattgggaattcttggacgtacgccacgcaatcgacatgatgcacctcactaagaacctttgcgtaaaccttcttggcttcctaggtgtatacggaaagttgaaagatacactggaagcacgtaatgatctgaagcatatggaacaacgcggcgaccttcacccggaaccaaaggagaaaggaagccattacttgagtccagccagctacactcttagcaaggcagagaagaaagtatgtttgaatgcttggagagtataaaggtaccgtctggatattccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatatattagaagcccttcagaataaagtggtgcaatgtctcgtcagttttgagttgatatttccaccttcatttttcaatatatgacgcatctgctttatcaccttg

SEQ ID NO: 75570 - DNA, 2849 bp, Oryza sativa
cttgggccaactgatgggtttgcttggcatagaactggcaagccttgcatcacctgacccagtcctgggcatcctggagtgtagctggccactaaaatccttgacggaaggctttaccgaccaaagtgcgcgaggccgagtgggccccgcattttccctcgcgggcgtcggtgataagctctacgccttgctcccgagagatacatttcaagaggaccccattggcgccgctccggtagagggtcccttctacaagcatgtaccgtttggagatgtgcgcgagcttttcggcttcggcgcgatccttaggaagagtgtgattgtcgaggtatgcccggatgtcggccatccaggcgacctgacatggggggtcggggttgaccccctcgggccccgaggcctgtggctcaccaggcgtcagggtgggggtcgcggcgttaggcaccctcggggggtccgagtgcgccgacggctgtgtgagattttcttcaaaggcccctgggggagtggggctcgtgctgacgccatgcgcgacaactcatcggcgactgcattgtcgcgcctgggaacgtgtcggagctcgagcccatcgaagtggcggtccatgcgtcgaacttcgtggacgtaggcgtccatctgctggttggtgcattggtactccttagatagctagttcacgaccagctaggagtcgcccagaactaggaggcagtggatgcccattcctgccgcggccctcagtcccgctaggagtccttcgtattccgccatattgttcgtggctcagaaatcgagacgaacgacgtacaaggatagtcttgctagttatccccttgccatcaaaccaaggtgcttatttcgataagctatcacacatttaaatgtaatcaagtgagctctgttgcagcctttacatcggcgcagttttgcttttactttctaacatttgtgcttgagtgttagcatatcatgtagtgctgctagctagtgtgcatagaaagttagaaactatatttcttttattttccacaggtattacagaatctggtttgattttgacaaagccatgtatgtcactaacattgtaacaggtacctcacgactcagttacggtctcaaagaggttctttttgcaggtacattttaatgagattttgtctcaatagggcctctccaatctgttcatcacatgaattggaatcaaccttgtagaatttctttagttcttggctacctttagataccaactggtctgacttcagtctcgtatctctcatacattgcagggaaacttgagagcacgacaattttcagatcttccccaaatgcaatgtttgaaatttggtactaatggtgacttcttcagaaaatagacatttattcgtgagacgtttattgggggaccaaaagatgcattgatcttttttccttagaaaataggcatgagagacgttgggagttcttttaattttttcattgctgcagtttctgtcctggctggctgttactactatggtgaattgaggcatagagcgacactgcagacctaaccactatggtgaattgaggcatagagcgacactgctgacctaaccaaattttgctacttactctaacttttaaaatctatctttctaaagatggtcgtctcgagccatcccattaggccacatggcagtgttaaactttgagataaatctaaaaaaactatacataaaaaagtagcaaaaaataaaagacacaacctagagacttcccaattatctatcctttttagataaatatagaatatttataaaaaaatttatctatcctctttgagataaatctagaatactcatacaagaagaaataccgagaagcaaacaaaatatctttcccctttgcatctatctatctcctgttgattggtttcatgccagctgattgacttgagcgacacgtggcgagatacaagcggcggaaagatcgtcgggtaagaaaccatctataaaacagacaatcttaggatggtgaagaagagccgctccatgtgcatctcgcaagttaggatggtgaattgaaaagaaaaaaacaagaagaagagcggaaagatcgtcgggtaagaaaccatcataaaacagacaatgttaggatggtgaagaagagccgctccatgtgcatctcgcaagttaggatggtgaattgaaaagaaaaaaataagaagaagagcctctccatgtagttgggccacatggcaccacaacccaacagtgtgtgatcggaccagtgcaaacatgtaaaagagggaaaaaagaaaaaataaagagacaaaaaattactttttaaaattcttcacaaattatcccagggcaagtattgtgaccacatatcttatgtttcgagaaactaaaaataatagatagaaaactaaatgacagaaatatctgctccttctttctaatattgaatcaaactctataatcctaataactattttttaaatattgtttttttttgcttacattataaaataaataatatctagatctttcaaattttagaaaaggcaacgattatgataaaacaaaatatctaaatttttatgccaaatctaaacacaaggatactcaaaatcgtaaagaagaattgaaatattagtatgttaattatgtggtttttagaaatcatacacacaggctaatcaactgacactggtggagaaaccatctttcgtcggtcggccgatttccacaatagtcccggatgcaataaaaaccggggctaaagatcatctttagtcccggttcgaatgctgtcagggcctgtcaggcccccccgggatctttagtcccggttggtaacaccaa

SEQ ID NO: 75571 - DNA, 14726 bp, Oryza sativa
tacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatagtatatatatatatatatatatatgcgtatgtatatatgtataaatacatatattacacacatatttataatttaaagcacttaacattttatatacatatatgttaccaaaatatatattaacactaaagtaaatatacgtacatatataaatatatatatatacatgcatgtacagtacaattcatttacgcgctagctatagttacgacttcgacacctgcgttacgtcagaagaggaaggaccgacgttacgaattgtcgatccgtcgtagtggaattcaccatcgggattaaggacttcttcattgatgaaccccatcagttgttcttgaacagccgtgataaaatccttgtgtgggagtttttccctcatgtgaatacgctatcattcgaaaaatatgacatatcaatatatgaaattaataaacaacttaacaaattgatacgcaatgaaattttgaatggtttatgtatacgtacatcgagctctcgtgtggtgtatctttggtttgataggcagtgggcatactcgcatacgtagtagccgcataagttagttcccatgtcctgctttgcgcactacatgagaaacgatgagagatttaatctactctttatattaactgtaactagagattcaattcaatataattttggatcatgcatgtactcactggaaaatgaaacctctgtccaagtttttctttccaagtcccgcggaccaattgacggaaccgatcccaagccctacatgtgtagttgcaagctataattaattaaatattacctgagatcaacataatagcaacagagtcgcgcgactttggaatagatggcattatattacctgtctatcagttggaagaccttgtaaaaaaccttctcctctttattcattgagtcatacacagtgactctgcatgcatccaagtcgaaaaagaacaggacccagtggaatctggaatatgcgtgagatgagataaatatcagaatgtacatgttatatgtatgggaatgaaatttgttcgaacggcaataaaaactcactctgtgttgtacggcaatagtatgaacgtcttgaaatgctgctgcgttaggagatggacgagattgtcctctgtgtctttctcgtacttgtcgagcatttcggtgttgattttccgagggtcgatgaacccagtatcgtaaaccccccgccgtcgggccctttgaatctccattctacaacaatgaaaggaaattattattgcttacatatatgccaggagctaattattgaacgaaacaaatcgaactccaagatacttacaaaatccatgcgcttagaagagagacgtcgagggtgtcccgatggtacagatcgaagacatccttgaaatggatccatagaacatcttctccttgcaagaagtcggggtttctgatcctcgctccgaacatctctctaccattggcgctcatttccatgtaccgttcatggaatttgtacatttctgtcggtagggactgcagctggtcaggcctgacaagcggtttaccgagttcaaacttgtatgccacttccgccttcgggattggtgcgcctccaaccaactgagccatgggtagaccggtgtccaaaataaaatccgttatgctaaagtcttcgcctgtcaccaacggctcgaccacttggtgtggttgttctccaagctgaggaactggtttggacttcttgtaataggctttcctaagtgttcggtcacaatccgatagctttaaggcctccttgtttgcggtggacattcccttgaagaaattcttcacgctcgggtcaataggtatcttcttttcaggactccgaggcttgagttgcctcttcacttctcctgccacataagcgtcaagctccacttgactgcaaccgtacggtggctccttgtttttggtggtgtcaactttggccttcttcgttgcccttgtgctggcaggaggtggagcttggcgagaccttgtcttgggaggtgcaggcggacacggtggaggaggaggcggaggagccagaggagatggtgccggaggagacggcggagccggaggagatgctgcacgagacgccgcttgtcgccccgggaggatgatgtaccacttgcgccatagtattgtcacgcccggaaattcactagtattttccgaacttatttgtgcataaaatcctcgtccaggaatcagccgaggtacacaaactgacaatttaatatacaaatccatcataattagctaaaacgataaatacttacttaagaggcacttagtcctcaccatgaagaaaactgcagcggaaaataaaatctagcgaagctccggctcaactcccacaggcagctcaacctgtgtataagccaaacgtcttctcctcctagatcctttttcttcaactgaggttgattgattattgcaagaatgagcatatgacatactcaacaagccacacagcaaatatgcaagtgcaccaggataccaaaggatggcataatataggctcatttgcaaaagcagcatttagcaaaacatttaagagaagtaaaacagtggagtaattaatcagaaattttaatcaacactgaacaatacacccatgttgcacaggcccaaccatcctgaacaaccatacccggctgtacagatctaactccaaaccaggagctaagcaaattattaccaggtataacatccataattattgtgagaggtgtgggactaatcacgaaaaacattgctcaacccgcccataaccgcgggcacggctattcgaatagttttactctggccagaggtgtaccactgtacctacaagacacagcctcaacatcatgtctaccatgcgtcgcgatactggaaagtacccgaatagaggctgtgacaataccctttgtacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacggttaatatttcacaacagtagctcgcgaaccggtccttaattgtcatgagcacgactctcaaaaccatgtgctcacaacccaccattatcaagttttagttgtcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagttaagttataataacccaaggtatcaaggaataaagtaatcaatgcaaacaggccataacaaaggaatagattcacaccacccagtgacatttgaaaataaatgcacagttgaaataaatagagaatttaaatataggatcaacatgctcaaaggattgtgtttaggatccgtgtgacttgccttgcaataatcggtcttcaattaatcttcttgaatacttccggcgcactcacgaaccttcgcaacgacagaaacgacaagctaacatgcaaaacgaaaaaaaagactaataaaaaccaaataaacaatacataaaaagtaaacaaacatgtagatcatgattttagatgaattatgagacttgaacggcctcattctgacttcaaatgaatttattatgaattttacaagattaaatctaattaaagcccatttaaaaagaattaaataaatttaattctatttatggacaattttaatatgtagatctttattttatacaacttttgcaacttgaaccacattaaactgagttacaaagaattagttatgaatttttaaagattaaaccggattaaagcatttatatggattttaattgaattatgacgcaataatgaattatttttgaaaaggaaaagggaattattgcgtcagcggctagggtttgcggtggaccgggtgcacggcaacggctcacgggaacggacggccgagatcgatcctatccaaaacggacggccgagatcgaacggtccacgaccgggccacggcagacagcgatgatgacgtcagcgatgacgtcagcaccggcggcggctcggcaacgcatgctcgccggtgaatgacggcacgacgacgcaaacggagggcaccaagacgtagagcgcgacgcggcgaactcaccggtgaccaaaacaacggcggagaagaaacggacggcgccggcgacgaggaagaagcggcggcggtcttcgggtcgacggtgacggcagtgctccggcggtcttcggcggcggtgaagcggtggacggggacggcgacgacctcgcgatctcgatggtggcaacggcgaccgacgacggcggctacaacggcggcgcgacgcggctgaaccgacggcaacgacggcggcgactagggctacgcggaggcggcgctagacacgacggctggctaaggcaaaggtggcgacggatagaggagagctcgggggtgcttataaaggggctagcgagcggcgacggaggcccacggtgaccggcggcgagaaggaaaggttagggttcggaggaaagagatgaatccgattcgaggtcgaatccacaagtttccaaaccgaattaggcgagatgattccaaaagagaaaaggaagaggagatcgagatgatcatttcccctctattgatttcaccggatcgggaaaggggcgagcgaattggaaaggagacggcggcacggctcaactagggttcgggcgtcggcggcgcgaggaagacgaacctgacaggtgggacccacctgtcagcggccgagagagaggaggaaggggcgcggcggactgggcggactgggccggggagggagagagaaggttttgggccgcctttcggcccaaagccaaaagaggatttaaaaacatttttctatttaaattattcatgaaatgcaattccattgattaaaaatacttccttggctcaaataaatcccagaaaaatctaggaactatagaatcaagcaaagtatttaatgaaattttatctggccccattttatattgagatttagcaaattaaaattagatcttttcttttaggcttttaagatcatttctaataattccttttaaacaacaatttataatttaaggatttttaaacaagaaaagctcttaacaattataattagattattaatgatcaaataattactgaactgttctttgtatcatttaggaattgagctccgaaaaatccgagaaaatttcagagagttgacttaatcatggagaatttaataaaaattaaatccatccatgctttatatttaggaaattttatttcccatatttaacttcacttgtaaattaaagaacatttaatataaattctaataataatttattaaataatttataaatcctgaaacaaaaatcaggatgtgacaagtataatggcgtggcttgtgtctcgtagatgcgtctcaccgtctcctcccgggtagtccaactcgatgtcctcgtacacggcttccaccagctcaactttgaccctcgagtatcctgctggaatcggcctgcagtggtaagtccctgaaatgtccgttgggatggccattcctgacgccaccttcacgtgatgagaggttatctattagtaatcaacctaagcagcaacttgcggaacgtacgaatcaaaaatcatatattacatcgagcataccttgattaataagttcttaaagggaatatgcagctcacatggtgtccgatgcgtgatctcatcaacggggcaggtggtttcgtcctgggtttgcatggcgtccatgctatgtgatactacctgccccgttgaggcgcagctgctacgattgcctgatgggctgaccattggaggatgtatgtacggctggggatcatgtgaacgatgtgctgccatgcgttcatccaccttccgggccaccttctcttgcatgctgagctcgtagctcgataccctgtactcaagatctgcaatcttcgcctcggtatctctcttgctcctcatccgactcctgtacgtgtggatgtcctccttgaatccaatcttccagggaatcacgcctttccctcgtgttcgtcctggatgctcgggagtttgtagggcgagtgacagctcgtccttctctctgtcgggtcggaacgtgccctgagaagaggcttccactgcgtccgttagtcgattcgcagcctcgcgtatctgatcgctgaagaccaaggagccatcaactgggttgagcgttccaccgtgagcatagtaccagaacttcgatcgatcaggccatttagcggtggccggttcgatacccctctcaagcaagcttgcctccatctcctcccacttcggcatcgcgacgctatagccgccttaccccaagtggtgatggtacttcttcttggcagcattttctttgtttctttccatcatcgcctacccttgttgacctgtcttgtaagcaacgaactcgtccaagtgatcccttagcttcgggaatacgtcaaagttcggtgtctgccccttcaagatgtatttccggtacagatctcccttgaaggtctggaactgttctgccattttcttaagagtccactgtttcactatgttctctgtacccgcagggagcgtgaacgtctcgagcattgtggttcacagcatctctttctctgatttcgggacaaagctgtcattacccccgcgtgcccttgttctgcgctagtacaccttgctgacaggcacgttatccctcacaacccaaccgctgtggcgtacaaaattcttggctgcttgtgccggggcactaggtcggctgtctgcgtccacctcagttatgatgtgccgaccctctatcttcttcgcggcacctcgttgtccgcgtgccctcttctgtccagcggagggatgacttccactatcctcctcctcattcccctccgcatctctctccacgtttccctccttgttcccctctgcatccctctcctcgttcaagtactggtttggatcctcgttcccctcttcttcgttccagtactggctgcttcccgatgcgattgtatcgtacagtatctgttcctcatcgcgatcagccatctgttcatagaagaaatatttgctaagcgtaatattaacactctactaatcttgtattaaaactcaaataatcatttatgctaagtctaagtatcgtgtatttgtacggtagataatcatatatgctaagtctaattaagtttgaaatattacatctctaataatcttatattaaatctctaacaatcaaatatgtttcgaatattacatctctaataatcttatattaaatctctaacactcacatatgctaagtctaattaagtttcgtatattaaacctctaataatcttatattaaatctctaactatctctaacactcaaatatgctaagtctaagtgtcgtgtatttgtacggtagataatcatatatgctaagtctaattaagtttcgaatattacatctctaataatcttatattaaatctctaacaatcaaatatgtttcgaatattatatctctaataatcttatattaaatatctaacactgacatatgctaagtctaattaagtttcgtatattaaacctctaagaatcttatattaaatctctaactatctctaacactcaaatatgctaagtctaataatctaataatctttaacactcacatatgctaactctaataatctaataatcttatattagaaatctaacaatcttatattatatctctaacaatcacatctttacatcacttgcctgcgtgaattccttcgagggctagctaccacttcggcttgagggacgacaacgacgacgtcttctctgcaacatgcaaaaaaaatgtattagtctaaatgcaaaggaacatataatgtatttcatgttttcaagtatatataatcatatatatatggtaagttcaacaatagtttaattatctcgttcgtacacatttcgctcgcgttcgttctcacacttttagttcaagtgcattcacgttcgttaacgtttcaatcacgttcgttcacgtttcattcacgttcgttcgtgttcgttcactaacactcacgttcattcatgtttcagtcacgttcgttcgcgttcgttcgcgttcgttcgcgttcgttaagcgttcgttcgcgttcgttcacgttcgttcgcgttcgttcgcgtttggtcacgttcgttaagcgttcgttcgcggcggcggcgtctcgcggcggtgggggcgcggtgcggcgccgtgggccggcccggcggcgtgggggcgtggcggcgtctcgcggcggcggcgtctcgcggcggcgtgggggcccgacggcgtgggggcgcggcggcgggccacggcggcggcatgggggcccggtggcgtgggggcgcggcggcggcgtgccgcggcggcggcgtaacgttgcggcccggcggcgtacgtcggtgtcggcgtcgtcggcgttcgtcggcgaaagagagagagactgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcactaagaagaaaactgcagcggaaaataaaatctagcgaagctccggctccactcccacaggcagctcaactgggatataagacaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcattttagcaaaacatttaagagaagtaaaacagtggagtaattgatcagaaattttaatcaacactgaacagcatacccatgctgcacaggcccaaccatcctgaacaaccatacccggctgtacagatctaactccaaaccaggagctaagcaaattattaccagttatagcatccataattattgtgagaggtgtgagactaatcacgaaaaacattgctcaacccgcccataaccacgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcaccccctcaaaaaccagaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaattgtgtgctaaggtttctaagcatggctaagcaatcatatctaatatctagttgaaccaatatatataaaactcaactagtccaattataataacccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggaattgtgtttaggatctgtgtgacttgccttgcaataatcgatcttcaattaatcatcttgaatacttccggcgcactcgcgaaccttcacaacgacggaaacgacaagctaacacgcaaaacaaggaaaagactaataaaaaccaaataaacaatacataaaaagtaaacaaacatgtagatcataattttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacctttaaactgattttaattgaaatatgacgcaataatgaattatttttgaaaaggaaaagaaagattattgcgtcagcggctagggtttcggtggaccgggcgcacgggcggcggttcacgcgaacggacggccgagatcgatccaatccaaaacggacggccgagatcgatcggtccacgaccggctcatgacggacgaccccgatgacgtcggcgatgacgtcacctaccagcggcggcggctcggcggagcggacggctcgggcggcgcacgctcgccggcgaacgacggcgcggcggtgcaaacggagagcaccaagacgtagatcacggcgcgacgaactcaccgatgaccaaaacgacggcggaggagcaaaggacggcgccggcgacgaggaggaagcggcgaagctcttcgggtcgacgacggcgacggcgctccggcggtcttcggcggcggcgaagcggtggacggggacggcgacgacctcgcgaacccgatggtagcgacggcgaccgacgacggcggctgcaacggcggcgcgacgcggctgaaccgacggcaacgacggcggcggctagggctacgcggaggcggcgctagacgcgacggcgggctaaggcaaaggtggtggcggatagaggagagctcgggggtccttttaaaggggctagcgagcggcgacggaggcccacggcgaccggcggcgagaaggaaaggtcggggattcggaggagagaagtcgatccgattcgagatcgaatccacgagtttccaaaccgaattaggcgacgcttccaaaagagaaaaggaagaggagatctcggagatcatttcccctctattgatttggccggagaaggaaagacgcggccgaatttggaaggagacggcggcggcttgcgctagggtttcgggcggcggcggcggcgcgaggaagacggatccgacaagcggggcccacctgtcagcggctgagagagagaggagagcggcggctcggcggactgggccgacttgggccgagggaaagagaagagagggttttgggccggctttcggcccaaagccaaaagaagacttttaaaaccttttcaatttaaattatttcttaaatgcaattccatttattaaaaatacttccttagctcaaataaatcccagaaaaatctaggaattatagaattaagcaaagtatttaatgaaattttatctggcccaattttatattgagatttaacaaattaaaattagatcttctcttctaggcttttaaaatcatttctaataattccttttaaacaacaatttataatttaaggatttttaaacaagaaaagctcttaacaaatctaattagatcattaatgatcaaataattactgaactgttctttgtatcatttaagaattgagctctgaaaaatccgagaaaatttcagagagttgacttaatcatggagaatttaacaaaaattaaatccatccatgctttacatttaggaaattttatttcccacatttaacttcacttgtaaattaaagaacacttaatataaattctattattaatttattaaataatttataaatcctgaaacaaaaatcaggatgtgacaaatctaccccccttacaaagaatctcgtcccgagattcggaacggctagaaagaaaaacggaataggtaaactgcagtctatcttattattccataactccgataattattctaaggctttaaagaaaactactgcttctttgaaactggtggctgagctgcaacacttgaagacacaactcttgaagatgcaactggcactgcattggctcctgtgacgacaatgttgttgacttgaccttgcggctgctaatgcttcggcttcggacactcttttgcaaagtggcctggcttgtaacagttgaaacatacctgctgctcccttctactactgttattctcctgagtctggtcctgctgaactggcaccggctgattagcttgctcgatgttaacttcattgctttcattagtctctgatttgatctcaccaccgatattcaactgttgcgattgtccttggccagcggaaaaaggttcaccaatttggagtggcttgatacgctgcctctggctactgccttgtgcctcttggaatacagtcattttccttttacggttatccatcctgttcttcttgtcttcaagtcgaattgctttgtcaaccaactgctgaaaatcagcatagtcatgagagatcaacgtaactgacagttcatcctttaagccttccaagaacttctcctgcctttcctcgtcagtacgcacatcttctggagcataacgtgccagacgattgaactcgtgaagatactctgccacagtttgatccttttgcttcaatgccctgaactcacgcttcttcaaagaaacaactcctgtaggtatgtgtgtcttcttgaatgcttccgtgaagtccgcccaagtgattggttgtccttctgctctgttcatccggaaatgatcccaccattctgatgcaggtccttgcaactgatgtgaagcgaacacgactttctcctgatccgtacactggagcagttccaacttcttctcaacagcgtgtagccaatcacctgcttctactgggttggtagtgctagaaaaggtaggtggcctcacacgaagaaaatcagttaacttgttctgcggcggtggagcattgttgttcccttggttgagctggttctgcatctgctgtatcatcatgttcattaactgagtctgttgagccagaacttgagcaagagttgggttcccttcattgttattgtttccacttccactggcgcgagtgttcaccatctgttgcttattagagaggatagaaggagaggggttacactaaagacaagaccttaaccaggttaacactgatctgatgtgtgtagaccattatattgttcaagttgattaagcaagcaacctagtatagttacacactcatcattaatcacaccaatgacgggaatgcaaccatacctacacacaagcaagcaacaagcgttctaccctactaactattctccaaggacactttggcggcataggttctaaggtaggatccaaacttcattccatcttgacatctgggcacttcagatcgaccatcaccttcttattcatcgatccacttgacttaacctccacaagtagaccacattggcgtcttcaagtttcaacaactagtttcagaactactccagttgaaagcaggaggggagaggatgaaaaaatgatttatagagaattctagagaaggaagaaaggaaaattttcacaaatcatgttttcggaaaattagtccttaaggtttgaccatttggcttatcctacagtcaagatggctctgataccaacttgtcacgcccggaaattcactagttatttccgaacatatttgtgcataaaatcctcgtccaggaatcagccgaggtacacaaactgacaatttaatatacagattcatcaaattaactaaaacgataaatacttacttaagaggcacttagtcctcactaagaagaaaactgcagcggaaaataaaatctagcgaagctccggctccactcccacaggcagctcaactgggatataagacaaacgtcttctccttctggatcctttttcttcaactgaggttgattgattattgcaaggtgagcatatgacatactcagcaagccacacagcaaatatgcaagtgcacaaggataccaaaggatggcataatataggctcatttgcaaaagcagcattttagcaaaacatttaagagaagtaaaacagtggagtaattgatcagaaattttaatcaacactgaacagcatacccatgctgcacaggcccaaccatcctgaacaaccatacccggctgtacagatctaactccaaaccaggagctaagcaaattattaccagttatagcatccataattattgtgagaggtgtgagactaatcacgaaaaacattgctcaacccgcccataaccgcgggcacggct

SEQ ID NO: 75572 - DNA, 10052 bp, Oryza sativa
tgaacgaaacgttaacgaaattgaacgaaaggtgaatgaaacgttaacgaacgtgaacgaaacgtgaatgaaacgtgaacgaatgtgaatgaaacgcaaacggtcgccttatacgacactacgtgaaatactatatatgttactttgcgtttagactaatacattatcttgtatgttgcagaaaagacgtcgtcgtcgttgtccctcaagccggagaggtagctagccctcgaaggaatttgtcacgcccggaatttctatccaaaattccaaacgcttacatgtgtgtaaaccctcgtccaggaatcagccgaggcacacaataacaaattgataatagagtaccattattactctaattaataagcgaataaaatgtcattacagaggtagatagttcctctcaatcaataaagatctaagcagcggaaaataagataaatggcgcagacggctccactccacaggcagcttgaccagggctacacctaatcctccacaccatcagcatcattgtagaactcttcctctgatgaatgattgcaaggtgagtatatgacatactcagcaagtcacgcagcaaatatgcaagtgcacaaggataccaaaggatggcataatagggttccatttgcaaaagcagcatttaataaacatttcagaatttaataaaacaattaagtaataattaaacaatattaatccaacgctatacaacataccctgttgtataggcccaacctttctgaacaaccatacccagctgtacagatctatctccaaaccaggaatataccattccaaaccaggagctaaacaaattattaccagttatagcatcatttactaaggtgagaggtgtgagactaatcgcgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccccttgcataacacaatccaccgcaacgcaccattcctggatcataatcacccccttataaacaaggcattgactccccagcgacgcctgtgggcttatctccgccacttctcagtctggtgccccgcaataaaccatgctatacaaaaggtaaagccgttgcccacgctggcttgtggttggcacggttaatgtttcacaaccgaaactcgtgaaccggtccttgattgtcatgagcactactctcaaaaccatgtgctcacaacccaccattatcaggttttaattggcacattaattaattaaccaatcacgattgaccatcgtgagctatcgttaagccatcattaaataatagtgagtcataagttatcccaatagtgtgctaatgtttctaagcatggctaagcaatcatatctaatatctagctgaaccaatatataaagcccaactagtcaagttaaaataacccaaggtatcaaggaataaagtaatcaagaacaaaagggctataacaaacaataggttaattccacccaatgacattcgaaaataaatgcaatagttgaatgaaaacaatagctttaaacgggatcaacatgctcaaagggttgtttgggatctgtgtgacttgccttgctggccttggaattcttcaaattcttttcctgcaaaaacagactctccggaaacgtcggaatctaaacaggaaagagcaaaatcaccagaacagcacataaacaagcatgaacagtacatgtggatatttttaacatgtagatctcaattttagaaaaatttagagacttgaaccaactaaatccaagctaagatgaattagttatgaattttcaaagattaaatcgaattaaaacagttatattgattttaattgaattatgacgcaataatgaattatttttgaaaaggaaaaagggatttattgtgtcagcggctagggttttcggtggaccgggcgcacggcggcggttcacggaaacgaacggccgagatcgatcttatccaaaacggacggccgagatcgatcggtccacgaccggtctacgacagacggcaacgatgacgtcagcggctacgtcagcgatgacgtcagcaccggcggcggctcgggcacgcatgctcgccggcgaacgacggcgcggcggcgcgaacggagggcacccacgggtagcggacggcacggcgaactcaccggtgaccaaagaagcggcggaagagcaacggacgacgtcggcgacgaggaagaagcggcggcggagatcgggtcgacggcggcgacgatgctccggcggttgatagcgacggcgaagaggcggacgaggacggcgacgcgacggcgaccacgatggagacctccccgagcgacgacgacgactggagcgacggcgaagcacggctggagcagcggcgacgacggcggctcgaggtcacacggcgctagggcgcttccgacgacgagagatgaaggcgagggtggcggcgggtagaggagacaccggggatccttttaaaggggctaggaggcggcggcggaggcccacggcgaccggcgacgcgaaggaaacctcggggttcggaggaaagagaccgatccgattcgacctcgaatccacgaacttccaaagcgatttagacgatgattccaaaagagaaaaggtagaggagatcccgaagattgtttcccctcaaacgatttcaccggatcgggaaagacgcggccgaattggaaagcggcggcggcggacgcgacgctagggtttcgggcggcggccgacgcgaggaagacgacgactctgacaggcgggacccacctgtcagcgacggtcgcacgagcgcgcgcggctgcggactgggccgacttgggccggggagagagagaaggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaatgaaattttaactggccccattttatgttggaatttattaattaaaattagatcttctcttctaggcttttaaaataaattctaataattccatttaaacaacaatttatatatttaggatttttagggtgtgacagaattcgcgcaggcaagtgatgtaaatatatgattgttagatttttaatataattaggactattaaatttaatatacgacacttagacatagcatatatgattatctagggttctaatgtgtagcatatatgattatttgaattctaatatatgacacttagacttagcatatatgattgttagagttttaatataagattattagatttgtaatataggactaataatataagactattagatttaatatacgacacttagacatagcatatatgattatctagggttctaatgtacgacacttagacttagcatatatgattatttcagttctaatatacgacacttagacttagcatatatgactgttagagttttaatataagattattagatttgtaatataggactaataatataagactattagatttaatatacgacacttagacatagcatatatgattatctagggttctaatgtacgacacttagacttagcatatatgattattggagttctaatatacgacacttagacttagcatatgtgattgttagagttttaatataagattattagatttttaatataggactaattatataagactattagatttttaatataagattattagagttttaatacaagattattagagttttaatataagattattagatttgtaattagacttagcatatatgattatctagggttctaatatacgacacttaggcttagcatatatgattgttagagttttaatacaagattggtatagttttaattattatctaggggtctaatatacgacacttagacttagcatatatgattgttagcatatatgattgttaaagcaaatatgacctatagacttagcaaatatttcttgtatgaacagatggctgattgcgatgaggaacagatattgtacgatacaatcgcagagggaagcagccagtactggaacaaagaagaggggaacgaggatccaaaccagtacttgaacgaggaatggaacatggagagggatgcggagaggaaccagaaggggaacgtggagagggatgtggaggggaacgaggaggaggaggctagtggaagtcaaccctccgctgacagaagagggcacgcggacaacaaggtgccgcgaagaagctagagggtcaacacatcataacggaagtggacgaagacggccgacctagtgccccggcagaagcagccaagaactacgtacgacacaacggttgggttgtgcaggataacgtgtctgtcagtacggtgtactggcgcagaataagggcacgcggagatcatgagagctttgtcccagattcggagaaagagatgctgtggaccacaatgctcgagacattcacccttcccgcgggtatagagaacatagtgaaaaggtgaactctaaagaaaatggcagaacagtttcatagcatcaagggagatctgtaccagaaatatatcgtgaaggggcagacaccgaacttcaacacattcccgaagctaagggatcactgggacgagttcgttgcttacaagataggtcaacaagggtaggcgatgatggaaagaaacaaagaaaataccgccaagaagaagtaccatcaccacttggggtcaggcagctatagcatcgcgatgccgaagtgggaggagatggaggcaagcttgcttgagaggggtatcgaaccggccaccgctaaatggccggatcaatcgaagttctggtactatgctcacggtggaacgctcaacccagttgatggctccctggtcttcagcgatcagatacgcgaggctgcaagtcgactaacggacgcagtggaagcctcttctcagggcacgttccgacccgacagagagaaggacgagctgtcactcgccctgcagactcccaagcatccaggacaaacacgagggaaaggggtgattccttggaagattggattcaaggaggacatccacacgtacaggagtcgaatgaggagcaagagagataccgaggcgaagattgcagatcttgagtacagggtatcgagctacgagcttagcatgcaagaggaggtggcaaggaaggtggatgaacgcatggccacacatcggtccctagatccccagccgtacattcctcctgcaatggtcagcccttcaggcaatcgtagcagctgcgcctcaacggggcaggtaggatcacagagcatggacgccatgcaaatacaggacgaaaccacctgccccgttaatgtcatcactcggtggacaccatgtgagctgcatattccctttgagaacttatcaataaaggtaatctcgtagtttatagattttagacttgtccattccgcaagttgctgcttatatatattgattaataataaataacctctcaccatgtgaaggtggcgtcgggcatggccatcccaacggacccttcagggacttaccactgcaggcttattccagcaggatactccaaggtcgaagttgagttggtggaagccgcgtacgaggacctcgagttggactaccttggaggagacggtgagacgcatctacgagacacaagccacgccactatactatggcgcaagcggtacatcatcctccttgggcgacaagcggcgtctcgtgcaccatcttctccggctccgccatctcctccacaggctcctgcaccgtctcctcctcatgctccagcactgtctccacctcaggctcctgcaccgactcctcctcaggctcctacaccaactcctccgcaagctcctcgtccggcaccttccaagtcaagggccccccaagctccactgcctgcccccacaagggcaacgaagaaggcgaaagttgacgcctccaaaaacaaggacccggggtacgattgcacacaagaggagcttgacgcttatgtggcttcagaagtcaggagacaattgaagcctcaaagtccagaaaagaagattcttatagacccgagtgtcaggaacttcttcaggggtatgtcttcacctgccaaggaggccataaagctatcggactatgagcgaacacttaagaaagcatcttctggaaagtccaaactagtccctcagcttggagagcaaccaaaccaggagatcgagccgttggtgaccggtgaagaatttggaatacaagattttattaataacaccgggctaactacggatcagttgctacgagatccaccaatcgaaaaggcggaagtgaaatacttgtacgaactcggtaaaccgcttgtcaagcctgagtagctgcagtccctaccgatacaaatgtacaaattccatcaactgtacatggagatgaacgccaccggtagagagatgatcggagcgaggatcagggacacggacttcttgcaaggagaagatattctctagatcaatttcaagggtatctacgaactataccagctggacgccctcgacgtgtctattatgagttgttggactttgtaagtatcgttcagttagatttctttttacgtttcctttaattaattaggtccttgtatataagtacaccatatataatatatacttccttttatcgttgtagaatggagattcaaagggcccgacggcggggggttttcgatactggattcatcgaccctcggaaagtaaatatgcacacatatatatagtacacacatatataaatgtgcacttaattaagtaaatatggcctatatttacagaagtgcgtatatgtaatatataaatatttatatatatagtatacacatatataaatatgcacttaattaagtaaatatggcctatatttacagaagtgcatatatgtaatatgtttttacacatatatatgcaatatgcatacatatgtataaatacatataatacacacatatatgcacataagtaaatataggccacatgcatatattaacaaaatttgagtttgcacctaagtaaatatacacacatatattatattatcaaaataagtacaaacaaaagtaaatgcatgtatgcatatataaatatatgcatgtattacaaatccttcgggctttgtaattattgtttatgtcatatactacgactttgtcaaatcagaaaaagaaggaccggcttgatgaataggctttccgtctaatagaattattctgtgggatcaagaatctgctcgttgatgaatcccatcagttgttcttgaatagcccttaggaaatcatcgtgggtgaggttgtccttcatgtaaatcgcctgtcatttgaaaaaaaaatgggacaaaatatatgaaatcaataagctaatggatacataattaatgtatgaataaatttacatacattcaggtcctggacagtcctgatttgctgtgataggcagtgggtataatcacagacttagtatcgtaggctctacggaccttccattataattgagggatgaaatgaataattcaagtcatcaaacaagcataatgaaatatctgacgcctcaagagaggaatattggagacattgctgggcctttagcctgccagtcaactccagcctgagatgtgcccgtcaaaccactcaaaggtggcgactgttggtatttcttaacgacattactagaaatataattcccagcaatgacgcagaaatacttctggtatcttatggttacagagttcatccgcaagcgcacggatataccattgtagcatttcacccgagagtattccaagcgtatcgtatttattttatcttgtgggaagatcatgtagagagaactcaactaataatttatatattacttgtgataatcatattctaagcaggggttaagataatccaagggtagagtgacacacaagcatttctactcatcctcataataaataatctaagctagttggaaagaaaatagaaagagaatatattcctatacttctaatattcatagtatacatatattctagttaactgatatactagctaataccctctatccgatgccctcctggtacttcgagaagccacccctgactgccgagttccttacgacagcccatcataaccatccaaccggggctaaatacggaggaataccctccctaggaaattaacttaggattatatataggcgcggaggaatacccgtactgagctgtcaccatcagcggcccacctctcatccgcaatatataaccccggataatgatatcccataatctagacaccacgctaaactaccagatactactctaatatcatcgtcatgacatagagtaattgcataagcaaacactatacctgcactaaagcatctccgagataagctagcagtatattcagtataacatgaacataatgtaaagtaggtactcatatactcggaaagtatttcaataccagaaatgtatttagaagagtactctaataaatgtacaaagcttacaaaagaggaaaggaaagctactagagccatactcgaactcttccgaaggtttctggactcctgattcctattctaattctattccactagctagatactactaaactaaacttgagagaaataagagagctcttgcttgaggtgtgtgttgaagtgaagagagtgagctccttatatagaggtaggtatgacggttgtggaaggggaattgtccgaagtgccctgccctccaaccgtcattaggatgcaatcctagacgtccacgccaaaacctgcatccaacggcgccaggattagttcaaccgaaccaccaggttctgccgaacctggggctggcccaatccagcccaatttcggctggtggcctcctctattgctccactccatagacttgtgaattttggcccaattcgttgtgtcaattctgagtttttagcccattcatacataagtctggtcctcgacattgtccgattgatttatcgttggtgttgatgtcgattctcctccactttattgtcgttctttgcaaaaagttagtagacctgatactagtggaatattattattctaacatatttatgcattgcaagcatcactagttctctcctgttttagtaatattgacggtcgaaactgatcgatacgaccatcaacagcgaccagatgtgttacatattcaggagacttgacaaaaatggctaaagatctacaacatctcaaatattcctaactcatactcatgtgaatctagttcccagaatgtgcactagattcacactttcatcttaagcatgaatatacatagcaaaatacatctaaagcaaaaaaaactcagattacatctttaaatagatacataggccgaccgaccaaataactatatcagagaacagcggaagcttgactacccaaatcctcaagcacactgactaggggtttaccccattaagttcaaatcctagaagaagcagtcgaaacccacatcactcaacttaaactaagccttttcctgcaaaacataaattagacaaaacatggcaagactcagtattaatgtactggcaagagcactatcaaacctacaaacatgaaagctctaagtcaaaggaaggctatatgtggtttcaattttcagcataaagcaaattttagttcacaaaccatttgcaacgtaatttaagcaaaacatgttagcaatatgtaaagcatattaattatggcatgatatcaacataaatagatagacatcattcccttagaacacaacgggaagtaaggcaatcatatcacatataccaatctcatcatcatctcaaaacaattagttctcaaaagcatttagaaatcacaa

SEQ ID NO: 75573 - DNA, 3477 bp, Oryza sativa
gttgttatatgagaattccgcgtacggcaaattcttatcccaacttccaccaaaatctagaacacaagctctcaacatatcttctaaaatttggtttactctttccgtctgaccatttgtttgagggtgataagcagtactgaaattcaaacgggtacccatctctacttgtaatttctgccaaaacttcgaagtaaactggctacctctatctgacactatcttcttaggaacaccatgcaaacataccactctggccatatataactctgcaagcttatgccctgtataggttgttttgaccggtatgaagtgagcgacttttgtcaacctatcaaccactacccaaatagaatcatgtcctgccgacgttctgggtagaccggttataaaatccattcctatttcttcccacttccactctggaatcttcaacggttgtaacagaccggctggcttctgatgttctgccttgacccgctgacatacatcacatagagccacatattctgctatctcacgtcgcatactggcccaccagaattgttgcttcaagtcttggtacatcttagtgcttccagggtgaatggaatacaaagtttcatgagcttctttcatgatagtatccttcaactccttattatctgggacgcaaattctttctcctaaccacacagttccttgctcatcttctacaaaaccgatggctttacctctcctcatgttctttttaatttcttgtatgtcaggatcattcacttgagcttctctaatgtcacaccctgattttcgtcttaggatttataaattatttaataaattattaatagaatttatattaaatgttcattaatttacaagtgaagttaaatgtgggaaataaaatttcctaaatataaagcatggatggatttaatttttattaaattctccgtggttaattatactctctggaattttctcggatttttcggagctcaattcctaattttaatcatacaaagagcatttcagtaattacccacatattaaattaatcattaaatggtctaattataattttgttaagtacttttagtgtccaagtattttcaggatttttcttgaaattatttgagcattggaagtatttttaacaattgaaagatcatttaagtgattattttaattggaaaaagtttttaaatccttctctaagccgttgggccgaattcggcccaacatcctctctctctcgcgcggccgagccggcccaatcagcccagccgacgccgcccgctcctctctcctgtggagaccgacaggtgggccccacctgtcgggagctccttcaacctccggccggctgccctagccgagcccgagccgcccctcttccgcctccgattccgcctcaatccgatccgtttttatccgggtttttgaggggttttgatcctctcgttctcctctatcttttcccccaataatcggagcgaatcgttgaggattttatccgaatcgagttcgtttcgaatttatccctaaaaaccgagtttagttcttcttggatcgattcctctcgtttggagttcgatctcttcaatccaatgctataaatagcatcccctagtcgtcctcttccgtttgccccaagtcccgagctccctcgtcgctcgtagcgctgccgcgccgttgccctagccgctagccgtcgccggcgatctccagttgcgccgcgccgtcgcctccgccgtcgccgccgtttgccgtcgccgccgttaggtgcgccgtggtgagaggaatctcggccgcccgttccccttcgccgccgaccaccggagctccgccgtcgccgtcaagccgagccgccgctgccgttctcttcgtcgccggttgtcgtcgtgcgtcgtttgacgttgtggtgagtaccgttgggttcgcctcgtcgtcctctacacgtaggtgtcttccaaatccccggccaaggcccctatctccggcgagcttgctaaccctaatcggccggccgtgggtgacgtcatgctgacgtcatcatcctttctttttccctttttcttttaatagattagatcttctaaaaatcatatctaaataaccgtagatccgtttcaggtggttcaagttgctaaatttttctaaaataaagatctacatattaaaattgtccataaattgaattaaatttatttaattctttttaaatgggctttaattagatttgatcttgtaaaattcataattaattcatatgaagtcagaatgaggccgttcaagtcttataattcatctaaaattatgatctacatgtttgtttactttttatgtactgtttattttgtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcgtaaacacaatcctttgagcatgttgatcctatatttaaattctctatttatttcaactgtgcatttattttcgaatgtcaccgggtggtgtgaacctattcctttgttatggccaatttgcattgaatgtcctattccttgataccttgggtaataaattgattagcttgaaccttatgtattggtttggttcagctaaatgttatatatatataattgcttagcaatgcttagaaacattagctcactaatgggatgaatcatatatactacattattatttatggttatattgaatggtagctcacgatggttaatcgtgttatgataattaattggtaattaaaatatgattattggtgggttgtgagcacatggttttgaaggtcgtgctcatggcaattaaggaccggttcgcgagctactgttgtgaaacatttatcgtgccaaccacaagccagcgtgggcaacggctttatcttttgtatagcgtgattcattattgtgcaccagactgagaagtggcgagaagtccatgggggtcgctggggagtccatgccttgtttataagggggtgattatgatccaagtacggtgcactgtggtgagttgtgttatgcgaggggtattgtcacaactcctttccgaggtaccgcggtggtactgaggcacatggtgacatgatgtggggttgtgtcttgtgggtacagtggtacacctctggccagagtaaaactattcgaatagccgtgcccgcggttatgggcgagttgagcaatgtttttcgtgattagtctcacacctctcataataattatagatgttataactggtaataatttgcttagctcctggtttggagttagatctgtacagccgggtatggttgttcaggatggttgggcctgtacagcatgggtgtgctgttaagtgttgattaaaattttggattaattactccactgttttatttctcttaaatgttttgctaaatgctgcttt

SEQ ID NO: 75574 - DNA, 2426 bp, Oryza sativa
gcaggacgagcaaccatgttgcggttgtcattgccacgattaccagtattgttgttgtagaactggcgttggggacggacaactgatgaagatcctacttgagggtacgatggagcttgaggtccagtaacgagtcgcggtctctggttactgccctgttgtgccttgaattgggcagccctgcgcttcttctgctccatccggttatacttgtcttcctgacgaatcgccttgtccaccaactgctggaaatcccggaaatccgtagacatcaaagcataagacaactcatcatttagtccctccaagaacttctcctgacgctcttcatcggtgcgaacatcttccggagcataacgagctaaacggttgaaatcatggaggtactcagtgaccgaacgagatctctggttgagtgctctaaattctctcttctttagagctacgacacccgctggtatgtgcgtcttcttgaaagcggccgtgaactcctgccacgtaataggctctccttcagccctgccttggcgaaaatgatcccaccattcagcagcaggtccatgcaactgatgcgaagcaaaagaaactttctcctgctcagtacactggatcaagtccaacttcttctccaccgcatgcagccaatctcctgcttctactggattggtggtgcttgaaaaggtagggggtctcacacgtaagaaatctgccaacttgttttggggaggtgggggtggattctgattctgattgtttgcctgctgattctgtgcctgctgcactaacagattgatcagttgtgtttgttgggccagaatctgagctagcgtgggatctcctccatcgttagtagctccacttccacttccacttccacttccggtgcgcgtgttcaccatctgacgataagcagaaacaacaggaaagaacgacagagagacacccttagaacgaagttatttaattaatttaaattctatattactcttaactgtgtatgattacatttaagttgcattaacactatctcaccaactatcttacactctgacaagcaaaagaactagactcatgctgttacatcccacccatgatgtaagcaacaactaaaacccacacactcacaagcaaacttaaacaagcaatctaacacaacgaactacggcaacgatctaactaagcgactactcccgccttgcgtcggaacgaagcgatggatcttcttcctctggagtagctggctctctttcttcagggtcttcctcctcttcctcatcacttatgatgtcgatgacaggttcagcacgatcgggcacagcttcacccatcacgcgaatcttcgaagctaactggagacgaggtggcggacaggttctctttcttagtgtgacgcgaagcttgggtgttggcggcggcgtttctcctttaagttcagctaattcgttctgtagacggtacaccttgctctccaacttgcaaatcttgcctcgattccagttttccctgtcatgagctgctttgtctcgctccacacttactgcatccatagcactaagcatatgcaccgcatgcatcagagtggcactctcttcaccatcaggacagatataggttccatagtcttgaccatgaggcttgtgaggatgatactggaaagctgatgaatccaactcttcttcaaaacgttgacgcaactctccaatggccaccaaagctacttcttgacaagcatggctgtacgatcttcctccagcttcaaacttaatggacagaaggtcttcacgatcactagccaacgtcacacgaacacgacacttctcttcgtcggggtcatgggaaatttggcgatactcgggagcaacttcatagcctacctcaaaagccatcaacctcagctccctgacgaatcctaacacctcgatcaaatttctcggtgaatgtggcggcatctaaggaaacatagaagagaggaattaatgcatatttttctaagttagctgcaccaacttgatttaactgatttttgaccaaaaaggaagaaaataaaattaaaatacttatgatttaatttgagcacggtacagtgtcaccacaagaaagatgagtagtactagtgctatcatgattgtatcgataccataatagatgtacagtgcggactaatcaataaaatttggtaaagagaaagaaagaaacattttgggaagaacaactttttgcttttaaaagaaaagaaattgaatttcaataaattttgtgcttaccttgcatgtgctgccaacttaattaatttataagagaatagagaagagcagttactattttttttcaaaatattttgaaggctacttaaggtttaccatttggcttatcctaaggtcaaggtggctctgataccaacttgtcacgcccggaatttctatcca

SEQ ID NO: 75575 - DNA, 14497 bp, Oryza sativa
  unsure (1)..(14497): unsure at all n locations
ctccactctagactcaactcctggagtaatatttaggagttggagctgtaccaaacaggcccgaatactctagtttgtcttgtgccagccaaagcactaccacactctacacattgagtgtggtctagaggtcataacgaggcttttacattaagcattgtctaatcttgcatgagcacaatatgtgttcttccatcctataccatactcgatatatgacctagaaccgttaagtggcgggcccatgccttaaactgaacgccgtggtgacggatacaatcggaacccaccacgtggcacaatatcgttgtattggacagacttagacgcctatgccgtgaggtgcatctaaacacccctcacgggacacacacacatagggaatttatcatcctatgatcatcacaaacacacactcatgggtagttcctctaggcagcccacagtacacccgtggccctacctatactacaacggcctcccgaatgcaaggtcagacaagtgcttaacttaataggccaaggtcatcccatactaacacatgtggatgtacggtaaacataatgggtgatatgatgttcggtccttaatcgactcaggcgaacactccccctatcggtctgcaactactaccatatgcataccacatgccgcccaagtcaaatcacatttttatctcattttatttcacaaataatcagagaatcacctctttccataatgttcaaaaagtgtttgcaaaatgtatagtaagtgaaccatagccatgtttttatttatcactaagcaaggctaagcatttgcactttataaaagcatagcatagtcatatgagcacaattaaagtactctaattaatcctaaggttcaaaacagcaagggatgatttttcaaaagggaagttatgcatatttttaggggacaactacaatctatcgtttggaagtatcgatagttagaaatacgcgtgcaactttacaatcaaaacatttagcctggaaacataggatttaatatgttcaaaggaagggcaacacttgccttgattgatataagacctccctgagaatagatataatccatctccttcaccggtatcgatttcgctgtctaaatgaaataacggtaacgataaataccaaaacatgtaaaaatctaaaatgatctaaaatgcatgagtttactagtgcggttaggtactggtctaagatgaatttaggtgaaagaatttatattttattactttgcatttgagagttattaattttcaaagtttaatactagctctagattaattaacctctaatcgtccttaggtgcattttaggtctaagttttgtgaaatgttggctttctgcagtcaaggggatgctcacaggagttcaacaaagttggtttcacaatttttaaggttagcatgattttattatgaattttacaagataggtcatatgctatagtctttattagttatttcgaattttagatatgttttgagtactgtatgtgtcatattttatttcataaaaactaagttcatggttcttataacctaagagacctgagatcacttcatttagactggtattaaattttatatgaattctagaagtttctataccgtcctttaattttaattcattattcaaattttagtgatgtttttggatatggtttcttctacagatttatatacagaacaaatgtacatgctattatcaaactaacaaattttagtttgtctcatttggagttaaaataaatcactcatgggttttatagtttctggtttacactatactagttattttaccaattaaatagttggtgatgattttatacagaaagtatcaagttttagttaatgtaaatcaaattaatgatttttttagcacactggaatttggttcactccaaattaagttaagatgaattttatatgaattttctaagttggagattgctctaggacgtgactacacagcactccacatgtagctgtcacatcctgattttcgtttcaggatttataaattatttaataaattattaatagaatttatattaaatgttctttaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaattataattgttaagagcttttcttgtttaaaatccttaaattataaattgttgtttaaaaggaattattagaaatgattttaaaagcttaaaagagaagatctaattttaatttgctaaatctcaacataaaattgggccagataaaattttgttaaatactttgcttaattctataattcctagatttttctgggatttatttgagctaaggaagtatttttaataaatggaattgcatttaagaaataattttaattgaaaaaggtttttaaaagtctgttttggctttgggccgaaagtcggcccaaaacctctctctttcttctctctctccccggcccagtcggctcaagtcggcccgcagcccagtccgccgagccgccgctctcctctctctctctcgctgtcgctgacaggtggggcccgcctgtcggacccgtcgtcttcctcgcgtcggccgccgcccgaaaccctagccgagccgcgccgccgtctccttccaaattcggccgcgtctttccatctccggccgaatcgtttgaggggaaatgatcttctcgatctcctcttccttttctcttttggaatcatcgtctttttcggtttggaaatccgtggattcgagttcgattcggatcgacttttctccctccaatccgacctttccttctcgccgccggtcgccgtgggccaccgtcgccgctcgctagcccctttaaaaggacccccgagctctcctctacccgccgccaccttcgccttcgtctctcgtcgtcggaagcgctctagcgccgtgtaacctagcgccgccgtcgtcgccgtcgctccagccgtgcgtcgccgccgttccagtcgccgtcgtcactcgggaaggccatcgtcgggatcgccaagttgccaccgtcctcgtccgccccttcgccgtcgccgaagatcgccggagcaccatcgccgccgttgacccgaaggccgccgccgcttcaacctcgtcgccgtcgccgtccgttgcttctccgccgcttctttggtcaccggtgagttcgccgcgtcgtcctctatccgttggtgccttccgttcgtgccgaagcgccgccgttcgccggcgagcgtgcgctgtccgagccgtccgagccgccgaaccgccgccgccggaggtgacgtcaccgccgacgtcatcgtcgccctctcccgtgagccggtcgtggaccgttcgatctcggccgtccgttttggatagggttgatctcggccgtccgttcccgtgaaccgccgccgtgcacccggtccaccgcaaaccctagccgctgacacaataatccttcttttccttttcaaaaataattcattattgcgtcataattcaattaaaatccatataagtgttttaatccgatttaatctttaaaaattcacatttgaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcctaattcatctaaaattatgacctacatgtttgtttactttttatgtattgtttatttggtttttattagtctttttcctcgttttgcgtgatagcttgtcgtttccgtcgttgcgaaggttcgcgagtgcgtcggaagtgttcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggaccgtttgttcttgattactttattccttgataccttgggttattataattggactagttgagcttatatatattggttcagctagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacgggggtcgctggggagtccatgcctctggtttttgagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcacaataagtattgatgttataactggtaataatttgcttagctcctggtttggagattagatctgtacagccgggtatggttgttcaggatggtcgggcctgtgcagcatgggtgtgctgttcagtgttgattaaaatttctgattaactactctactgttttatttctcttaaatattttgctaaacgctgcttttgcaaatgagtctatattatgccatcctttggtatccttgtgcacttgcatatttgctgtgtggcttgttgagtatgtcatatgctcattcttgcaataatcaatcaacctcagttgaagaaaaagaatccagaaggagaagacgtttggcttataccccagttgagctgcctgtgggagtggagccggagcttcgctagattttattttccgctgcagttttcttcatggtgaggactaagtgcctcttaagtaagtatttatcgttgtagttaatttgatgaatctgtatattaaattgttagtttgtgtacctcggctgattcctggacgaggattttatgcacaaataagttcggaaattactagtgaatttccgggcgtgacaagttggtatcagagccatctcgactataggataagccaaatggtcaaaccttaaggactaattttccgaaaacatgatttgtgaaaatttctcctttcttccttatctagaattctttgcaaattgtttcattgtctactctcctctctcgttcaacttgagtagttctgaaactagttgttgaaactagaagatgttgatgaggtcaacttatggaggtcagtaaagtggatcgaggaagaaccgaagtgccaactggtcaagatggaatgaagtttgcatcctaccttagaacctatgccaccaaagtgactttgaagaatagttagtaggatagaacgtttgttgcttgcttgtgtgtaggtatggttgcattcccgtcattggtgtggttcaatgatgagtgtgtaactatactaggttgcttgcttaatcaacttgaacaatataatggtctacacacatcagatcagtgttaacctggttaaggtcttgtctttagtgtaacccctctccttctatcttctctaatatgcaacagatggtgaacactcgcgccagtggaagtgaaaacaataacaatgaagggaacccaactcttgctcaagttctggctcaacagactcagttaatgaatatgatgatacagcagatgcagaaccagcttaaccaagggaacaacaatgctccactgccgcagaacaagttagctgattttcttcttgtgaggccacctaccttttctagcactaccaacccagtggaagcaggtgattggttgcacactattgagaagaagttggaactgctccagtgcacagatcaggagaaagtcgtgttcgcttcacatcagttgcaaggacctgcatcagaatggtgggatcatttccggatgaacagagcagaaggacaaccaatcacttgggaagagtttactgaaggattcaagaaaacacacatacctgtaggagttgttgctttgaagaagcgtgagtttagggctttgaagcaaaaggatcataccgtggcagagtatcttcatgagttcaatcgtctggcacgttatgctccagaagatgtgcgcactgacgaggaaaggcaggagaagtttttggaaggtttgaaggatgaactgtcagttacgttaatctcccatgactatgtggattttcagcagttggttgacaaagcaattcgacttgaagacaagaagaataggatggataaccgtaaaaggaaaatgactgtattccaggaggcacaaggtagtagccagaggcagcgtatcaagccactccaaattggtgaatcttttcccgctggtccaggacagtcgcaacagttgaacatcggtggtgagatcaaattagagactaatgaaagcaaagaagttaacatcgagcaagctaatcagccggtgctagttcagcaaggtcagtctcaagagaataacagtagtggaagggagcagcaggtatgtttcaactgttacaagccaggccactttgcaagagagtgtccgaagccgaagcatcagcagccgcaaggtcaggttaacaacattgttgtcacaggagccaatgcagtgccagttgcgtcttcaagagttgtgtcttcaagtgttacaactcagccaccagtttcaaagcggcagtagttttctttaaagccttagaataattatcggagttatggaataagatagactgcagtttacctatgcccttttctttctagccgttccgaatctcgggacgagattctttgtaaggggggtagatttgtcacatcgtgattttcgtttcaggatttataaattatttaataaattattaatagaatttatattaaatgttctttaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaatcataattgttaagagcttttcttgtttaaaatccttaaattataaattgttgtttaaaaggaattattagaaatgattttaaaagcctaaaagagaagatctaattttaatttgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagccggcccaaaacctctctttctctctccctccccggcccagtcggcccagtccgccgagccgccgctatcctctctctctctgtcgctgacaggtgggacccacctgtcaggttaatttttctcgcgccgncgncgncgcccgaaaccctagcgctgggccggcgccgccgcttttcaaattcggtcgctccttttcttctccggccgaatcgattgaggggaaacaatctccgcgatccactctatcttttctcttatggaatcgtcgtctttttcgctttggaagttcgtggattcgaggtcgaatcggatcggtctctttcctccgaaccccgatctttccttctcgccgccggtcgccgtgggcctccgtcgccgctcgctagcacctttaaaacgacccccgagctctcctctacccgccgccaccctcgcctttgtctctcgccgtcggaagagccctagcgccatggatctagcgccaccgtcgtcgccgtcgctccagccgtgcgccgccgccgttccggtcatcgccgtcgctcgggaagaccgccatcgtggtcgccaagtcgccgccgtcctcgtccgccccttcgccgccgccgaagactgccggagcaccgtcgccgtcgtcgacccgatctccgccgccgcttcttcctcgtcgccggcgccgtccgttgcccttccgccgttgttttggtcaccagtgagttcgccgcgtcgccctctacccgttggtgtcctccgtttgcgtcgtcgcgccgtcgttcgccggcgagcatgcgttgccgagccgccgccggtgctgacgtcatcgctgacgtagccgctgacgtcatcgttgccgtttcccgtgagccggtcgtggaccgttcgatctcggccatccgttttggataagatcgatctcggccgttcgtttccgtgaaccgccgccgtgcacccggtccaccgcaaaccctagccgctgacgcaataatcctccttttccttttcaaaaataattcattattgcgtcataattcaattaaaatccatataagtgttttaatccgatttaatctttgaaaattcataactaattcattgtaactcagtttaatgtggttcaagttgcaaaaattatataaaataaagatctacatattaaaattgtccataaattgaattaaatttatttaatcctttttaaatgggctttaaatagatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgcgtgatagcttgtcgtttccgtcgttgcgaaggttcgcgagtgcgccggaagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattctttgttatggcctgtttgcattgattactttattccttgataccttgggtgattataattggactagttgagctttatatatattggttcaactagatactagatataattgcttagccatgcttagaaacattagcacacaattgggataactaatgtttcactatcacttatggttatatttaatggtagttcacgatggtcaatcgtgattggttaattaattacttgccaactaaaacttgataatggtgggttgtgagcacatggttttgagagtcatgctcatgacaattaaggaccggttcgcgagctactgttgtgaaacattaaccgtgccaaccacaagccagcgtgggcaacggctttaccttttgtataacatgattcattacggagcaccagactgagaagtggcggagataagcccacgggggtcgctggggagtccatgccttgtttatgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattattgatgttataactggtaataatttgcttagctcctggtttggagattagatctgtacagccgggtatggttgttcaggatggttgggcctgtacagcatgggtatgctgttcagtgttgattaaaatttctgattaattactccactgttttacttctcttaaatgttttgctaaatgctgcttttgcaaatgagccaatattatgccatcctttggtatccttgtgcacttgcatatttactgtgtggcttgctgagtatgtcatatgctcaccttgcaataatcaatcaacctcagttgaagaaaaaggatccagaaggagaagacgtttggcttatacccaagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacatcggctaactatggttaatgtggtatgcttttagtgagagtaattattatatgtgatatcattggaaggatttatggctgtgttatctttcctctattattgtattgcattgcatttcattcgaagttatgtcgtgaacctatggtcgcgaccgtaccggtacagcatcgtgtattgtcgtaacacgatgcagcttcacaccttgttgggtgtgaaggcaggaatattattgcatttgcattgcattgcactttagcattttggggtatggaagttatatactctattgagttcatgagagggcttctttctcctgaggtctttgcagatctggtttatcctccttactcttgaacctatgaacactagatgtttgcctttatatttaatgttatgttcctttgttttcttataaatataatttaatgatttggtaggttaaataacttgataaaataattctcttgctgagatttattctcacacccctacagtgttttcaggtgcttaaagtgacatgctcgcttggggaaaacgggagtagaagcacagctgcattccacactgccaccctaatttttaaagttgtcatgatttttataataaaggaattgtacccttgttaagttgcactagatgaatctgagagttgaaattagtttatttcatccctgaatgttcctttctcctttttttttgtagatggctacttgcaatgctatacttatatttgacgcttccgcaatgcttatgttttagaggagttgctgtcgaaatttctccttctttgttaaatgtatgtctatttagtagcatcccgatgtctttgtagtttctggggtgttacaaagatcatccgcagcattgttatcgccagcatccctgtccacctcgcccgtttgatttccttcaaatccagcgtactgagcccagtcgggaatgttctcgtcctccacttcatcttcttctatttcaaccccttgctcaccgtgggatgtccaacaattatagcttggcatgaaccctgactcaaacaggtgaaaatgaatagtccaggatgcagaatactccttctggttcttacacttattgcatggacaacaaataaaaatgaatagtcctggatgcagaatactccttctagttcttacacttattgcatggacaacaaataaaaccgttacgcttgttagcttcggccactctcaaaaaataatgcacgccctcgataaactctttggaccgccggtcagcatacatccattgccgatccatctacatgaaatgaaaaaaaaatcatacataaataaattttgatacaataatgacagtcaaacagtaatgataaaataatttaaaactctttcgacgagcaattcttattaacaatttttgaagttctaaactaatattaatgttgtacttctcttaattttcaatttagtttgttttctattttttaagattaattttcatcatattttaaactatgagaataaaatttctatatattcttcttccccacataaattttctctctcatcaacttacaacaaagttttgtagaaaaaaaaatgtgtgaaacatagctccaaaagtaatataacaagaaaaaaaatattggaggatgaagttactaaccttttagacatatccgatttgtatataattactaaaaaattttcacaataaattttggcatgacctcctctttctttgagaaatttaagcttgctctcgggctagagaaggaagaaggcatatatacgggggggatctttattcccttggtgttaccaaccaactggggctaaagatcggatctttagcccctgttagtaacaacaaccgggactaaagatcccgggggccctgacaacatctgacatctctacaaccgggactaaagatgatctttagttccagttgatgttaccaacggggactaaaagatcacatatacgcgttgtagccgccgaccaaagttggtttctccacgggcgggagttgcagcttcatcactcttcttcgggtgcttacgtgccgcccgccctcccgttagctagctagggaatactatgtctgcttgcttgatccactgagacatgcttctagttatatattactaacttgaaatgcagtagctataattagttgttgataatactattcgtgaagagtgtctcgatcaaggttaatgaactatagttatatatgctccacggagacatgctgttagttatatgctacaagtgataattaattatactccctccgtttcaaaatcttactatttttgaccctgacacagtctatgagatactactttgaccaccaatatttataaaagtaagatgttttaaacaaaaattaattatatattatgatagtttgcttaatgataattaaaatatttgacttgtcattaagttaaaaatatttatattttaggacggagtgagtaattgttataattagttgttggtgtgcgtgaattggttggcaaaaatatccgatcgagcgcgtcggcaggccaaatgcatgcattctgcagactcttgcagcatgtgaagctccaggacaagagtgaccagctaaggcacagttcgcgtcacgcactttttgcatgattgcatccgggttccggtgatacttgttgcccaacactggagacaagcacaactgataaaacacgcgcggcccatttcatcctgtgttaatagcccacggcccatctcccttcccaccttatcctacctaggaataagttcaccggaggtccctcaacttaccgagttctttgaggttccttaacaacaaaaaccataaatgtgtacatcaaactcacttaaaccgttcaaaggagatccatggcagtatttttgactggttttgctgacgtggcatccaagttagcaaaaaataaaaaataaatacgtggggcccacatgtaagtgaaaaaaaatgtgaggtctctcttttcttttctttttttttcttctcttctcttctcttcaaatccaaatctaggcctgcggtagaggtgttagaggtgacggcggtggcagcggcgcacagccaaaggcaggcggagcggcggcggcagcgagtgagtgcgggtgcggagcaacggcgtcgtcggcagcaaacagtgggcgagcgcgcggtggcgggcgagcggcggctccgggttgccgccatcagagttagtaccgagggagaaggagggcgcgtcaggaacctcgtaacttcaccattgctcctcccagtggtgctcctcatcaccgtcgatgtcgagagagaaggatggtgcatcgagagcctcataacgcttctgctcctcccctccattgccgttgtcggtgaggtgggactcatcaccgtcgccctcaaaatcgattccgagagagaaggatgaagtccatctgctagcaacggcgatggagggatttggtggagaactcagtaggttggcagaggggggaccagcggcgagcgagagcggcagaaggcacaacagcggcgagaaagcatggcagaggggggaccagcggcgggcgagcatggcagcgggaggagtagagtggctggagtaggccgcaaaggggggacggctgcaggcgacatggcaaagggacggagcagcggccgccgcgacacttctcgagcttctcaagctgtagctgccgtcacgcttctcgagctccacctccacgagctccggccctcgatctcctccaccagctgcggtgcctccaccgccctccgcgtctaaccctgctccgcccggcgccgaccccgcaccgggtcgagcacgcggcacacgaatggtggcggcaacacctaatgccgcctccccctcgctttcccgccggccgtttcccgcccctcccgccggccacctgccccactcccaag

SEQ ID NO: 75576 - DNA, 1267 bp, Oryza sativa
ggatataataaaaacgtctcaaaactcatttctacacatgagatgttccaaaaacgtctcaatattcatctctaaacgatttaattttgtgctaacctgtaaagcgtcttaaactatatcctcaactaataaagcgtctcaaacatcgtccctattttaatttcacttataaaaaagagacgacttatagaatgacttaagtgaaacgtcttaaaacaatggttttgttgtagtgaacatcgagacgaacccgatggtactcaccacaacgtctatcgacgaacggtgatggccggcgacgaggaggaaggcggtggcggagctccggtggtcggcggcgaaggaggacgggcggccgagcttcctcacctccgtgcgcacctaacggcgacaacggcaagcggcggagacggcggacgcggcggcgcgacacggccgaaagatggccggcggcggcggcggctaaatgcacgtggcggcggtgctacggtgcacgggagaggacgagagagggggcaaatggaagaggacgacgaggggaagctttataaagcattggattgaagagatcgaactccaaacgagaggaatcgactcgggaaaaatccaaactcggttttagggataaaatcaaaacgaactcgattcggatgaaatcctcaacgattcgctccgattcttgggggaaaaggaagaggagaacgagaggaacaaaacccctcaaaaacccggaggaatcggagtcggattgaggcggatttgagaggagaaaggcggcggcaaagcggcggctcgggcggctcggccggaggtaggggatggatccgacaggtgggccccacctgtcggcctccacgatagaggggagcgggcggcggcggcagctgggccggcttgggccggttcggccgcgggagaggagggagatgttgggccgaattcggcccaacgaccaaggagggggatttttttgaactttttaaaataaaacaatttgtgaaatgttgtttcaattattaaaaatacttcccttactcaaataattcccagaaaattctagaaaatagaggagcaagcatagtatttaataaaattttatctagctcatttttatgttaaaaattttcctagaaaattagggtttagcttgtaggcttttaaaataatttctaagaaatgatttaaaatatgcatttttaatttagtcatttttagggcgtgacatgctgctaggggctcagttctgcctgcctgtcccgggggttcc

SEQ ID NO: 75577 - DNA, 23362 bp, Oryza sativa
gccgagccatgtacccaagttagtgttttaattcttaaaacctgcttatcaactaaaatgtggaatggttggcctaggttggcttgggacgagctgggacccagggtcgggttgccagttcggtctgaatcatcgtaggccttgggttaaggcaggttcgtgtgggttcacggccttgataaataatatggtatagttctagaatcgtgtttacaaaatagctttgagcaactaagtacctttaaatgctgtttactgcaaaccctaaccctttatagtatgactcctttgtactcccttgcatttattctgcacttgtgggtgtgtcttgttgagtacggtggttgtactcagtcttgctcaatttttcccaaccccagaagaggagccccttgaagatgaaggttttggtgtctagctcgtgcctgccgtcaagcgcctgtggtcgtcgccctagtcttccgttgtttctcgtttgtctctgtgtgtgctgggccttcgctgcccatgtaataagttagctatttacgcttccgcttgttaaactctgaattgtatcaacttttggtgtaccttgcctcctgggacaaggattaatgcacgcacgtaaggaacgcccgttgggttatttccggtcgtgacattagatctttattgattgagaggaactatctacctatgtaatgactttttattcgcttattaattagagtaataattgtactctattatcaatttgttattgtgtgcctcggctgattactggacgagggttcacacacatgtaagcgtttggaattttggatagaaatttcgggcgtgacatatatgcatatgaccgacgctaaggagttgtgggatgcactgaatactaaattcggtgctactgatgctagcaatgatctgtatatcatggagtagccccttgaagtgatgagaaaaagaaaactgcgtcttttccgatctacgtgtagtgctagatgctgggtgccatggatcgagtgatcaaatcagaatttatttacgttcagaactcagttgactgcttctatagataaggcggaatgtccttagttcagcattatagcacatagtctccaacgctacgccatatgtcgcttagacttgaccttttctcccgccccctaaaatcttcggctcctcgtttttattcaattatgaaattactcattttgatggagatttatagcatcattcaagtaaatacaaattgagatcgtagaaacatgagcttgcagtttcatgactacaagatggctgacaaccgttttgtagtcgaacaggctcatgagatacaaaccatagctaaggaactcgaactccttaagtgtgtcttacccgacaaatttgtggccgggtgcattattgcgaaactacctccatcatggagaagtttcggtactgcattcaaacacaagagacaggaatactccattgaggggttgatagcatctcttgatgttgaggagaaagctcgggaaaaagacgccgcgtctaaggatgatggtgggcagtccagtgccaatgttgtgcacaaggcctagaacaagagcaaggggaaatataaagctcaacagaccaccaacttcaagaggcagaagaagaacaacaacaatcctaaccaggatgagaggatttgctttgtgtgtgggcaacctggtcatctggctaggaagtatccacagcgcaaggggatgaaggcacctgcagggcagacttctaagtctgctaatgtgaccattggcaacactggagatggaagcgggtatggtaatttacctactgttttttcagttaatcagtctactaattggtgggttgatactggggccaatgtacttgtttgtgctgacatctcattgttttcttcttatcaggtcgcacggggttccaccttcctaatggcgaatgggtcacatgcttctgttcatggtgttggcacggtagatgtgaagtttacttcgggaaagatcgtgcagctgaggaacgtgcagcatgtcccttctatcaacaggaatcttgttagtggctcccgtctaactagagatggatttaagttggtttttgagtctaataaagtagtcgtgtctaaacatggatattttattagtaaaggttatgagtgcggaggcctgttccgcttttccctttctgatttctgcaataagtctgtgaacaatatttgtggaagtgtggatgatgaggctaatgtttggcactcacgtttatgtcatattaattttggctgatgtctcggctttccagcatgtgtttaatttctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatgaggtgttgacgaagggtggaaaacaatatttcatgacgttaattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgacgaacatgacatcatacatgagaggactcctccctattctcccgagtctaatgggattgctgaaaggaagaaccgcacactgactgacttggtgaatgccatgttggacaccgcgggacaacctaaggcatggtggggggaggcattgttgaccacgaatcatgtgttaaacagagttcctaacagaaataagaacaaaacaccatatgagatatggattgggagaaaaccatcactttcttatttgcgcacatggggtgttgttggtcgctctgaagttaaggtgaattgtatgtttcaattgatctcccgaaggtgatgtcaagatgaaccccacacctgctccttggctattgagcgcgccatcgaacgccattgtccatgtttcattgtcggtttgactgtctaacctattattaggcatagtccaatcggctatgacatcggcgagaacctcggacttgatggctgttcgtggtacaaagtggacgtcaaactggcttagctcgactacccatttcgcaatgcggccgataacgtctttgtttctcatgacttcgccaagagggaaggcggagacaactgtgaccctgtgggcttggaagtggtggtgtagctttcttgacgtcatgattactgcgtagagcagtttttggatctgtgcgtaccttgtcttcgcgtcgtggagagctttgctgacgtaatagactggtctctgtacattttctctttcgacaacaatgacagtactcacagagtagggtgtggcggtaatatagaggaataactcttcattaggttggggagcaacaagtacagggggatttgataggtagcacttgagtgcgatgaacgcttcttaggcttcttgtgtccatacaaatttgtcctgctttttagcagtgcgaagaaatgctgtccttgttctcccatcctaacgacgaacctacttagtgccgccatgcatccggttagcttcagtacctccttgagtcttgtgggcgacttcatgttctcgattgccttgatcttctcggggttcgcttctattcctctgccagagacaaggaacccaagcagtttacccgacggtaccccgaacgtgcacttctcaggattgagcatgaggcgatattgtctgaggttgtcgaaggtttcccgtagatcgtcaatcaatgagtcgcatgtcttggttttgacaacaatgtcatcgacgtaggcctcaacattgttacccagttgatcgctaagtgccccttggaccgtacgctggaaaatatttcctgcggttatcagtccaaacggcatttttacgtagcagaatacaccgaacgatgtgatgaatgttgtcttttcctcgtcctcttttgccatgcttatttggtggtagccggagtaagcgtcaaggaagcttaacagctcacaaccagctgttgagtccactagttggtctattcgagggagagggaagtgatccttggggcacgccttgttgaggtcggtgaagtcgacgcacatcctccacttcccgttggccttccgcaccatgactgggttggctagccactctggatggagtacttctctgatgaaaccagctttgagaagtttatcgagctcttctcgtatggcctgtttctgatctggtgcaaatctccgcagcttttgctttactggcttggcaacgggtcgcaccatgagtttgtactcaatcacctccctagggacccctggcatgtcggacagttgccaagcgaatacgtccgcattatcgcggaggaaggtgatgagcgcgagttcctatttctcgttcagtgatgccccgatcttgactgtcttgtcggggttggcactggagagtggaacgattttaattgcgtcgtctggttttggcatcttagtcgttttgatcattttcttgggtggctcggctgtggcgggtgggctgggcgtgtgctcgaccatgtcgaggctctgcttgtcgcattggaccgccagctttgtgtttccttgaatagagattgttcccttcggctcgggcatcttgagtacctgatacgcgtagtgagatgcggccatgaacttcgcgagtgcagttcttccgatgatggcgttgtatgctgtatcaaactcagcaacatcgaatgttatcttctctgctcgaaagttgctcgcttggccgaaagacacaggaagcgtgatctagcccagtggcttggacgaagactaaggagtgattccatggaagggttgatcggtaggcgtcaactcgtttcgtggaatgcccattgcgtccaaggtgctggcaaagagaaggttgatggagctaccgccatcgacgaagactcgcgctaccttgatattccgaatagtgggttcaaccacgatcggatatcgtcctgggataatagcagttttggggtggttctcatctgagaactcgatgttctgttcagaccacttcatcttgggtgcaaccccctgccatgtcgaacaaacctcacgttccacttttttgtattctcgctttgaagagtacgctgtggaacctccgaagatgtgcgagacatgaagatcggaatctggatacgccgagtccgagtcctgagtggttgcctcagtggccttctcaactacacgtactcgcttgcccttctccaaagccagctgctttgccaacgactttttgaagatgaggcactcctccagagaatgtttgtccgacttgtgtatggggcaccatattctcttcgtatcactgccttgtgggtctgggtgtttgggcgggcgcttgtattcagacacgaggacttccgcttgagctttcctcttcccactcttgccgcttttcttcttgcttgattcgggtgtgtccttggctggcttcttctctcctcccgcctttgactcgtcgttcttgcgtctcactgcgtcgtctgcatgggcgcatcgatcgacaacctcaaacaaacttcgagtcgttgtgattcgccttgttgccaactcctgggtagtatagcgatctctgacaccggttttgaaagcacgaatcacagaagcatcggtgatatcggggatcgtatttctgcactcattaaagcgccgaacaacacgtgtaaatcgtcttcgatcgcgtggcgcttgtaagttccctggaagttagcgacgaattgctaccacaaatctgcccatgaagagatcgagtagggtgggaggtgcatcagccacgaacgcgcagaacctttcaacgccgttggcaaatagtttgctaacgcgttgtcgtctgccccagcagcgtatagtaccgtggagtagacctggaggaattcttcagggtcagtactcccatcgtacttctctattgctccgggtcggaatctctcgggccatcggacatcacgtagagaacggttgaaagctctacacccagtgcagggggcggtgggttgtcggcgattgtgtgtcctccgtggatgtctatcggatgacgaagatgaagatgatgacgatgatgacggtggttcactcggctccggtgtgcgattccgagggcgacgtttaggttctcgagaattctgtcgtcatccaccattgttgtcctagcgccgatccccattatcatcaccgtcatgttgacgccctcgaccagcatcgtctggtgtccgctgttcgcgatcgtcgcggtcgcggcagttgtgacgattatcgtggtcttggtcttcgttcgagcgacctcctcgctgtcacgcccagaagtttcccctttttcttgctttaaaaattggttaaataaattgcccgaagaaattatcttaattaacctagagctaactccataattaataaatgcaattaataatcggaaatagcgtggtggaatttttcttgagttccccatgctccaatgcattaacaagatttttagtggaattttcagagccttggaaataattttaaccaattaaaaatcaccaaagtgcaatatttaatcctaggaaaatccttctcctctttttcttatttcttttccttcctttttctctagatgggccatcggcccatctctctccccgcgctcggcacccctttcctgggccggcccgctcctcctttccactccccgaagtcctccctccctccctttctctttcgggcaccgacaggtggggcccacctgtcggtcgtcccctacctccggtcgttggagccggagctccaaccgcccgcgctgccgccttctccgctccacgtcgcgcctccactccgcgcccgcacctcgcgcccacgtcgccgccctctcccccgcatctcccgcgcgcgcgcgcgcccgcaagtggtgggggatttgaaatctcccaacaccctctctctctcctccacctctccacgtcgccggccaaataggggccatccccggccgtttccgcccctccctcgcccataaaaaccctcactcgagctctctctctcatttcccccattcaccgtcctctcccacgccctctaccgccgtcgcgccgcgctcgccgagctccgcccccgccgcccatctcctgccacgtgccgtcgccactagggccgccgctgtgccaagccgccgccgccgctagctccgccgccgtgtgggccatctcggccaccgcctcgcgtcgccggaaccccaccggaaccccatctccctcgcgagccggtgagctatccattcccctccgtctccggccagccactttggtcgtcgtggtcgccttatccatccctaactcctctcctcccctcctctaagtgtcgccgccgctcgtccgcccctcctcttgtcgggtcgtcgtcgccgcctttgtcttccgctccggccgccgtgtcgccggtgagtccttcctccccctcctttcctcaccttcccgcgagcgccggccacgccgctgctccggccatgcgccgccgcctttcggccgtcgcagccgcttcccgcaccgccggtcaccgccgtcggtggccgtgcctcgccgccgcctcgccttggtcggccggtcggccttgaggccaagctgagcctggccggcgcctccctcgcctcccctttgagccaccgcctggtggggcccacctgccaggcgccacctccctccctttggagccgctgacccgtggggcccacgtgccggtgccccccctttcgctgacgtcagccctgggctttattgcgcaataaaataattaaggctttttctttattagtaaaaacacagtttatcttctaaaattcttaagtaattcatccgagctccgtttaagtccattcaagtctcagtaaatcaagaaaaatgcaaagaatccactaaaaatggttttgtttcctgtttcagtagtcttatagcatgttttgcttgtgtgctttgtttgtcgcgtaggtttcggccgtttcgtcgatccgcggtttctcgaagacgttgctgaggtctcatcagttcgagagcaaggcaagtcatgcaatacgtttgatcatattgtacccaatttacaaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactagtacacaaatggggatcacattattacatagactctgactattggtatagctttagattggcgccaccgcaagggtgtcagttaattaaaatattctgaatggcgggctgtgagtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggtgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttaggtggaggatcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcgtaatgagctggtgtagttcaggtggttggttgggcctgttgcaacgtggtgtagcgttggacagtaattggttaatattgattaattactacagctattttactgctttcaactactgctttgaaatgcctgctttatgcaaaagaacccctagcttcctttggttatatcctgcatcatacctccttttccggtatgacttgctgagtacagtgggtagtactcagtcttgctctcttttcccccacaccagagttgaagttcttctcagatggagccgtctcagagaggttggtttcgtcgctgccgtcaaggtttgcttgtggagtggagtcgcccgctgctgaagtcaagcttcccggtttagctcgcttttatctttctcgctgcatttgtaatcttttatatttttgtaagacgtgggtctgtatgtcaacaaatgtcgtttgtgtaccctggctggtcctggacagggatttaatgcacattcagcttagaaattctggttcgagaatttctgggtgtgacactcgctcttcgttctcgcgacgttgtgaagaaacacgatgtcgggaatgattctcattgtctcgcgtgcgtcgtgcttctcggcggccattcagatggtcgcggagatcgccggtgctgcgaggtggatgggtagctcatctaggtgacgtccgctgctccggtggttcgccgttggcagcgccagctatcagtcgctcttgttgtgctctggtagcggcttcctcgaacgcgttactgagattggctaccgattcccatagtcgttctatccatcgtgcgagatcatcgttaagaacggggtcatagggagcttctctcagtactgcattgatggtgccgagatgttgggccggcgtgaccgtctggttctccgcccctgcgttagcgtgtgcagacgtgctagtcccaccgatggcaaacatgtcgcgtggtgtactggaagatgatgagccatagtcttcgagcaagtgtaggactgatggctcgtggggatcaatgtcgattactccaacaaatcgatccgaggtcaacgtcgctccttgttccttgtttgtgcccttacgagaggttcctacctgctggaccttaggaagcgtcgttttcatggcgtggagaaagaccttgtagcttgagaagtcgtgattcttcgtcttgtgaataggacaatagacatcatgagttggagaagtacgctggattccacgctctttgcaagcacgaattttagcttgtacgttgagaaaaacccagcaagcttgcaagttgtgcttcctggacttgtggataggataccaggacttttttacctcagaagttgtccttgtcggctcggagttcttgtcggaaggacaaggttcggccacactaggaaccttctcgggctcgtatgacgtcgatgttccattctctgctacggcgggaggatccttagacgcgggatcgtccggggttatagccacggcgttctcgtttccgataattgatggaccagccgagattggcaccgtggtgtaaaccgggaagatgatttcgccaacttgagtccacaccagcattgttcaagtagggactccatgaatggggccggtgctgacgccgttgtcgacgaagcttgatgtcatagtagtagaaccttgagcaccaaagctccctacgtggcgcgccactgtcgacgatgggtacccatagaccggatatagagggtattggggtacactggtacgatgatcaacgtagtacgacatgaaggaaacaagagacaaagattatactggttcaggcccctaaataggtaatagccctaatccagttgatataggattatatggagatgaccacaaattacaaagggaataatagaactggatgataccagcgagatcgtagtcgagttgattcgactagatcacccggcgacttggctcctgtaggctccggcttcgtaggctgtggtcgttgtgttgtgtcacgcccggaatttctatccaaaattccaaacgcttacatgtgtgtaaaccctcgtccaggaatcagccgaggcacacaataacaaattgataatagagtacagttattactctaattattaagcgtataaaatatcattacagaggtagatagttcctctcaatcaataaagatctaagcagcggaaaaagataaacggcgcggacgactccactccacaggcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaagttttaccagttatagcatcttctattatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacctcttatacaacacaatccattgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggctaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaagccatcattaaataatgagtcataagttatcccaatagtgagctaatgtttctaagcagggctaagcaattatatctaatatctagttgaaccaatacataaagctcaactagtcaagttataataacccaaggtatcaaggaataaggtaatcaagaacaaaagggctataacaaacaataggttaattccacccaatggcatttgaaaataaatgcaatagttgaatagaaacaatagctttaaataggatcaacatgctcaaagggttgtttgggatctgtgtgacttgccttgctggccttggaactcttcaaattcttctccggcgaaaacggattctccggaaacgacggaatctaagcagaaaagaacaaaatcaccaaaacagcacataaacaagcatgaacagtacatgtggatatttttaacatgtagatctcaattttagaaaaaattagagacttgaaccaactaaatcggagctaagatgaattagttatgaatttttaaagattaaatcggattaaaacacttatatcggttaaaattgaattatgacgcaataatgaattatttttgaaaaggaaaagaaggtttattgcgtcagcgggctagggtttgcggtggaccgggcgcacggcggcggttcacgcgaacggacggccgagatcgaaccgatctaagatggacggccgagatcgatcgggtccacggcggctcacagcggacgacctcgatgacgtcggcaatgacgtcaccgacggcggcggcggctcggcggagcagacggcgcgaggacgcaaacggaaggcaccagcacgtagaggacgacgcggcgaactcaccggtgaccacaacggcggcggaaggtcaacagacggcgacggcgacgaggaggaagtggtgaagctcttcgggtcgacgacggcgatgatgctctggcgatcttcggcggcggcgaaggggcggatgaggacggcgacgcgacggcgaccacgatgacgtccttcccgagcgacggcgacgtctggaacggcggcggagcatggctggagcggcggcgacgacggcggcgctagggcacacggtgctagagctcttccggcgacgagaggcgaaggcgagggtggcgacgggtagaggagaccacggggagccttttaaagggactcggaggcggcggcgaaggcccacggcgacggcaacggcgaaggaaagctcggcttggagagagagagcccgatccgattcgaactcgaatccctcgatttccaaaccgatttagccgatgattccaaaggagaaaaggtagaggagatcccgaggatcatttcccctctattgattcggccggagaagaaaaggaacggccgaatttggaaaggaacggcggtggcggctcggcggcggcgtgctagggtttcggcccgaggaagacgacgggcctgacaggtggaccccacctgtcagcggcagcgaggacgcgcgcgcgcgggcggctgcggactaggccggctgggccgaggagagagagaaagcggttttgggccgactttcggcccaaagccaaaagaggactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttcttttcaagacttttaaaattattttctagaaattccatttaaacaacaatttatataatttgaatttttagggtgtgacaaacctaccccccttaaacagaatctcgtcctcgagattcggaagaactggcgaacagatacggatgggctgacttcaattcatcttctcgttcccaagttgactcttcttccgagtgattactccattggactttgcaaaaacggataactcgattcctggtccttctctcatttgtttccaagatacggattggtttctcaacataggtcagatcctctggacttctatctgttcaagatagcttcttcggtaggtacccttaaacacttcttcaattgcgacacatggaaaacatcatggactcctgccaaagattgaggtaactctaactgataagcaacctctcctcttctactgacaatcttataaggtcccacaaaacgcggtgccaattttcctttggtatgaaaacgatgaactcctcgaagaggtgtgacacgaatatacacataatctccctcttcaaaactcaaatctctgcggcgattgtcggcataactcttatgacgagactaagccacacgcaatctttcttgaatgattttcaccttttcttctgcttcccttaggatatccgtcccgaaaacctgacgctctcccgtttgatcccacaaaagcggagtgcgacacttccgaccatacagtgcttcgtaaggagccatctgaagactagcttgataactgttattatacgaaaattctgcataaggtagattcttatcccaacttccaccgaaatctaaagcacaagctctcaacatgtcttccaaaatctgattcaccctttcagtttgtctatcagtttgcggatggtaagcagtactaaagttcagcttagaacccatctcttcctgaagtttcttccaaaaatttgaagtaaactgactgcctcgatcagacactattttcttagggacgccatgcaaacacacaatccttgccatatacaattccgctaaccgacttccagaataggttgtctttaccgggatgaaatgagccactttggtaagtctgtcgactatcacccaaatagagtcatggcctgatgacgttctgggtagaccagtgataaaatccataccgatttcttcccatttccattcaggaattttcaaaggctgcagcaaaccggcgggtttctgatgttctgccttgactcgctgacaaacatcacatactgctacgtattctgcgatttcacgcttcatacttgcccaccaaaacctttccttgagatcctggtacatcttagtactaccagggtgtatggagtataaagtatcatgagcttcttttagaattgcatcttttaaatctttgttgtcggggacacagattctctcacccaaccatacagttccatgctcatcctccaagaaaccgatagcttttcctcttctcatattcttcttgatctcttgaatatcaggatcattaatttgggcttctctaacttgatcaatgtcacgccctaaaaatcgactaaattaaaaatgcagattttaaatcatttttagaaattattttaaaagcctaccagctaaaccctaattttctaggaaaattttcaacataaaaatgagctagataaaattttattaaatactatgcttgctcctctattttagagaatttttctgggaattatttgagcaagggaagtatttttaatatttgaaacaacatttcacaaattgttttattcaaaaaagttcaaaaatccccctccctaagccgttgggccgttttcggcccgactctctctttctctctctccccgcgcgcggcccatgccggcccaagccgccgccgcccgcgcccctctctctcgggacactgacatgtggggcccacatgtcaggcccttcttcaacctccggccgccgccgagaccgagcccgagccgccatcttccacctccgattccgcccaaatccgagcccgattcctccgggtttttgaggggttttgttcctctcgatctcctctttctttatacccccaagaatcaagcgaatcgttgagttttctctccgaatcgaattcgttttgattttatccctaaaaccgagtttgaattcttcccgaatacgattcctctcgtttggagctcgatctcttcaatccaatgccatatatagcttcctctcgttgtcctcttccgtttgccccctctcccgagctctcccgtgcctcctagcgccgccgcgacgtgttccaagttcgccgccgccgccggccgtcttcggcgtcgtcgccgcgccgtctccgccgtcgccgtcgcttgccgtcatcgccaagaggtgcgccgtggtgagaggaagctcggccgcccctcctttttcgccgccgatcaccggagccctctcgtcgccgtcgacccgagccgccgccgccttccttctcgtcgccggccgccatcgtgcatcggttgacgacgtggtgagtaccaacgggttcgcctcgttgtcctctacgcgtaggtgtcctccaatcgtccggtcgaccgctctagcgccggcgagctcgcggacccgagccggccgccgttgctgacgtcatgccgacgtcatctccagggctgacgtcatctcctctagggctgacgtcatcgtttccttttctttttctttttcccgattttctaatagattaaaacttcggaaaatcataactaaataaccgtagatccgttttaggtggttcaagtttctaaattcttctaaaatcaagatctacatgttaaaaatatccacatgtactgtttatgcttgtttttgtactgttttgttgattttgtttatttgctttagtttccgacgttccggaggagagcgtttccgttgaggaaggttccgaagcgtttgtggaagcccaaggcaagtcacacagatcccaaacaaccctttgagcatgttgatcccgtttaaagctattattttatttcaactgtgcattgttttcgaatgtcatcgggtggtgaacctttcccagttaattaatggccgaagatgactttattttcctatgggttataatttgattagcatgaaccttatatattggattggttcagctaaatgctatatttaggtttgcttagccctgcatagaaacgttagctaactaaaaggggttaaatataaattatattacataattattattgttaataatggttatatttaatggtagctcacgatggtcaatcgtgtgatgttaattaattgataactaaaacctggataaggtgggttgtgagcatatggttttgatggttgtgctaatgacaattaaggaccggttcgcgagctactgttgtgaaacatttatcgtgccaaccacaagccagcgtgggcaatggctttatcttttgtgtagcatgattcattatagtgcgccagactgagaagtggcgagatgtccatgggggtcgctggggagtccatgctttgttttaaaagggggtgattatgatccaggaaaggtgcgctgtaatgggttatgttgtacaaggggtattgtcacaactcctttccgagataccgtggtggtattgaggcacatggtgacatgatgtggggttgtgtcttgtgggtacagtggtacacctctgatcagagtttaatctattcgaatagccgtacccgcggttatgggtgagttgagcaatgtttttcatgattagtctcacactacttattaatggtattaatgttggaatggttaattcctggtttggaggtttaatttgttcaactggggttggttgttcaaatgtggttgggcctgtgcaacacgggtgtgttgtatggtgtttatttaatattgattaattatacaactgttttactattctcttaaatatttattaaatgttgtttctgcaaatgagctatgttatgccatcctttgttatcctgtgcacttgcatatttgctgtgtggcttgttgagtatgttatatgctcattcttgcaatattcattcatcagaagaggagtatctcagtgaaggtgatgatctggaggaataggcttattctggttaagttgcctgtggagtggagtcgccttagctgttccgtagtttgttatagttttgttttccgctgcgtagtatgttattttctttgagaggaactatctacctctgtaataattttaatttgcgagtattcaatagttaattatttgtactctattatcaatattgtcattgtgtgcctcggttgattcctggacgagggtttaacacacatgtaagcgtttggaattttggatagaaattccgggcgtgacaatcaattagagtgggcttcgcttctaaggctgcaacgaaacctctactgacaattcccaaatttaatctttcaaattccttgcataattccaatggcaactatcgtccttctgtagcattgcaatagcctttcctgctaagagcatctgctacaacattagcctttcccgggtgataatgaattcccatgtcataatccttaattaattccaaccatctcctttgtctcatgttcagatccggctgagtaaagatatactttaaactcttgtgatcggtatatacctctggacgagtaccgaaaagataatgacgccaaatcttcaacgcatgaactactgcagctaactcaagatcatgagtaggatagttcttctcatgcagacgtaactgacgagatgcataggtaaccaccttcccatcttgcatcagaacacaacctaacccaagtttggatgcatcacaatacacttggaaacccttctttggatcaggcaaaatcaaaataggagctgatatcaagcgattcttcaactcttgaaaactctgctcacattcttccgaccacttgtacttcacatctttctgaagcagtcgtgtcatgggcttagcaatcttggaaaaattctctataaacctccggtaatatcctgcgaggcctaggaaactgcgaatctctgaaactgtctttggttgtttccagttggttacggattccacattactagaatcgacggcaactcctccggctgagatgacgtgaccaaggaacttcacttcaaacaaccaaaattcacacttgctaaacttagcatacagttgatgttctcgtagcttctctaatgcaaggcgaagatgttcttcatgctcttctttggttcgggagtagataagaatgtcatcaataaagaccaccacgaacttgtctaggtactccataaacaccttattcatcaagttcatgaagaaagcaggggcattggtaagtccaaaagacataacagtacattcgaacaatccatacttagtggtaaaagctgtcttaggtatatcttcctctttgattctcaactgatgataccctgatcgaagatctatcttggagaaaatggtggcacctttaagctgatcaaacaaatcatcaattctgggtagtggatacttattcttgatagtcacatcatttagtgcacgatagtccacacacatcctctgggtatgatctttcttttccacaaaaataaccggagctccccatggagatgaactcggtctgatgtatcctttctgaagcaaatcatctacttgcctcttaacttctgccaactcattggctgccattctataaggtctcttatggatcggagttgttccaggtaccaaatctattctgaactctatatcccttttaggcggcataccaggtaaatcgtctgggaacacatcaggatactcccgaactataggaatctcttccaaagttatctggttcagtcttgaccttaaagactcagaagacaatgcatgaacagttacaactcgaccatcattactggtgagagttacttttctgttagcacagtctatcacacctttatgtctggctaaccagtccatccctaggatgacatctaggtctttggattctaacaggataagattggccagaaatggtactcctttaatttctattctgaccgaggggctacgttgcaaagaaagtgcttgattacttggggtactaaccatcaaaggacgtctaagatcctctacttccatcccatgatttcccgcaaaactcatagataagaatgaatgtgtagcaccagaatcgaaaagtactgttgcaggaactgagttaacagggaacgtacccaaaatcacatctagagcatcttgagcttctgcagcagcaacatgattgacacgggcctttgatactggtgcggtagagttgctctgggcagggacaaccttcacgcgtcggggcttcggacacttgtcagcataatgtcctgggtctccacagttgaaacacaccacaagcttgctgccttgctccctcttggcaggttgttgctgtgtcgaggctgcaataaggcgtggagcttgattgcggttgttgttgccagcattgttgttgaagaactgacgctgcggacgaacaacagacgaagaacctccatgtggcatagactggtgtcctaaaataagacgcggcttctgattattcccctgttgtatcttgaattgagcaatccggcgtttcttctgctccatgcgattatacttgtcctcctgacgaatagccttatccactaatttctggaaatcagaataatctccagtcatgagtgggtaagaaagctcatcattaagtccttccaagaacttctcctgacgctcttcatcattgcgcacatcttctggagcataacgagccagacgattgaactcgtgcagatactccgtaacagagcgagatccctgggtgagcgacctgaactccttcttcttgagagacaccactcccgatggtatatgcgtcttccgaaaagcagcggtgaattcaagccaagtgataggttcagcagtagtcctattcagacggaagtgatcccaccattcagaggcagggccatgcaactgatgtgatgcaaatgagaccttctcctgatcagtgcactgaagcaaatccaacttcttctctaaggcatgcaaccaatcactagcttcaacaggattagtggtactagagaaaataggcggcctcacacgaagaaattctgctaacttattctgaggaggtgcatggttatttccctggttctgctggttctgaagttgttgcatcatcatgtgcattagctgagtctgttgagcaagaacttgagcaagggttggattctccccattgttattgttattggggttgttggggttgggaccattcccgttgctgcgagtgttcaccatctggcatggacagggcacaagaagagaaaccgggggaaaactacttaggacagggaattactttaacttttattgatcttaactgagtttcattattacaaactgaagactctcacaccactaaactcaccaacttcctaacactcaaaaaaaacaaacaaacgcatgcacttacatcctaccactgatgtaaatcacatgcaagacccacacacaagcaaacttaaaacaagcaaactaacacaacaatctaagacaacgacttaacaagtcactctagttcttccgagcatcggaggtcgattgaaggctcgttcggctcgtcttcatcatcttgggtagctacccactcaatcttggatgagtgtgcttgggttcttcttcttcttcatcacttacgttgacgaccggaggatctgctggggcaacttctttctccaccacacggacctttggcgccaattgatagcgagggacaaatagagctctcttccttgcggtaagacgaatcctgaccttctgaggtggtgcttctcccttcaacgcggctagttccttctccaaacgatccaccttgtcttctagcttgcaaatcttaccacgattccaatcttcacgatcttgggccgctaacacagtttccgcacgactttcatccatagcccatagcatctcaaccaaatgtgttgtggtagcatcattctcaattccttcagtctcaaggtaactgccacggtcacttccctgtggttgacgaggatggtaacgatactcagtgtcagccaactgatcactgtaacgatcacggagctctcctatggcgatccttgccacttcctgacatgaatggatgtagtttcttcctccagcttcgaacatcaccgatgggatatcttcactattactgttcaaggtgactttgactcggcacttctcttcatgacgatcatgaggaatctgggcataaaaaggggcagtcccaaatccaacgacaaaggacattgtacgcaactcctggacaaaaccctcaacaccaaacaagtactcaggcttgtagcgcggcatctaaagacaagtgaaaggagggagttaagacatctatccaattaatagcacaagtttttggattaattttagaaattcaaagtaaaaggtaaataaataaagtaaaccaagtttgcaagataagttggaaaagtcagaaacaatattacaagttttatacttttgaataacaggttccaaaagaaataaaagaaagttataaaatcaacttgctaaatttattttattgcagcaagattaaatgaaacaacattgtaaaacttttgctggaaaatgagccattagtatagtaatagatgtacagtactaataacactggaataaattttaaatgagaaccattaaaagagattatgaaatgcatgtgccattagtttggtttaattaaaagagaaagggaggagaacagttctacttttccaatatttttagagggcttctatgggtaaccatttggcataacctagggtcaagggggctctgataccaacttgtcatgcccggaatttctatccaaaattccaaacgcttacatgtgtgtaaaccctcgtccaggaatcagccgaggcacacaataacaaattgataatagagtatagttattactctaattattaagcgtataaaatatcattacagaggtagatagttcctctcaatcaataaagatctaagcagcggaaaaagataaacagcgcagacggctccacttcacaggcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaactaggagctaatcaagttttaccagttatagcatcttctattatggtgagaagggtgagactaatcacg

SEQ ID NO: 75578 - DNA, 1485 bp, Oryza sativa
  unsure (1)..(1485): unsure at all n locations
ttaatgctatagacaccataggtttcgataaaaatttaatgagatgtgaaatgtgtagctagtttccgtctacgagttaggagacatatccgcgcggtgtgaaagtggtgcgcgcgcgcatatcgcgtcttccctatgtccaggaaaacgtatatcacagcgtgctatgctcttgtccaggtacgtaatatgtacacgtaccgtgagaatgcctttgatgtgggtgcggctgccgaacatgctccggtgagccggatcgccgtggaggcggaggagcacgtcgaccaagtcgtcttcctcgtcggatgcatgcttgcgcttgtttgagggtggtcagtcgtatgacggcgctcgttatgagcgcgttccgagctgggcgggaaaccggccgctcccaggccgcctacctacttgcccgctagaggagtgtcgcacctcacccggagccaacggtcatcggtagtacggcgacccccagatgatccatccaagtagagagacctgggtgctacgtatgtaggtaccagccttgtatcagtaccatgcnatnctcgctcagcccgtacgcccgtcagcccgacaggtcgtacgtcgccagccacgtatncctagctgtctggtgagcggacgatctcantgatcgctcaagggattgacgtggggaatggcagccggcgggaccgcccacgggccgacgacgaagcgacggcggtcctcgacgctcaccgggcggtcgacggagcctcgcggcacccgcgggcgggccgaggagctccgacatgcacgcgcggcgcgcggcgcgccagtacgcgccgtcgggcgcgaaggagatgctcttctggccgtaggagagccttgtggccgcgtacagcgccgggcgccccgacagcgcgcggtcgttgttccgggaacagcgcccgcgccgcgtcggcggtggagacgacgagcgtcggcacggagccgaggcggagcagcatgagcggcgccgcatgcctggcggcgagcgcggcgagggagcggtgcgggagcgcgccgacctggtggaggttgccgatgagagggaggcccttcgggcgtggcagcgacggtgaggcggcgcgcttcttggacgacggcgcgagaagctgcttgaagaggagaatggtggcgaggaggaggaggcatgacgcaaggaactcaggagcttggagagacgccatggacattgctgtcttggttgttctctagcttgtctctagggcggctgagtttatctatctatatatatgtcatgtcaggaggagatatcttagggcatcaacaatgtatccttaccaagtagtaagtaagtaaggttggaccaaccaaaagcagaaagcaggtaattgttattcaaggtgggtcccacatgtatataaatataaatataaagacgtagtgacgacgacgacgccgtcaccagcagcagccgccgctgcccacggccgtgctggcccgcgtccccct

SEQ ID NO: 75579 - DNA, 1177 bp, Oryza sativa
ggcccacatggcccacctttattaattattgtttttatgtaactgacctatgggtcccacgggtattgttttttctcaaatcgagttgtcacttaagcgccacatcagtgccacgtagcatggagacctagttaaactagccacgtagacaccacgtcagccaaaaccgctatgtgccggtttttgtaagtttggagacgggtagtatccggttttggagtttagggatgaaaatcggactgggcgacgaatagagggacttaaagtgaacttattcctttgccgaacccgcgcgtcgatcgtgcgtgcacacgcgtctcgcaatcctccacaaactccggccgtattctgcacgttgatgttggcctctggcggtccaacaccagcactgacccaagccatccagatacgggtacgggccggttgcgcctgcgtttcctacctgatcgcgacgggaaaaccaatggcgatcggcgaccgggacgaccatccgtttatctgtaccttgaaggcgacccgtgcgcacgacgctcgccgccgcttcctgtactgtctttacccaatcctgcaccggaaacaggagagagagagagagagagagctagtaggaaccggggcaacttcacgacggcttccatatgctccccgttctagttgcttgtaccagtagtactttcatttctcaccaggaaggctacaccctcagtcccaaaaaagaattaaactctagggatggatgaggactgccgtttttgtgaaagtttggggacgcaaacgcaacccattggctcttggcaaatgcaacagtcagtgtcatcatctttctgagggcgacatacgtacccatccgatccggaacgaccgagaccgttccagaatccagagtccgtggcttctgccttatgtgaacttgtggtatctcagtacggatacgtctgagctccgtcttgatgggagcagcattaataaactttcttactgatgatttagtgcttagagcttcttcagtttttgctgaaatcaacctaaccgatatttagcgttaccaaattttggcacattttaatgttgtcaaattttcatagcattagttgcatttagtttgtagccctatcaaaatttggtagtgtttatataagaagaaacttttgaaatgctaaattttggtagaacagca

SEQ ID NO: 75580 - DNA, 5344 bp, Oryza sativa
acactagaaaggtctcgcgcgctacgccgcgcgggtgtaatagacgtgtctaaaagagcctaagacgcatgttattggagcttactgaaagtgttatatttagctggcaatttagcctgtgtgggacaacagaacaagtagctcatttcaagctgtaatgagcttgattggttttatgtttaaatttaggctcttatagacgtactgctatgatttaaggatgtacacctcctgttagattcaggcactcagtaagtaagcatgttctcatgcttagattacatacagtctgttggaggtgcattatatccttacagagtgatgtgccatgctgggatatatagcatggaagaatcaatacatgtagtaactatatcgcaaaacatctccgatcacaacagttgcagctatagcaaataacacaaaggggcattttgtgccatttagtgaaagtagcctgcaggtttcagaaatggcaagcaccattgactgaatatgcacaatcctttgtagggataatttttagaagctcaatattatgaatcggcgatacgaatcatttagtgtttgcctattagacatggtgagctagcaatagctagaacatcagttggttgatccccaggccaatacagaagaacatatccttggtcttatcttcccaccacaaaacaaagagtggccgaagcgtgagcattgctatatttgagacagcctcttgccatggtaggtgggataatattacatgggagccccaaatataaagtgaatgggcagttagtacttgtttaaacaaataaccaaacaagtagaacataactgtttaaaataattacttacatttgagcgactccagtggcagtgtatctcagaatagctcgcacaatactgaagctctgggatgaccaccttcatcaggagatgagctacagatgcatgtcatttggcccatctgaaaacataattatattatatatcatatgcggctaacgaaggttttgtatgttattgcatcctaagcactctagtatgtccaattttcaaaacctaaaatattgtgaattgcatctttgaagtaacataaaagtaattatgtatagcttagcacctaaaagggtataggtttgtcttgccattccaaagatactagaaagaaatgcgcactacgctgcgccgtttgaagatgatgcacatgccaccattatgctacaatgtcatgcactaagcgtataaaatagcacctggccacatacacatgaatataactttattgagaaaacatattgttttatataaaaagtattattataatgcattagcagaacaaagaatatgcgtaagcatatttcagtatctgatacactacctaagcagaagatcataaagattatgcaatgtttgttgtacagtgtttgtaaagccgataaaccattggagtttgccaaggagtaacttacaactgtactaatgattttaatgacaaaataagagaagtaatatcgtatatagagaggcctcccatgtacagtctcttttatgtagcataaatcatgaccaatagagaaaaaatgtctcaattaccaaaacggcacaaaaatacacaccatgatatagtctaaatataggttttgggatacaaatatcaccaaacaaaaatagtagaaatagatgtgtttttcaagagcagcaatgctggctcagcttttgaaaggcgattctctgatcttttggcagtaactgaggtggtattgctcttgcatgagtttctctattcaccattatatacatcagaaaggaatctcctgaaaaaaaagaatagtcaaaactgatttgcaaaagatgatgcaatgttattgcaaaaattaatgaaaattgtgggaataatatacacacaacaataggttactgggatgtgtacttccagcgttagaggctactttatacgaagagagaagaaaagagaaatatggcatctatcaacacatgatggccatggattaagaagtggcacaaacagtaagcataagagaagtattccgtcatgaacttaagatagaatcttataattgcaattgctggtgaccggcaacatggagaatttatatgcatagaacattcctggtgcagctagcatattctagaggcccggccaaacccttggatcaaggcaaagacagtggtgcaaagacaaataagttgcatgtagtcttcatcatttgcacattacattataaaaataagagctatcttctaaaattttttttgttgggcagaatataagtttgtaggacagcattacataactacctgcttatgtcctatttgtcaaacatggagcagcaaagtcatctaaaacaccaccaagcaatgataaaacaatcataggcttcatttcctccatgatcttatcaaccttccttattgaactggaccgacacaacaaaccccataaactaatctaatcgcgcatcaacaatagcatgtacatcatctataatatctgcattgtacgcatcatgtcatttttggcagaaaccttagcaattttaataaaaagtatatcctttcaatgcatatcctgttggcagaatgctttcatataagctttttattgatagccttgtagtgatgcctagtaaggttttttttttttttttttttttttttttgccatcgatgtcattctatcaagctaggtaaggtggcaccaccatatcataccatatataatgtagcagtagaagcaataaacatggaatttctgacaactgaattcatatgaaataatctgaagtaaagaaaaattcccttaatagaagtgaagcataattgtatatgatcattataatataattaagcttttgttaaccgtactgtggtaaagaagatgaattgtgtcctgcaagatgaatctccctgctgaaactgtacctctttcagaatagaggtaggaacaacatgaagcagttagtgtttcctaaaattaaacaatgttgtacatgaacaatatggaaataaataaaaaacgatgcacctgcatattgtttgtgttcttcaaacttgaatccacaaaactgagcatgaacatgaatctgatcttgccacaaaccaaaagaagcaaacattaatttaaggaatatgatatcccttttaatcctagttaatcctagacagcgaacaatctagtcgagagagaatgaactaacctagtgcatactacataatcataagagaattgtattaacttatgacagaatgatttcttgccttactgcatgaaagaatattcttccccatactacatggaagcaataaaaggaatcactgggttgtagttaaaaacaaaaaaaaagaaggaaattgttggggtctagtagtgcatctaatattgttgacaaatttcacaaggagattatcgattgaatattgcatagtacataccatgcttaagagtgaggacaaagctagatgggtccctcggcaggatggcacaacagagtggtaccacacaagacatctctcttatctatgaacaacacctcatcgtaattcatcagtcactcgacagatcctaagggtaagatggtgttaaatctttcaatatgaatgcaggccaactgcagtaaaatgacagtcttaatttatactcccttcgtcccataaaaaccaaacctagggatgaatctggacggattcatccctaggacgtccctaggtttggttccctagggttggtttttatgggacggaggaagtacaaagcaaattcatgagcaaactgcaaactaccatccgaaatctctgacctgacagaatgttatttctaaaagatgaacacaattcctgataatttaaatgtagaagtaagcaagtaaatagcattttaaaccatggtctaatagtcaaatgtagaagtaggcacatcgcgtatgtgattacccaaaataaaccaataagcggtatgcacctatactattggaatagtatcaaccaaccacttaggaaaaggggaaaaaaaaccaggttaaacgatgtcaacaaaataaaatagttaaatgtgaaagcctaacagaagatagtagtattatggattactttcataagcatatgccacactacataatattaaaagagtggattggaagctgtaacctgaagcatggctacattatatttattttgcaacattgaatatgttgtggacataaccagaagcaaactggcataactgtgacttgcaacatggaaaatttatatgcttatatgcatagagtactttcagtgctgctaggacattctagaggcctaaactcttgtgtcaaggcagaggagaaagatgcttgcactcttcatcatttacacattaaattataaaaataacaggcacgctgaaagttatttttttttggcagaatgtaagtttgtaggatagtactaaataactacctgtcggaacgttttgttttatggatatatggcagcagactgagttgtctgaaacaccaccaagcaatgaaaaaataaccataagattcatttcctccatgatcctaccaactttctttgttgaactggacaaacacaacaaaccacataaatccggtgtagtaataattttgttgcaacaaattagacatcagtaaaagctttgcacactgtctatcggcgtgttatgctcccagtattagagctagggggttttgatgtcagtattgggctattggcaggtatttagcaaagttaataaaaagaatatccttccattgcatatcctgtttgcagaatactctcatataaccttatacttatagccttgtagtacctagcatggttttctttttccttcctgacgtcattctatcaaggggtgccatacaatgcagcaacaaaaccaataaccatggaacttctgacagctaaattcatatgaaataatctgaacccaagaaaaactcaccataatctaaatatcgcagccctgcttaagagaggatttgctcagtatgactgtagatgcgcagcataaaagtcgtcctctctgtaatctgcgaccaacacctcatcctagcccatcaatttctccacagaacctaaggcaagatgtgggatcatgtaaaaacaccagcaaacgcaatggaaatgctcaatggcgagtcaaaaccattgccttaccttgtggattttgtgctaaatgtatgcacaaaacaattgtggctgaaaggggtatcaaaatgattcaccaacgaggagaccaatggccgagaccatcgattccgatgacccccgaaccggatctgtagctcaccgaggatagggagaggaagagggaggcggtgggtggcct

SEQ ID NO: 75581 - DNA, 2591 bp, Oryza sativa
ttttttgtaaaatttgctgacgtggcggccctaaccttcaaccaatcccacggcttttaagtaaacacatatgactataatatctgaacataaaatgtctactaattctccatgatacaaagggcaaaaataattatcgtgttttttttgcattgattcaattcaagaagcgtcaagattgacctgatagtccatataacattactaatgccaccatgcaaaaatttaataagcacatctcagaaataaatcaaataagaaagttcataaggtttacctcttgctcagaactcagagcagagatcaatgcagtatgaatgttcactattatcttatcttgtgtttgtttctcagtggaacaattgacagcttcatccattatgttttcctgagctgaggatagtgcattggccctctagacaggaataggtattttgcaagaggaaatttgttccttcaaactgaccaacgatttttcacttgtctgaagatcaagaacaattgagaataatcagataccatggctgtcctggacgaaagaacaatttggtaaaatcctcttcagatatttaaagccgaacaatagctattgcaataggatgtttcatttgtataattttgaaatgggtaatctggcacataataccaaaccgcagttctcaatagtttaatgccatcatatcacttatatcgttatgtatcatacacagtgaagaatatagagaatgcatggcaataatttgtgttggtcctgcatgaactcgtgtataatgaggtgaaactaatctatacagataacacttcagcgaataaagtagcacatctaaaatttcccataagttttttttacaacaaaactgaaagccacttacctacaaaattgttgtgtaccctttgatgaatatctcttgctttgtacttgtatcttggatgacctaccgattataagtgtctggcaactatctcacaggctgagacacatcatatattagagaaaatcataatgaactgcacatatcgctgaaattaagtagaacatgactctagattcgttaatgcgaccaagtgaggtgccatgtcagttttcgaaaatcattgtcatccagtagctgatataaaaatattgaattgcaatatatacagaacaagaaaaacaagaaaccacaactctgttaatagaaaagcttgatacaataagtaaattaatacgcaaacattggattgaggatcacataccttacaacatttagttacagagtggcaatatttgaccatatagacaggatgaaaacccttgcaagttgacagctcgagttatggttgaactgcaatacaacagagttcagattgtgataacttctattctacttggtagatttccatgttctttaccttaatagagggcttaaggaaccctgtacaactctatagttatttgcattccttgatttggcctctaaagactgaaaaagttaggtatatccaaattgaacaattttgtgaaaataaaaacaaataactgaaattaggacaaagcacgaacctacctcctaaatatcaagccaatcatatctgaatctgaatgtacaccatacgatgagggattggaataggtagcctaaaaacgcattagcaaattacttaggtatcccagtttcctcctccctcacattttcccccttgttccttgattcctcctgttgctgcttgctcagcctcccaactcagctccatcttgcaggcttgcagccactgatgtagttgaccagagaagggtgaaggaaggggataaaagaaggcaaagaatgtagcagactcaccagagaaatccagagaagatgaacggagcagccgaggagggagcttgaacagaagaaaaccccactcccgtgtacggagatgaggcactggtcagtggccaatccggtcgccaccgtacggggagacgaacgccgatggatgcggctacacggattgtgccgacggaggagatcatgcatccaacatctgggcacgggatagcagatggcaagccgtcgtgggtgacgacctacgatggaagatcttggaggaggcgaggagcatcgatgccgcctctagacagaaatcaggaggaaggggatcgctcgatggggatgacgggatgcaacgtggggagatgagcgacgaccgattccacgggtaggtaaggacggagccatctagataggagacgaatggtcagattgtgtccacgcgtggggttgaacggctctgattcagtggactcgactggaaataccgaaataatgaggggatttctgcaaaaatcaatgagtgggtcggcggggcctgcagttaatctaacgcttattaaattttttttgcttgttatgacatgtcgatgtcgcagtgggcgctggcttcccaaatcgctaggagggcagctaatccagcacctttaagatatctaatactccctccgtcccaaaataagtgcagttttgcactattcacgttcaacgtttgaccgtccgtcttatttgaaaattgtttatgattagtatttatattgctattagatgataaaacatgaatagtactttatgtgt

SEQ ID NO: 75582 - DNA, 17316 bp, Oryza sativa
actgacagtctcaggttttctcaggaactgaggaactgggctggaagtggaactaacaaaatatggtattgctccatttttgtttttgcatgcagatttttcacagatgtagtgaaatgcatgttatgcataattgctatatgaaattatgaattactggtcaccacgaatctagtggattcttccctgacagaacccaagaaggcaagaaatgatatgaagaatacaacaatgtatgatcattctttactaatgtgagaaagaattaatatatgcagtataatcattctttattaatgtgagaaagaattaatgtccttttttttgttatcttcatctcttcgagcctggaaatactttatgcatgatgtggctgataagaagttatgataggattttgctccattcatcagtctcagtttgctgctgcaaaatttagctcaggaaaatgtgtttgtgcaacatttttctttaccttgttgcacctctagactaaatgatgcgttgccacttatttctatctgttctgaaagctatgtagcaactcgccagcatttcttctttggtcactttaatggtgtgttgaccattttttcctcttttttaatccctgaaaacaacattagatcttccttcttagatttaactaacaataattcgttgatctccttttctttttttttcttttttttcccttctttctttctttatcagccacatcatgtttcatcaggatagctgaatctatcataaatcggaataaatggctaatgccgacataatcattcgtctcctggaagaaaaataaattcaatgtagtttttatcaaaatttaacggcgcaagtagttggttttctcataatgaggctacatttccataagccagcctaaagttgggattagtggtaattccaggagggttgccagtgttatatgggttaaagagcaagtaaaatacgcgttgaattgctagccataagaatgtttatgtaagtttgaattatgaggtgaagagagaactcacagaagtgaggatgagctgctacctctcacaagagacctactagtagattgggagcaaatgaataaaataatattagtgtgatagaggtaatatactatgtatgctgtctcctaattactaatgagagattatgtggataaaattagatatatcaatcacctctacttttattaaccttgctcaccacacaaaaagaatagtacagtacgtagtgattcattattacaacatcttgattgcccaaaaaagtttactgcaacatcttagtactctataattgatgcattgattaaccaataatagatctaccttttgctaccttttctccaacagaactacagaagtgagatatgaactgttgtacgttatgctggtacaaaaacataaggggcaattgcatatttgagaagatacatggatggactaattgggtgttgtgattgatggcatctgtctatgtagttgcttgatgcccttgtgacttgtgactagaatcaattttccaataaaagttgtatttttgttctaaactgtgattaaaaagaacaatatatatggaaggattatgtggtgacatgccaaattcaccaccatcgcaccgtacttctttttctagaggagtttggatattgtccacagttatcgaattatgttgaacaaaaggtactttaatttcatataacaatttgggagtaataataggatgtaacttacaaatcaaactaaagtttgaggggtgaaataatatgtacatgaacgccttataagaacaaaaataaatagataaatagatcagattatctcgaataatactgacggagcgtggggctcctcaccgggagaccgcgcaggtccccctttgccggttcggccgggggccctgggtgaggttctaagctcctggtctgtggaatgttcgcgaaagtggaaacgcacaagacacgggcgatgtatacaggttcgggctgctgagaagcgtaataccctactcctgtgttatggtggatctgtgtatgaagaagctacaaagagctggagagcaagagggatcaaactctagaaaccctcttccttctttttgcctctcgtgggatcttctcctggattctccgggagtctccaacctctgatccccctcctaagtgggctaggtcctccttttatatctcaaggggataccacatgcaccacttctacctatttctcctttcgatggggacccatcctctttttactaaaacttggcccgcccttccttcatcaatgggcggagatttgcaatggttgccgtccgaatgaccttctgatgggatggcccatacctacctctactccgccggaagcaggtgcaacgtgggatcatggctgtctgccgacgacatgaccagggtcagaccggtcacaaatcggtcattcttgtccaccacgcgtcagtttatcaatctgcatgttcgtccttcttcatacaatgtcttgcttgtaatggttgggatgaagcctggcatatatctgaccgggaccaacgtgccatcttcaggagctagcacgctggctccggctagggacgagtgcctggaggctctcatcctgacgggatggggcgaggcgtgtgtcagaccgcctgttgccacctaacccgcgatctgatcggtctgtgaccggtcacagaccggataaacgagcgcgctgcactgcgttacatgcggcgtgacgcgctcgttcaaaccacaataaatgcggttaggtgagccccgctgtgctcacctaacccatacgcgacgcaaaacccacaaggggtcggggcgcgcctcggccctcggggccgaaacgggagcggtccgatccctcggggagacaaagagaggggcggtcacatcaccctcgggcccgaccccccgagggggtcaggccacgtgggtgattgctcctgcccaagcctctagtcatgatactcccggtcccatgtcatcgacaaatactatgaccttcggataatagggatagtgttttaatttcgccatgaaatgtggagccaaccctttgacatttgtactagccaaatgatacatagtagcgctcttagctactccctccgtcccagaaaaaatcaacttctggttatgaatctggacacacactacgtctaggttcgtagccagaagttagttttttatgggacggagggagtagctaggagtacaatactacaaaatgctccaacatgcatcaaacccaaaacttgtcatgttcctacgggtatccaatgctagagtagaaactcaaattctttagttttctcttttcgagaatgaaaaatacatatcattttgtttccgtcccgtatggacccctagaagggaacctactttggattttactttgaatcctttctcgagagcagaaaagaatttaaacaaactttcctttgcaaagggcaacatatatatgtgctagacaggaggcataggacacaagacagatgctcgcttccatgaaacgaaataagcacaaataccggtagtaaccggccatgtttcgagatttgtagttctgcatttctaagtagagagagagatagagaggggagataacatgtaaatgtaaaggtaaaatagggtaaatatccgttggaaatcctaactaaaaggtcacctaaattataaaaagaatcgcacatatagataagttgatgttacacaatattataaaaaatattatctaacctcaactttatttgtgagatataaaaataataaatttcaaacaaattattaccgcaaacaaatttatatataagttgagttttcacccaggtagatatagagtccaaattcaatgggaaccactaagtcacattaacaattttgagcttctcttgatatataggttttaattttttaaaataaaacagacggttaaatgttggacatagaaattcataactgcggttaaaatgagacggagggaatataatagaatatgaccggatatagtatatctctctctggttttcacactttgtctcagcaagaggtaaattgaaatataaatcgcatgaaaacaaaactagattggccgatacattcattaacaaaagacaaaacatattcgatattgttagaaggacaagacaaatagtcgtgagtaaaccggtaatccctcaattttaaggtgctcaccatccaaaggtgcatgccacctttatttatccattctcctttctttttccaaaagtttttgtgtccccgttagaggggcctccagtccttttagcgtgtgatggattgataatgataatgaattatatataaatttatctattgcacaatcgttttcatagtacaaataaaaaggattaaaagagttgaggtgtctatttacttttcatggcttgcatgcaatggaagtgaaacctttatcttttttctgttagcttttatgtatgtgatgtcttgtcatctttgcataattaatccatttagatcgtgtgtcagggacacctgataggaatgtactcgtggctgtagcttggaatctcatgattaatcctttctcttttgtctttggaagccattgttgttgtacgtagcttcaaaggtagtttttcagattggtgtgatgatgccatcatctggtagtatttgtcttcagagaagtgcgtatttagtttggcatgaagtcttggttgagaatcagttattcttttagtatcttgtaagcttcatcttacagctaacctggtattataatagtagcttaattaccaaaattaattgtagtaatgttatcttaattaattgaatgcggcgactgtttgaggagtgcaaaaaggtggtgccgtcgtcaattttgcgttgtgttgtcaacacaggttaattaccaactgttcctttctgtctctctgtcagacaagtaggagtactacatagcagcagtcctcattgttcagtaaaaaggtgttcctgtggacaaattaaattggagttgcttttgcttgtctagtaacctgcttcaaggttactactacattatatggagcagttagtttgatcgctgttaatcaggagggacttttgaactgtgataagcagtatagtgaagtttcagtataagtaagtgacaaaatttgggcttatttggaacacggaaattttacagaattttcatagaaaacagtttgtttcctacaaagttctcgtaaaattgttcggctccaatagagccctaaggtcatgttcttttcagcttattttactagattattaaaatagattatttgtttcacttttaaaaaatatttttcaaaaaaaactttattctattatactgcttgtatcatttctttaattttttatcacttttctacaatcaagtactagataatcatatacatgtcccccggtgcagtgaaccagggtcacacatgcagcggcagcaaggcccagcaatgcagtactagtattgcaatagcagcaaatcgcctggagattgcaaaggtttaggccgagggtgttgcattgtttgtgtacaatggcaatccagtacagtatgggcatactagtattttgcaaggttgaatgcagtaataatgtttagggtaccaaaatttgtactaggatcaggtccagacacagattgatggctggggcaagggtgacagtggacaactgtttttgtaccccgggatcgggatgtcctgtgtactgacagtaaaaaaaaacggactggtcagtgttcgtgcagcttgagctgatgcatactacttgaggagggtacataaatacggttctctacttaggagggtgtgtttagttcacgctaaaataattagaagtttggttgaaattggaacgatatgatgaaaaaggtgaaattttatgtgtaggaaagttttgatgtgatagaaaagttggaagtttgaataaaaagttgggaactaagggtgtgtttagttcacgtcaaaattgaaagtttggttaaaattggaacgatgtgatggaaaagttggaagtttgtgtgtgtagaaaagttttgatatgatagaaaagttaaaagtttgaaaaaaaaattttagaactaaactcggcctaaaccaggcctcaacattattgattgatactaggaggagtgtattcctactctgaaccttttaaaactttgtactagtagtactctctttatactaacgtatagccaactactgacttcaaattatctatagtcaatttaataaccaattgatataataattacctataaacatatactacataattaatgtttagtctcacctgtcatacacacatatcttggagtacgtgttacagctggctataaatctgtagcatactgctcttatttctcctcttttatcactttaaaatacgtttatagctggcttatagtctgctattgaacctgctctaaccatttatggaatagaattcaaaatttgtatattcagatatatagtagtattttctatagcattgattttaatgcatgaaaatctatagtacatttttagccaatcaaatgcttgagaaaaaaatacaaacaattcaaaatttgaccactaaggtaactagtaaaagggaatattttcccactaacttaattttgctaagaaaaacctagaaatacttagagtaagtttaataatatagccaacggctaacttcaaaagttcatacatatcatccataggcaatataataacccatccataaaatagttagttatagatatataaacaacatagtaccgaccggaactagcccgtgacgctccaaattaacctgtaaatcgatatcagtcccaggaaatagtgctggtatcacaggaagacagattatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttactcctggaagaactcctcgtcagcgggatctgcttcatcttcttcagcaactgggggggaattatttatatagagcaagggtgagtacaggagtactcagcatgccatgggaaataggtgtttattgcaggcttcaaggaaaggctgttgtttttgcaattgatttcatttgaactcttttctgaaatcaactaagtgagtgcttctcaaacgacacggatgagacagtgcgtctcgtccggtcggagtatgtgcaatgtatcagtctttagatttgaatcaaggttggcacccggccaacagcttttcaaacggccacccgggccaacaactttcaaacggccacccgggcctagctgattccatcagctacagatttttcaatcatcgaacccctttccacaacagcaatttcacaagcagtagtcaagcaaaactacgctaggaatcacctcacatccgcccatgaccgtgggcacggctgttcgaacagtttgttaacctctgcagagggggtacactttacccacacgacattactaacccggatcacccaacccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcggaaaaccgtacacccggtacgttccccggtccgcggttttggaaattcatttagttcgcaagcaccgacccaggtgtcgggttttccaagtcttttgtaaaacccaagttttacccaagaagttactcagaattttaagtttgaaggcgtccgtcgatactcgcacagggtgcacgaatatcgggacgcaactagatggttacaaggggacatggtatatcaattagcaaaggaaggatcaaatgcaacaaattaggtaggtccgccgatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggtgaaaataaagccctattaatgacctctaagcgtgccattagatagatctcgagatttgaggaattttggaagttgaacggagtcaaacggacttacggttggaaggatattgaatttctaagattattggatttttggtctaaaggaaaaggatttaattaaatcctttttagaaaagaaaagaaaagaaaagaaaagagggagggacaatagacttttctcgggcggctagggcgcggcccgagagaaatggagcggtccggccgagctaaatgggccggccggcccaaggcggcccaaggcgcgcgcgcgcgggagggaggagagagagagccggtgaaccgggctcaccacgtgtggtcccgggtgggacccgcttgtcggtgacacggttcaccgtgcggagcgagcacgcggcgcacgcgcgcgggcgggggagggacgcggtgcacgcgcacgattcgcggtggatgcggatgcggcgggcccacgcgcagcctcacggctcgcggtggaacgcgcgcacggggaggggctgaccggggtcggctcgacccggccgagctggcgcctacgtggctgccacgcgggctggcgggaggaagacgaaggcgccggccgcgaatggaccgcgggcggcggcggtttctccgggacgccttgcgacgatgaggggcgacggggcgtacaccgggatgacgagggagaataagagcgagcgagccaacggcttggattcgccggagggagtccgtcggcggcggattgcggcggcggcgcccggcggagggaaaagggggaaacggcgacgaggtcacgaggggccaattcccggcggcgagagcatctacgcggctacgggaatccgatgctagcgtcggattgggcggagctacgccgagcgaggccggcgacgagcgggtgctacggagctcgggcagcgacggcggggagcacacggcgagcgacggcaacggtcggggcggcgccggctagctacggggaggctactcatgctaccaccgaaaactaagggggggagatggaccgaggaggaagaacggagggaggcactaccgtgcgggcggggcgcagtgacgagaggccgacggcgcgggagtaatctctccggcctcgggccggggaagaggaagaagacgagcgcccggagtcccctttcgcgtcctcgaacgcaccggctctcccggcgctcggcgatgaacggcggaggcgagacagagcacgggaggcggcggcaatggcgcggacgagaaacggggaggattggggggggaaagaggaagggagggcgcctggggctttaagggcggcaatgtcggtttggaaaccgactttgggcggtcaaggcgcgagctggcgctcggcgctcacggccaaatcggcgacaggacggagggaggataacgccggcgggagaaaaaggggaaaaggagggagagaaaggggtttgcctccttgccgctttgggaaaaggaggaggggagcggggcgtcgcggcagagggaggaggggctctgcctccgtcccttggcggcttgcgcgcggagtggcggggccgaggcgatgacgacggcgatgacggcgggacggtttggagcggagcggcgacacgggcgacaggtgcgggctggcgcggcagagggtgatggcgacggtgaccaggcggtcggccaccacggcacgcgcgcgcgggatgcaacgggaggcgcggcggattgagcggcgcggctcgggcacgcgcgctggctgtggggccgagcggctgcaggcgcggcagagcagcggggccgggcggcgcagacggcgtaggcgcgacgcgggcgacgaccacgcgggcgcgcgcgcgaacgacgcgcggggagcggcagcgagggagcaaagaggagggctcggctcggcggctcacgcgcacgcgcgcgcggcgcgcgggcggagcggagggggagggggagagagagagagagagagagcgagagagatagccgggaggaaggggggagatgggccgagagaaattcggcccatcgaccctgggggagacaaaatagacttttgcggaggaatttgatttggaaggatttggattcggaattgaactcgacgatagatcggggatttgagatcttgagatggcacggacactagacaacaagcaaagaaacaaatttcgcaactagggtttttaagagataattttcccgctaggcgccacgacggaacgggcgttacagaccaacccccctaacaagaatctcgaccccgagattcagcacctaagggagcagctccgggaactcggcgcggagaagatcttctcgctcccaggttgcctcatcttcagagtggttgctccattggactttgtagaacttaatggtcttccttcgagtctgacgtactgcctcttcaagaaccttgatcggtctttccttgtaggtcagattcttttccagctcgatgttacccagggggacttgttcttctggaactcgaagacatttctttaactgggatacgtggaacacgttgtgcacatctgcgagaccttcaggtaactcaagctggtaagccacttcgccacgtctggcggttataaggtaggggccgatgtagcggggtgctaacttgccggacatcccaaacctcctcataccacggagaggtgatacccgcaggtacacatgatctcctttttcgaactcaaggtcacgcctccgattgtcagcgtaattcttttggcggttctgcgctgtctttaaacgttctcggatcagcttaacttgttcttctgctgccttgagtatgtcaggaccgaataccagcgcttcgcccacctcattccagcacaagggggtgcggcactttcttccgaacattgcctcattcggcgacatctgaatactggcctggtaactgttgttgtatgagaactcagcatacggcaaacaacgatcccaagtgccttcgaaatccagggcacacgcacgtagcatgtcttctaggatttggtttaccctttcggtctgaccatcggtctgcggatggtaggctgtactaaaatttagatcggttccgagagcttcatgcaactgtttccagaaccttgaggtgaactgagtgcctcggtctgacacgatcttcttgggacagccaaatctacatacgacatgggtcatgtagagttctgctagtttctttccatcaaagatggttttcactggcacgaaatgagccgatttcgtgagtcgatccacgattacccagatggagtcgtacccgctaggggttcttggcaaaccggtgatgaaatacattccgatttcttcccatttccactcgggaattggtaggggctgtagcagaccagctggcctctggtgctctgccttgactctttggcaaatgtcacacaaggctacgtattctgcgacatctcgcttcattccagtccaccagaagtatgccttgatatcttggtacatcttcgtacttcctggatgaatggagtaggcggactcatgagcttcctttaggatgagatctcttaattccttcttggccggtacacagatgcgtggaccgcaccaaactgtgccttgatcgtctatggagaaattggtgtctttcttctcctgtattctttttattaactcttttatcccttcgtcgtctttctgagcttcccggatttgcgactctagggtaggctgtactgtcaagctggcagggacacctgactgtaccacggtcagcctcaacttctccaattctctgcacaggcgatcttggtcaggccgtatttgagctacattgcaataggccttgcgacttagcgcatcagcgaccacattagctttaccggggtggtaatgaattccaagatcgtaatccttgattagttccaaccatcttctctgcctcatatttaatttggtctgagtgaagatatacttaagacttttgtgatcagtgtatacttcacatctgttcccgattaaatagtgcctccagatcttaagagcatgaaacacggctgccaactcgagatcatgggtgggatagttgacttcatgaggcctgagctgcctgaatgcataggccacaacctttcgttcttgcattaggacacatcctaagccttgtcttgatgcatcacagaagatctcgaaatcttttcggatatctggcaaggtgagaactggggcagtggtcaaccttttcttcatttcttgaaagctgtcttcacaggctgcagaccagtgaaacttcttttccttctttaacagctcggtcataggtctgactagcttagagaatccttcaatgaatcttcgataatatccagctaagccaaggaggctgcgaatctctaacacgttcttgggcgggttccaagcaagtacagcttcaaccttgctgggatctacatcgacaccgttggaggagatcacgtgtccaaggaatgcttctcggtctaaccagaattcgcatttcgagaatttagcgaatagttgatgatccctgagcttttccattattagcctcaggtgttcagcatgttcttcctcattcttggagtatatcaggatgtcatcgatgaacaccacgacaaactggtccagctattccataaagattttgttcattaagttcatgaagaatgctggggcattggtgagtccgaaggacatcactgtgaactcatatagaccataacgcgttgagaaagcagtcttcgggatatcttcagatctgattttcaattggtggtaacctgatcttaagtcaatctttgagaaaactcttgctcctttaagttgatcgaacaaatcgtcaatccgtggcaacgggtacttgttctttatagtcacttcattcagggctctatagtcgattatcattctctcagagccatccttcttcttaaccagaagcactggggctccccaaggggatgagctaggtcgcacataacctttactcttcaattcttcgatttgtcttttaacttctgctagctcattggctaccattcggtagggtctttttgcaattggtgcggtgcctggtgccagttctatggcgaactcaatctctcggtctggtggcatactcgttaattcttctggaaatacgtcgggatattcacagactacgggcaccgactccaaggaggtgacttgtaaacaggttaagatagaccgacttgcggtaggggtgttagaggtaaaacggacttgctttcctccaggtccttgcaaggtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatatttgagttgcccttatattcctcccaggggaatgtactatcattggtacacgtaaattttgggttttccaaccatttcttttcacaaaagcttgtgatatgaaagaatgggaagctcctgaatcaaacagaactattgcgggtacggagttgacagagaacatacccatcacaacgtctggagcatcctgagcggtctcagcttgaatgtggttcacccggcctcgaccaaagttgttggaagcacaagtaccttgtccacttgcctgagagctaggacgagactgagctgccgctggagtaggagttctggcagtgctgccattagcatgccgtgagctggtgttggtaggattctgagggcactgtctggcatagtggcccatctggttgcaccggaaacactgaacagctgacggtccttgcggtgacttgaaagaggtaacactgtttggcgcagtattgccactaggggcacgctgctgtggctgaggtgccggacggttcatttgaggacaaggggcgtagcctggctggcggttagcctgagtgaccgactggtggtattgcatgggttgaccgtagcgagggcgaggtgcgcctcgggaggaatttccctgatggttagacttgcgtttcttgtattcttcggtagcctcttttctggcatcctcaagtagaagtgccttgttgatcatatgttgaaaagtggggaagtcgtgagcaagcaactggagtctcattccaaccgcgattcctttcaagaatttcctgatcttcttcttatctgtgtccacttcctcaggggcgtaccgagccaacttgttgaacatacttaggtactcattgacactgctgttgccttgcttaagtctgttgaattcctctttcttcatgtcaatggtgctttcaggcacatgagctgcacggaaagccgtagcaaactcatcccaagcaatgttagtgggttcagggtatgcattacagtaattctcccaccaatctgcagtaggtcctcttagctggtgagaggcgtagagcgtcttctcaaccggagtacactgcaccaagttgagttttctatcaacatctttcagccaatcgtcagcctcgacgggctcgacggtctgagagaactctggcggacgagacctcagaaaatctgtcagcttggatctattattgcccatgtgagggtggccatttccatgcgcattgtgctgataaccggctacggctgcggctaatccttgcaagatttgtatctgaactgccattaagtgctgcatgttgttttccacatgaggtggggaagggaggcgttcttctccagaattgtgactggcagtgtggtgagagcggtgagactgttccatctctgcattacgggaagctgtgcgatgcgagcggttgctgcggcggggttgctcaacttctgcgttgcgggaagcagtgcggtgcgaacggttgctgtggtgagactgctcattagctgactcatgatttgcttctgtcacaactctaccttcttcaaaaccgaagcgggctggcgcacgggctgcacggggggggggggggggggggctagccatctaaactcccagaagagggcgaggtaagaatcaggtaagcacttaggagggcaaggagcaaagtaaatagcaactcagacagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctaacacacggacggctgttgaagactgcctcctctactcctcgtcagcctggctgcctcctgtagtcggctcctcagtcgaagaaacgtcgatcggctgacgcgaagggaccggcggaacctgtcgagggccggcagcagcacaggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaggggctaactgggtgtgggtagggggagtacactggtgagtacggcgcacgcgagctaggggagcgcgggccactgggagtgcgggcagagccgcgggagctgtgggaggacaggtggctggcgtgacagaggcggcctgagtcccaagagacagtgtcaactgaggtgacaccctcctcggccatatgggcctccagagcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgcgtggccagaaggaaggcgtggaagctgccggaaggcggagcccccgagacggtggctgtagtcgtgggccaggcgacgaagcgcagtccaggagaggtcctggtacgcgatctggagagtgggcctggccacagtgaagtggtgtgggcgaaggccagctccgtgtatacctccacgggggtaaaggtacacagagagctcacagcgagggggaacacggtccacggagtaccccgtgtactcgggacacgagaagccaaggaaacgggcgaggtcacgaagctgagcgacgtggtgaccctcaccaaaaccgtgggagctgacgcttgcgttcactgccatctacaattttgaaagagggagaaaatattagtaaccattttagaaacaaactattggaaataaagaaaacaaaagaaaccttagcttttcgcaagtagttttgaacttagtatccttagggtcgtcctaaacgtcgggtttcgccctagggccaagcctgtgctctaataccatctcttgtcacgccccgaactagtaccgaccggaactagcccgtgacgctccaaattaacctgtaaattgataccagacccaggaaacagtgctggtatcataggaagacagattatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactcctcgtcagcgggatccgcttcatctcttcagcaactggggggggaattatttatatagagcaagggtgagtacaggagtactcagcatgccatgggaaataggtgtttattgcaggcttcaaggaaaggctgttgtttttgcaattgatttcatttgaactcttttctg

SEQ ID NO: 75583 - DNA, 571 bp, Oryza sativa
cagcaaactttgctgccagttgaacttgtgctgagactataatatgaactaaatctagctgtgcaatctaattaactaggaatttacgaaaaaaattatagtgcaatcctaatgtactggtgtatgatatgtaaagacatttttcttttgctggttagtttcgcttaccaccccaacaataacctccaattccaataacagatttgccttccctttttagagcagcaaaaattgatttagcatcttcagctgcttttacctgaaattcaaattgaatatactgatcaatatccattaattaactccacaataagcatcatctagaaaaggtttttttaatgcaactatgatcattattacttggcgttttgaaacgaaccatgtgagatttcatattgatatagcattaaaaaattacaagaccatagccctaaaaagttataaatagaggaaaaaaagaaacaacagtcacaccacgtgtctacaagatgtaaacttcctcctgtttggatccccttaagctattttggggctaaaaggggtgggctaaaaaatatctctaggatccaaa

SEQ ID NO: 75584 - DNA, 967 bp, Oryza sativa
gcggcgccggtgacgtaggcctcgtagcccgccaggtcgtggactaccacgccggcctcgccgccgccggcggccttcatgtccggcgggtgctcaaagcactgcaagcgcggcggagcagccgcggcggcggcgccggccgccgcggcgagcgcggcgaggcagaggatcaggaggctcaacgaagcagttgccatatggttaatttgcatactgatgagtgagagatgatgcttgggcttttgtacatgcctttaaccggtagagtcagctgcacgctgcaatcctgcgccccttttttcttgtaaaaaaaacaaagtgaaactattacactttgtattacgtataatataaactattacactttatattataattggtttgattttttttaatcaaacttcttttaactttgaccgagttcgtagaaaaaaatagtaacattttcaatacaaaacaaatattgtagcaatgtacatgctgctaatttttactataaacttaatcaaatttaaagaattttaaccaagaaaaaagtcaaacaacttataatatgaaatgggggagtactccctaactatttgtcattgtcatctccaattatttgtcatgctgtcctttcgaattatttctagttgtcgtttcagcgtggtccaatttgatgtttggagcgtagtgagttgaaccacattcggatcaattctacgtgtcccaagctcaagaaatctatcaaggaggatgagaaagataacaaggacaacaacggcttatcttttgaagataaaaggaagaaccacaagtgcaaacttgtgcgtcaaaagctttcaaagcaagtcgagtttagcgatgaaggataatcggaaagcgaggatgataagaaagcacataccaaaagtaaggttttgtgagtttatgtcttatagtaaaatgcttgtgcgttacaacgggaaaatctacccactcaaaa

SEQ ID NO: 75585 - DNA, 1616 bp, Oryza sativa
ctacatgaaagaacatgcaaatgtttcttcagaataaattaccggtgtccatgtacaaatttgcataaacagccatgcatgcaggctgaatacaatgagtgtctgcaatctggtggcttggacccagaatttggttgctaatttctttatacccactcaatgcctgttgggctttactgtttttccaatgatggaataaaaaaataccggccattgtttaaagagctacaaccatttattaaaaaaaaatcactcaataatgagtaccatcactttcttctcttaatttcaccattatagtagaggtagaatcctaatttggctccgccgctctacaacgcaatagactaatattgatagctagatttagtgccaattacacaagtcaacacgctcaattcctttagcacgactagtacttgtttactcctatactatagtctagctatctattatttatttattttatttattatcatattattattattattattatttattatattataaatatatcaaatccgatgatccaaaatcatctaatccaacatccaggatttacaaagccgattggtttgcgtggtttcttgatgtttcgacaaggctcagaattaattttcggttgaaattttgaatgctttcggatagattcaaatgttacacagtaaatttggtcaaaattaggtcggaattcgtcgaaaaccaaaccgtgatacgatacgacggggcttgaatggccaaccggtaaatgtataaagggtaaattggaaccatgccattataattttgtaaagtttgagatatgccatcggtatctcaatgacatgtaggacccacatgaattaatgacatgtgggtcaggatggcatatctcaaattttacaaaattataatggcacggttctaattttccatgtattgtataaacccttgccaatgccttgtaagttgtatcgccacgtttcccctctctctctctctctgaatctctcgcacacccgcaagccctcaaatcacgcacgccgcgcccgacagtagaggacagccggcgacccactacaaccacggacgagcggccagacggaaggccacctggccatcgtgagcagtccacccggatatcatcagaaaaatcagggggcggcagaaccgggagcactcccggagtcgtcaaggttttctctcgcggagttccatcccggccgtgctcccctcccccacccccctgcacgtgccgcgctcctcctgtcgtgtcgtcgtcgctccaccgcaaaaattctgtggctcctgagaggtacaatggtgccattgctcccctagtgctcgatgatatgcctttagggcgctttttttttgtggggggggaagggggggtaataatttgaggcaaaaattcagttcaccctagacaatcatgcggttgaatgagttttgatttccctacgaaacctatttgatgattgtggcaatttttaaggatgctaatttttcaatgaataattccatgtggcaaggcctgaattaagatggccatcatgtatttttggagctaatttcttaatattctgttgatttatctttgttcctttagttttttcatggattgccatcgg

SEQ ID NO: 75586 - DNA, 3415 bp, Oryza sativa
caccaaaggtgtcgggctaggatggcaagctcgccgaagattggatgatcggctgcgaatttggagaacatgtacgcgtagagtcggccgagccgaacccaacggtactcaccctcgagccaaacgtcaaacgacgacgtccgtcgactaaggggcggcgacggcggctcgggataaccggcgacggcgagctacggcggccggcgacgaaggagaaggtgcgaccgagcttctcgtcgctcccacgcacctaatggcggtggcggcaagcggcggcgacggcggagacgtctgcgcggcggcgccggagatggccggcgacggcggcgaggctaagcagcggcggcgcggcggctaggaggcacgggagaggacgggagttggggcaaacgaaagaggaggactagggggtcctagttatagccttggattgaagagatcggactcctcctacaagaaatcgatccgggaaatcaaaaactcggttttggagataaactcaaaaacgagttcgattcggataaaatactcaacgattagctccgatttttgggggtaaagatagaggaggataagaggaatatttcccctcaactaatttggaaagaggagcaacgaggaggccggatttggaaggaggagcggcacggctgcacaggctcgggacggctcggctctgtccaggggttgaagacaacactgtagcgagagggaggacaaacagacttctatgcgggctgagaggaagggacagaatgggctggattcggcccaagctgagtaggaggatttttattacttttccaattaaattaatcaatgaaatgatctttgaattgttaaaaatacttcctatgcccaaataattccaagaaaaatcttgaaaatacttggacactcaaagtacttaacaaaattataatcagaccatttaatgattaatttaatatgtggattattactgaaatgttctttgtattattaaaattaggaattgagctccgaaaaatccgagaatattccagagagtataattaaccatggagaatttaaaaaaaaaaatccatccatgctttatatttaggaaattttatttcccacatttaacttcacttgtaaattaatgaacatttaatataaattctaataataatttattaaataatttataaatcctaaaacgaaaatcagggtgtgacaaatctaccccccttacaaagaatctcgtcccgagattcggaacggctagaaagaaaagggcataggtaaactgcattctatcttattattccataactcagataattattctaaggctttaaagaaaactactgctgctttgaaactggtggctgagctgtaacacttgaagacgcaactcttgaagacgcaactggcactgcattggctcctgtgacgacaatgttgttgacttgcggctgctgatgctttgtcttcggacactctcttgcaaagtggcctggcttgtaacagttgaaacatacctgctgctcccttccactactgttattctcttgagactgatcctgctgaactggcactaattgagtagcttgctcaacattatcttcattgctttccttagtctctgatttgatctcaccaccgatgttcaactgttgcgactgtccttgaccagcggaagaagattcactaatttggagtggcatgatacgctgcctctggctactaccttgtgcctcctggaaaacagtcattttcctttttcggttatccatcctgttcttcttgtcttcaagtcgaattgctttgtcaaccagctgctgaaaatcaacatagtcatgggagatcaacgtaactgacagttcatccttcagaccttacaagaacttctcctgcctttcctcgtcagtacgcacatcttctggagcataacgtgccagacgattgaactcatgaagatactctgccacggtatgatccttttgcttcaaagccctaaactcacgcttcttcaaagcaacaactcctacaggtatgtgtgtcttcttgaatgcttccgtgaacttagcccaagtgattggttgtccttctgctctgccttggcgaaaatgatcccaccattcagcagcaggaccatgcaattgatgcgaagcaaaagaaactttctcctgctcagtacactggatcaaatccaacttcttctccaccgcatgcagccaatctcctgcttctactggattggtggtgcttgaaaaggtagggggtctcacacgtaagaaatctgccagcttgttttggggaggtgggggtggattctggttctgattgtttgcctgctgattctgtgcctgctgcactaacagattgatcagttgtgtttgttgggccagaatctgagctagcgtgggatctcctccattgttagcagctccacctccacttccacttccacttctggtgcgcgtgttcaccatctgttgcatattagagaagatagaaggagaggggttacactaaagacaagaccttaaccagtttaacactgatctgatgtgtgtagaccattatattgttcaagttgattaagcaagcaacctagtatagttacacactcatcaatgaactactccaatgatgggaatgcaaccatacctacacacaaagcaaacaacaagcgttctaccctactaactattcttcaaagacactttagcggcataggttctaaggtaggatccaaacttcattccatcttgaccacttggcacttcggttcttcctcgatccactttactgacctctataagttgacctcatcaacatcttctagtttcaacaactagtttcagaactactcaagttgaacgagagaggagagtagacaatgaaacaatttgcaaagaattctagataaggaagaaaggagaaattttcacaaatcatttttgttggaaaaattcgtccttaaagtttgaccatttggcttatcctacagtcgagatggctctgataccaacttgtcacgcccgaaaattcactagtaatttccgaactaatttgtgcataaaatcctcgtccaggaatcagccgaggtacacaaactgacaatttaatatacaaatccatcttaataataacgttacatacttacaaagaaaagaaaatagcagcggaattaactgtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacatggattccaaaggatggcataatataggctcatttgcaaaagcagcatttagcaaagatttaagataagtaaaacagtagagta

SEQ ID NO: 75587 - DNA, 1177 bp, Oryza sativa
tctcctcatagggttggtggggtgaggtgggaaagagcgggcggcgacgggcggtgcggtggcgcggcgaaactggagaaggggtgacgtggcaatggcgagccgggagcagatggcgcccacagcggtagggccatggcaagtagagcgcaggcactgcggcggttggcgcatagtcgaataggaagccatgacattgatgatgctgccgccattgcgagagagagggtggcctcggcgagcagagcagtggcggcggagcagagcgccagcggcgacgggcgagcccgccacacggagcggagcatgcgcggtgaccgccatggtggtggggaaagttagcgctggtagcagcttctgggcgccacggcggcgtgagcttggtgagaggatgctacaacggatggagcatcgctgcgttgtcggctggctcctccgtcgccggtaccgcgttgatggcggggacgcggcggccgagcttgtcctcacggatagggtggaaggaccgaaggattggacgtggtggtggatgaggtagagagggtttggtaggctgtccttggttaccctcccacacgcgagcccccacatgtcagagctgccaaataggtgaaccttaacaaaatagtgacggaatggtgtggagagcgcagtaaagttcaacgatggcatagagggaggctcgaactttttagtggcacagagacaagcaccatctttcttaatggcatacaggtaaaaacctcctaaaatggactatggatgtagccttaattgagagacctaaaatggccgtagcctgtgttggccaagactcaaatcgtgcaggagcagaacagcccaaaaaagaatcaagaccatggcccagcttttttcgatggaccgccctgggcttcgaccgaaaaccaaaagatatttctgactcacaatacgtagtcatcatgtatgaagagtggaagacagacctcaaaaagcagtttagtaattctgtgtttaaaatgtcttttttatcacgtaaaaatatactgatcaaacacgtgaattaaacgatttgtcgatctgcaaattaaacgataaataaaaaaataacagagggagtgaaaactctcgggtaccagacataaccgacctcgcccttcactcgttaaatcccttggcaaatcatgctcatatccaa

SEQ ID NO: 75588 - DNA, 12575 bp, Oryza sativa
aaacagagaacaataatcatgaagcagggaatagagaatttttcgaatgagattataatttgttggagcaaatttttaacaaaaatcctcatattttttatagggaatgatatgctgattctgtgggtgatactataggctaccgatcttcagcccagctcagtttgatgtactatgcatccacagctctaggaataagttcatctgaggtccttaacttatcaacgaatccaattttcatccttcaaccagaaaaccagatacaacaggtctctcaactatcaaaaccggtgcagaaaaggtccctcggcggttttatcaaaaccggtgcagaaaaggtccctcggcggttttgactgacgtggcgcttacgtggctagtttgactcggtcttcactacaccaatcagctattgcaagcttaatttgacaggatttagtaaatgttggatatgtagtgcaagagaagatctgctggagaaagggtttttaatccggttcgtaaccccctgtagtcctggttatgcaaccgggattacgaatacatctttagtctcggttgagataactaggactgaaaattcattttacaccaaccgagactaaatatggagccaagtccagttggtagttttttttcatcatttttaattttgaatattgatttcactacatccccaaactatccccaaatcgatcatcacaaaacaaaagggatcatctccaaatacatcacaaattctcaaaaaaattatatcacaaattcaaaaaaaacatcacatattcacatcacatacaaattaaatacatcacaaatccaaaaaaaacaaatcttccccagcccggccgccgctgcttctcccaccgcctccccagcccggccgtcaccgccgatgagcccgctgcgagagagagaggacagagagagacaacgagagaagaagtgaggtaggaaaatgcaattctgctctcgggcacatgtgtacccacactcctataccgtctgaccttgttgagattcgtgctgaagcttcatcatgactcagccgtgtgtggtgcgtagatatagcagataccacctttgaaagtcgagcagcccatgccgtatacacatggatcaacggtgcaacatggtggaatgccttcaatgcccttctctcatgcgttggaaacatccacattatttaatgcaccattggtctatggtttctttcagacttgctaatggatatgcggcgtagctcgtcctccatcttttgcgatttcgaggcatcaggggccaattttcaggtgcgcttgtgggaagccggctgcacggatcctatccgagacggtgaagaactacacggatcctaaaagttgtcagctgcatttcaagccaaacatgtacagtgcccatgaagatggtagcgaattaaatatagggtgtgtttagttcatgttaaaattaaaaatttagttaaaattaaaacgatgtgacgaaaagattaaaagtttgtgtataaaaaaattttaatgtgatgaaataattgaaaattcgaagaaaaattaagaagggcttatttgtgttggataggactgtattttttgacgcagacagcacatagcagagagtaaactgatttgactcattgcagcataggagtactggaaacagtcagacgtataattgcctttctggctatcattttgacgaagaccgattgggcacatagaattgttacatccactcagtccttggcgaccgcgtcatacggacgacagggcattgtccgtcgaatgcagcagatgcaagaactcatttttcgcgcatcttgacaccgccatcggcctatataagggcactattacactgtagaatatatatctattaactttataagttcatagaaaaaaggtccttcacattcactcctagggcaacaaaaatatatataacaaaagtagtccgtataaatctagatatatatatggactttaactattataaccttcacaatgtacttcctccgtttcacaatgtaagtcaatctagcattttccacattcaaattaatattaatgaatctaaatagatatatatgtgacggagcgtggggctcctcaccgggggaccgcgcaggcccccctttgccggttcggccgggggcgctaagtgaggttcttcaccctcaatctgtggaatgttcgcgagagaacaaatgcacaagacacgggcgatgtagacaggttcgggccgctgagaagcgtaataccctactcctgtgttttggtggatctgtgtgtgaagaagttacagagagccggagaacaagagagttcaggctctagaacccctcttcctctttctctcctctacgagttccggtattctcagtgtcgtctgagagtccccccttcttcggtgggcaaggtactccttttatatctcaaggggataccaaatgcaccacttctacctactcttcttttgggtggggacccaccctatcttgaccaaaacttggctcgcgcctttgcctggaagctaaatcacagcttgtccttgagtgaggcccagcgccgtcactcgcctgacacaggggataaccctgtcattccttcattaatgggtagagatttgcaatggccgctgtccgaatgaccctccgatgggatgggtcatacctacctccactccgccggaagcagatgcaacgtgggagcacggttgtctgccgatgacgtgaccggcgtcagaccagtcacagaccggtcattcttgtccaccgcgcgtcagtttagcacgccgcacgtctgcccttcttcatacaatgacttccttgccatggttgcgatgaagcctggaatgaatctggccgggactgacataccaactccaagagttagcacgccggctccggctagggacgagtgcctggaggctctcatcattccgacgggacggggcaaggcgtgtgacaggctgcctgttgccacctaacccgcgatctgaccggcctgtgaccggtcacacactgcgatcggtcacggaccggataagcacgcactgcgccgcattaaatgcggcgtgacgcgctcgtcaaaccgctataagtgcggttaggtgagcgccgctgtgctcacctaacccacacacgtggcgccaaaaccacagggggtcggggcgccccagccctcggggccgaagcgggagcggcccgacccctcggggagacagagggaggggtggccacgtcaccctcgggcccgacccccccgaggaggtcaggccacgtgggtgaccatagttacccaagcctctagtcactatacccccggccccatgttaccgacagtagcccccggcgttacgtcagggcgatcgcccccctcgagggaaacgctcggtcgtgacgccactccttaggcccggtgacaggtggggccggtccatacaggcgggcagaaacccagcggtcgcaaatcgcgcgcatcggcaagggaaaaccgactgacaataatgagcggcctcttcgagaccgctacattacttgagcagcgcgcgaatcgggacgagccggttcgtttcgcctggagacatgatgatggcgcttttctcggttggcgagcgtatttaacgagcgctcgatctgtcccatctcaaccgccacggccgcacatctgccgcgcgtgccgcaaacgggcgagtggggtcagtggaggcgcgggcgtgagaaacgagggggcgagatagtgggcgcgggaagcgaggagccgggcatagcgttggcaagggtataaagacgccgaggaagggattcgtttccttcctctcgccacacttccccttgccttcgccacttgtgctctaactcttcgtttcctgcgccctacccttgccgcactcgctcgttctcaagctcctcctccgccggcgtcatggcacggggctccgcaccgctcgacggtagcgtgctgccgccttcccgcatcgtgagcgagaggcagccgggctgccgcgccgattcatgccggaatctaccaccggccgggaggtggtcgcgctgggcgagggacgcccggcgccacactacccggggcggtccgtcttcttcctctccttcgcaatggcagggctggtcccgccattctcttcttttttcatggatattctggagttttatgatctccagatggcgcacctcacccccaacgcggtaatgacgttggccatcttcgcgcacctgtgcgagatgttcatcggggtgcgcccatctctccggctgttccggtggttcttcaccgtacagccggtgtcgccgccgtcggtagtcggtggctgctacttccagccgcggggaccggtgctgaaccgctacattccctgcgtcctccgcaagaagtgggacgactggaagagcgactggttctacacccccctcgccgacgaagcgcgcctccgacttccgagccagcccccggcgcaggcctccagctggcgggcgacggtagatctgggagatggctacgacgccgttcttgaccgcctggcgggtctgcgatcccaggggctcacgggggccatggtgttcggcgactaccttcatcgccggatcgcgccgctccagcggcgcgcccggggcgcctgggagtacaccggatccgaggactacatgaggacccaccaggggcgcaaatgggactgggtccctgaagacttcaagatggtggtccaacgggtgctgaatctcagctccgtggaggcatccctcatcccccaaggagtcctccccctctgctgcgatccagagcgcgccaacatcctgaccatcatgcaggcggtcggggcgtcgggggagcgggccctccaaggccacgatggcgcgggcgggagccgcaggggggaacaatctaccccaggagggggtcgtgcttctgggccccacgacgggggcccggggggcagccgccctgccgacgcccgggggaagaggaagcaggagggtaccccttccccatctcctccccgagggggcggggcggtgcgtgccagcagcaggcgcccggagggtgccgtgccgacgccgcagcccgagggggagcggaagaagaaacggctccgcaagatgggggggaccgagccatgccgggggaacctcatctcgcccccgaggtggtcgtttagccgacctccccgcaggttcgtccccgcgcccaccgcggccgtattcattctcccatctcccaaggcgagttttcactcacccgtttctttttgtcttctggtttttcttctgcctcagcgagatcctgttgcgcccccccccccccgccattccaagtccggccggtctgaggccaaggagacggcgaccgcggaggcccggaggcgggaagctgatcggcgagaagccgcggaccgcctccgggaagccgaggaagctgcccaggaggccgtccgggttcgccaggctgaggaaaccgctcgggaggaggccagactccgccgggccgaggagtccgtccgggaggcggaggcagcgcacgcacgccaggcggcctgccaagcccccgacccgactccgcccgcggcgacgacgacttccgaggccacccacgatgaggccgcgggcgcaccgctcgggcccgacccctcgggcgacgctcgggacgagccagcttcgggggatgcccccgagtccggcacgtcgatcggcgggccgagccgcgtggcacccacaccgaggcggctctcccctctgccttccgctgccccactgagcgcggagcccctcctgcaagccttggccgccgcgaacaccacggtgctggacgggttaagtgcccagatggaggtcctgcaggcagagcgggcggagctcgacgcggcgtgggcgcgcgtcgaagaggggcggcgctcggtggaggccatggtggaggcgggccgcaaggcacaccgccggcacgcctcagagctcgaggcccgtcgtagggaccttgcggagatcgccagggaggtggaggaggagcgggagactgccctcatcgccaccgccgtgttcaacgaggcgcgggatgacctccgcctccaatacgggagccgggcggcggagctagaaaagaagctcgacgccgcccggggagtccttgacgccgcagctgcccgggaacagcgggcggcggagaacgaggcggcgtcccggcggcgcgaagaggcccttgagggtcgcgccacggcgctggaggagcgcgcccgcgccctggacgcgaaggagagggagctggcggacctcgaggccgccgtcgccacccgggaggcaacactggcggcgcacgaggccgcctgcgccgaagaggagtccacactccggagttcaccacgccccggggcacggctcggttctgggccccttttggcgattttagccggcccgggccaccgagggcaggatcgagcacgagcgtgctaattcaagccaagattcttcaaaaggaaacaatggcacatacacagtccttaggaaatcgaaaatgcttttattgaaatacggaagagaaaaaagataagtatatgcatgtggtagcccccggccaaccctgcacgcccggggggggtgcggggttggcccgagcccgagacctgacacccgacccctactaggggtagaagcgatgaaggtgttcgatgttccacgggttaggcagctctgtgccgtcgcccatggccagccgaacggagcccggccgggggacgccgatcactcgatacggaccctcccacattggtgagagcttgctcagtccagcacacgtttggacgcggcgtaggacgaggtcatcgacgcagagtgatcgggcccggacgtgacgctgatggtagcgccgcaggctctgctggtagcgcgccgctcggagggccgcgcgccgccttcgctcttccaagaagtcgaggtcgtctctttgaagctgatcttgatcagcctcgcaatacatggtggcccgaggggacctcagggtgagctcagatgggaggaccgcctccacgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctaaagggacccaggatatcgagcccccagacagcaaacggccacgaaagaggtatggtctgcagggcctgggccggctgatgggtttgcctggcgtggaactggcacgccctgcaccgccagaccaggtcgaccgcatcgttgagagccgttggccaatagaaaccctggcgaaaggctttgccaaccaaggtgcgtgaggcggagtgggctccgcactcgccttcatggatatcggcgagaagctcgacgccttgttcccgaggaatgcacttcaggaagactccgttagccacgcgccgatagagggtcccttccaccagcacgtagcgcttggagatgcgctggacgcgttcactcccttcgcggtcctcgggtagagtcttatctgcgaggtacgcatggatctcagcgatccaagcaaacaatctaagggagctgggagcgctcccctcgggtcccgaggcctggactccgacgggcctcgggggccgttcaggcgcgtccgtctcccctagggggtcgggtcgcgccgacggctgggcaaccctttcttcaaaggcgcccggtggggtctgggctcgcgaggaagcgagccttgagagttcatcggcgaccgcgttatcccgtctgggcacgtgccgaagctctatcccgtcgaaatggcactccatacgccgcacctggcgcacgtaagcgtccatctgcgggtcagagcaccggtactccttacagacctggttaacgactagctgggagtcgcctaacaccaggaggcggcggatccccagtccagctgccaccctgagtcctgcaaggagtccctcgtactccgccatattattggtcgcccgaaagtcgaggagaaccaggtatctgaggacgtctccgctcggtgaggtcaacgtgacccccgcaccggcgccctgaagagacagggagccgtcgaactgcatcacccagtaggcggtgtgaggcagctgcgaggggcccgagctggcctcggggacggagacggcctcaggagctggggtccactctgccacaaagtcggcgagggcctggctcttgatcgcgtggcgtggttcaaagtgcaaatcgaactcagagagttcgattgcccatttcaccacccgtccagtaccctctcggttatgcaagatttggctgagggggtaagacgtaaccaccgtgacccgatgcgcctggaaataatggcgcaacttcctcgaagccatcagaatagcgtaaaacatcttctgagcctgtgggtatcgggtcttggcatcccggagggcctcgctaacaaagtagatgggccgctgcacctttcggcgaggccgatcctcttcgccaggggccgcatctccagggcgctcttcgtccgagaggccgcgcggggcgccctcggcttctgcgccgataacctcggggtcagaggaagacaggcgcggccttcccgcagtggccccggggccatcctgggggtcgggggcgcctggcaccgtcggacaagcaggcggagggccagctctggccgtcgggggccttgggccaccgttcggctcgggggcctctcctccctgctctctcccgggtcgagtcgacacaaggtggggatgcgcggagtgagggttgtcctcgtcgcgctccacgaccaacgccgcgctgaccacttgcggggttgccgccaggtagagtagcaacggctcatctggctccggggcgaccaggactggggtagaactgaggtacgccttcaactgagtgaaggcccgctcagcctcctccgtccaggtaaacggcccggagcgtttgaggagcttaaataggggtagcgccgaacacgcacttgtcggggttcagctttatgcgggcggagcggagactttcgaaagtttccgctagatccgagagtaaggtctcttggttgcgcgtcttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagtttttgcctcatcctccctagccatgcgaatctgatgataaccagagtatgcatctagaaaacacaaaaggtcgcaccccgcggtggagtcgacaatctgatctatgcgtggcagggggtaagagtccttaggacatgccttgttaaggtcggtgtagtcgatgcacatccgaagcttgccgttcgccttgggaacgacgaccgggttcgccagccactccggatggatgacctcacggatgaatccggcctctagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagatgtcggcgtttgcccgcaggaaggagacgagcgcgtcttcctatttgtcgtccagaagaccaccgattcgtgtggtcttggacgggccgtcgcccagggcaacctccttgaccgggacctcgtcgcacgtgatcatccgctgcctcggggcggctgggacggaggtgctgagcctctcgtcgccacccgcgggcttggacgccgcggcgaggtggtccgcgcgctgctccatacaagcaagcgcgactttgaggtcgccatggacggtgatggggccaccgaggctcggcatcttcatctggagataggcgtagtggaccgccgccatgaacttcaccaacgcgggcctcccaaggaccgcgttgtagggcagactgaggtccgccacatcgaagttcacccgctccgtgcggaagttggcggaaccaccgaaggtgaccgggaggtcgatatgacctagcggccaagtgtgccccggcgtcacaccgatgatcggttgggacagccggagcaccatccctggggccttgatggcgtcaaaggctgcgggggaaaggatgttgagggctgcacccccgtctatgaggacacgccccaacttcacattgcaaacggtgggggaaacaaccatcgcgatctgtcctccccgagcaatgcacggcgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgacgtcctcggcggtggccttctgcttggcctcacctcgccggttgccggcgggagccgccggggctctgccctcacggcgctcctgcctcctctcctcctcccacttcctcgtccgctcagccaaacttttgaccgcgcggcagtccgcgaggtcgtggagggaggtgttatgcacggaacaccacttgccggtcgggcgctccctgctgggagcgccggcctccttctttttgtcgctcgcaggcctcccctttcgggtggcccgtgaagcgccctcgacggcgaggacgtgaccctcgtcgtcggaatgggccgacctcttcttcctcctcctgtcccgccgccctgaccgagcggcggacccgggggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacggcccccctgaacgcgtagatcaccgcgtgtgcggggatgcatggtatggtgttgcggacttgacagaaccgctgaatgtacgagcgaagagactcatcgtcccttcgctgtaccgcatgcaagtccgcttcttcacctgggcgcggatatgtgccctggaagttcatggtgaactgctggcacaaatccttccaagagtggaccgacgcgggtggcaagttcattagccaaccccgcgcctgacctttcagggccatggggaagaaattcgccatgaccctgttgtcacccccggcggcctcgatcccggtcgtgtagatctggagaaactcggcggggttgacgcttccgtcgtatttttcggtgatggtgggccggaaccttgggggccaacggaggggctggcccccgtgcccggaccgaagtggcactccggacgaggaagcgccctccgttgcgtgggcagcacgacgaccattgcgccggcgctcgatgttgaggcgggcatccggccccccacgcacatcttcttgggtcggaggcgttgacgagggaatggcggacgaacggcgggtaacggccgccgctcgccgcgccctccgcctcgacgacacggagccggcggtagcagcgccagaggccttggtggcggaggaccgcccgccggcgcctaggcgctgctgcgccgtcatgaccaagtcggccacgtcatccagccaacgtcgggctggagtctctggatcggggacgacgggcgggtgacgcaggagcgcgcccgcagcctggagcgcgccctggggcgtgctgccatcgccgtagacgaggaggcgacgctccccgtctcgccgtccttctccatcgcccgcgggcggcgaagtcgcggatctttcgaccccctcgagcgcctcctcccgcccaagacttcggcgagagggggacggtggagtactagctcgacggcgcgggttctgctccccgtcgtcaccgctagcgctcggagagaggttgtgcgccactgcctgttcagccattgggctgagcgggagaagcttggcgcacacgaaagaggacgagggcttagaaagacacacgcgccccctacctggcgcgccagatgacggcgcgtggggctcatcaccgggggaccgcgcaggcccccctttgccggttcggccgggggcgctaagtgaggttcttcaccctcgatctgtggaatgttcgcgagaaaacaaatgca

SEQ ID NO: 75589 - DNA, 2519 bp, Oryza sativa
acaaattttatcttagcccaatttatattgagatttacaaattaaaattagttcttctcttctaggcttttaaaatcatttctaataattccttttaaacaccaatttataatttaaggattttaaacaagaaaagctcttaacaaatataattagatcattaatgatcaaataattactgaactgttctttgtatcatttaggaattgagctccgaaaaatctgagaaaatttcagagagtttacttaatcatgaagaatttaataaaaattaaatccatccatgctttatattaaggaaattttatttcccacatttaacttcacttgtaaattaaagatcatttaatacaaattctaataataatttattaaataatttataaatcctgaaacaaaaatcaggatgtgacaccctatcaaggatcctaaattaggtaggcacccaaataatctttccaagcccccagtctcaggggctctactgcacagcccccatccacggttggaaaagctcgggagctgcccgacgtggtcttggtccgccggcacctcccctgcccagtgctcattcccgcccggtgcggctcctccctgcctaccgtgtcatccctcaagtgcattcctctacccgacgctccttcccggccgacgcgtctgctgtacctggagtctcctctagcctgcaccctctgcctgaactcgatgaaaaacatggcccagtggccgagtcatgcgatggcgtcgaggcactggatgattcaagtgttgttgcaggctgcaaaattgagaaagtagtagcagggtagcactagcagctgcgattgtgggacttagaagaatggggaaagtgatacatgcgatgtgctatgcagcttttttgttgttttgcttggttgttgcttcgtgagagaagtagctggtctatgggtggatgagaagacgggaaaaatcaacacatgtgagaaaatgcatggaagcgctacagtagcagaagctcgtttcacccgagctatgaatacatgctactaggatttgtatttccattttattttttttaaaagaatcgaatttgaattgtgaatttaaatatggttggattattatggttttatactaggagtagcgtagagtatagaactatacatttgtactttaaagtatatgttaaaatagaagatgaaatgaaataagggacgagaaaagggactgctgctggagttaaaggtattttttaggtacttagaaaatgggggaagcccccattaaatttttagaggctgtaaaataggagctattgctggagatgctctaactagccaacacatggatgtcccactcgtataagagcaaatttaatagtatagccaactatcaactctaaatcatctaaagttaatctaatagtcaattcatataatagttacatataaatatatattggtcccacctgtcatacacatagtgtcttagaatccgtgttgtagcaagctacaaatctatagcccacgcttctcttctctctcctctctaatctcctccatatgcttatagctaacttatagtctattattcacactagtacagatcctctcatctgtgacggcccatcacatgcctgggcaacgtggcccgtcaaaacaaagtcatctcaatcgggcctaaatttttgccgttgtagatatactcgtcggggtgcatattcctatagcccgtcaccgatgacactcatttgtgacaggcttgaagttaggcccgattgagatgacctccactatctcaatcgggcccaaatactgagcccgtcatagatgagtgtcatcggtgacgggctccaaagaaggcccgattgagatggcctgaatgcccgtcatcgatgactcttatcggcgtcgggcttctatttctgcccgttagagattagtgtgcgcccgttagagatgacttttttttggcccgattgagatatactttgcacactatatatactccagcagtccgttgtctgtagttatcccactaataactattttggtgggaggttgaagggggcgaatttttgtaatttttttgcaaacaaaaacatgaaaatcataaaagtaagtaaaagggtactaataatttcctattaatttagtagtacttatgttatgagatgttaactaatattttgttcattgttcagcgatggatcaaagttggatgtacatgactggcttgaggcgtcagtacaaggagtatagagatggcatattaagttttatgaaagccgcagtggaggataggataagaagaaacgacaagtacatgtgttgtccatgtagcgattgcaggaatgagatttggttggacgatgaaaaggaagtacacgctcacttgatacgccggggattcatgaagagatacacatgttgggtgaagcatggagagcaagatctgggtactgatggtgtagctgcggatggaagtggtgcagacaatcatgaagaaggagatgaagacgagcatgacatgtttgt

SEQ ID NO: 75590 - DNA, 31909 bp, Oryza sativa
cgtgaacgtgaaatgcaatatatatatgttacttcgcatttatcctaatacatattttttgtatcttgcagaaaagacgtgttgtcggagtcgtccctcaagccggagtggaagagctagccctagaaggaattcgtgcaggcaagtgaagtaataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttagtatataattattgactacggaattggtgcgactcctagcaattgacaattttagtcttaattagacttagcatatacgacagttacacttagcatacatgactctttcagtcttagcatgtaatattatttgagttttaatataagattactttatttgtaattagaattagtatgtaattattgactacggaattggtgcgactcctagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagaacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatctgtcacatcctgatttttgtttcaggatttataaattatttaataaattattattagaatttatattaaatgttcattaatttacaagtgaagttaaatgtgggaaatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccagggctacacctaatcctccacaccatcagcatcattgtagaactcttcctctgatgaatgattgcaaggtgagtatatgacatactcagcaagtcacgcagcaaatatgcaagtgcacaaggataccaaaggatggcataatagggttccatttgcaaaagcagcatttaataaacatttcagaatttaataaaacaattaagtaataattaaacaatattaatccaacgctatacaacataccctgttgtataggcccaacctttctgaacaaccatacccagctgtacagatctatctccaaaccaggaatataccattccaaaccaggagctaaacaaattattaccagttatagcatcttttactaagatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccccttgcataacacaatccaccgcaacgcaccattcctggatcataatcacccccttataaacaaggcattgactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattatcaggttttagttggcacattaattaatcaatcacgattgaccatcgtgaactatcattaagccatcattaaataatagtgagtcatgagttatcccaatagtgagctaatgtttctaagcagggctaagcaattatatctaatacatctagttgaaccaacatatagagctcaactagtcaagttataataacccaaggtatcaaggaataaggtaatcaagaacaaaaaggctataacaaacaataagttaattccacccaatgacattcgaaaataaatgcaatagttgaaaagaaacaatagctttaaacgggatcaacatgctcaaagggttgtttgggatctgtgtgacttgccttgctggccttggaactcttcaaactcttctccggcgaaaacagactctccagaaacgacggaatctaagcagaaaagagcaaaatcaccaaaacagcacataaacaagcatgaacagtacatgtggatatttttaacatgtagatctcaattttagaaaaatttagagacttgaaccaactaaatccgagcaaagatgaattagttatgaatttttgaagattaaatcggattaaaacacttaaattgattttaattgaattatgacgcaataatgaattatttttgaaaaggaaaagaggatttattgcgtcagcgactagggtttcgcggtggaccgggcgcacggcggcggttcacgcgaacggacggccgagatcgatccatccaaaacggacggccgagatcgatcgggtccacggcggctcacgggagagggcgacgatgacgtcagcagtgacgtcaccaccggcggcggtggctcggcggctcgggcttgcatgctcgccggcgaacgacggcacggcggcgcgaacggaaggcaccaacgggtagagcgcgacgcggcgaactcaccggtgaccaaacgagcggcggaagatcaacggacggcgacggcgacgacgaagaaacggcggcggtcttcgggtcgacggcggcgacggtgctccggtggtctacaacgacggcgaaggggcggacgaggacggagacgcgacggcgaccacgatggcagccttcccgagtgacgacgacggctgaaacggcggcggcgcacggctggagcgacggcggcgacggcggcgctagggcacacggtgctagagctcttccggcgacgagaggcgaaggcgagggtggcggcgggtagaggagacaccggggagccttttaaaggggctaggaggcgacggcgaaggcccacggcggccggcgacgagaaggaaagttcgggaaaatcgaatccgaaacaaactcgaatccacgaatttccaaacgattttagccgatgtttccaaaggagaaaaggtagaggagatcccgaggatcatttcccctctatcaattcggccggaaacggaaaggagcggccggattggaaagcggcggcggcggcgcgaaactagggtttcggccggaggaagacgatgggccccacctgtcagcgggcgaacgcgcgcgcgcgcgacggcggactgggccgacttgggctgaggagagagagagcggttttgggccgactttcggcccaaagccaaaagagactttttaaaacctttttcaatttaaattatttcttaaatgcaattccattcattaaaaatacttccttagctcaaataaatcccagaaaaatctaggaattatagaattaagcaaagtatttaatgaaattttatctggccccattttatattggaatttattaattaaaattagatcttctcttctaggcttttaaaattatttctaaaaattccatttaaacaacaatttatatattttgaattttcagggtgtgacaggaaataaaatttcctaaatataaagcatggatggatttaatttttattaaattctccatgattaagtctactctctgaaattttctcggatttttcggagctcaattcctaaatgatacaaagaacagttcagtaattagttaatcaattaatgatctaattataagtgttaagagcttttcttgtttaaaaatccttaaattataaattgttgtttaaaaggaattattagaaatgatcttaaaagcctaaaagagaagatctaattttaatttgctaaatctcaatataaaattgggctagataaaattttgttaaatacttctcttgaatctttagttcctagatttttctgggatttatttgagccaagaaagtatttttaataaatggaattgcatttcatgaataatttaaatagaaaaatgtttttaaatcctccttttggctttgggccgaaagccggcccaaaacccctctctctttctctctccctccccggcccagtccgcccagtccgccgcgccccttcctcctctctctcagccgctgagaggtgggccctacctgtcaggcccgtcttcctcctcgcgccgctgccggccgaaaccctagccgccgccgctttccaatccggtcgatcctttccgtttccggtgaaatcgtttgaggggaaataatctcctcgatctcctcttccttttctcttatagaaacttcggtcaatttcgtttggaaatcgacggatttgagctcgattcggatcgacttttctccctccaaccctagctttccatctcgccgccggtcgccgtgggcctccgtcgccgctcgctagcccctttaaaagcacccccgagctctcctctatccgccgccacctttgtcttagcccgccgtcgcgtctagcgccgcctccgcgtagccctagccgtcgctgtcgttgccgtcggttcagccgcgccgcgccgccgttgcagccgccgtcgtcggtcgccgtcgccaccatcgggatcgcgaggtcgtcgccgtccccgtccaccgcttcgccgccgccgaagaccgccggagcaccgccgtcaccgtcgacccgaagaccgccgccgcttcttcctcatggccggcgccgtccgttgctcttccgccgtggttttggtcaccggtgagttcgccgtgttgtcctctacccgttggtgtcctccgtttgcgtcgtcgcgctgtcgttcgccggcgagcgtgcgaggccgagccgtcgtcggtgatgacgtcatcgctgacgtcaccgctgacgtcatcgtcgccttgtcccgtgaaccgcggtagatcaagttgatctcggccgtccgttttggataggatcgatctcggccgtttgtttccttagaccgtcccgtgcacccggactgcctttgatgacgcaataatcctccttttccttttgaaaaatagttcattattgcgtaataattcaattaaaatccatataaatgctttaatccggtttaatctttaaaaattcataactaattcattgtaactcagtttaatgtggttcaagttgcaaaagttgtgtaaaataaagatctacatattaaaattatccataaattgaattaaatttatttaattctttttaaatgggctttaattagatttaatcttgtaaaattcgtaataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgtagaccgaatattgcaagtcaagtcacacagatcctaaacacaatcctttgagcattttgatcctatatttaaattctctatttatttcaactgtgcatttattttcgaatgtcactgggtggtgtgaatctattcctttgttatggcctgtttgcattgattactttattccttgataccttgggttattataactagactagttgagctttatacattggttcagctagatattagatgtaattgcttagccatgcttagaaacattagcacactattgggataacttatgacttattattatttaatgatggcttaatgatagtttacgatggtcaatcgtgattggttaattaattacttgccaactaaaacttgataatggtgggttgtgagcacatggctttgagagtcgtgctcatgacaattaaggaccggttcacgagctactattgtgaaacattaaccgtgccaaccacaagccagcgtgggcaacggctttaccttttgtatagcatgattcattgcggagcaccagactaagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacatatcacaccctgaaaaattcaaaatatataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaagagtctcttttggctctgggccgaaagtcggcccaaaaaccgttctctctctcctcggcccaagtcggcccagtccagtccgcagccgcccacgcgcgcgcgcccccgcctgtcaggtcgtcgtcttcctcgcgtcggccgcctcccgaaaccctagcgctgcgccgccgccgtctccttccaaatccggccgctcctttccttctccggccgaattgatagaggggaaatgatcctcgggatctcctctaccttttcccttttggaaacatcggctaaatcggcttggaaagcgtttgattcgaggtcgaatcggatcggcttttctctctccgagcccgacctttccttctcgtcgccggccgccgtgggccttcgccgtcgccctccaacccctttaaaaggacccccgagctcttctctacccgccgctaccctcgccttcgcctctcgtcgtccgtagcgccctagcgccgagtagcctcgagccgccgtcgccgccgtcgctccagccgtgcgccgccgccgttccggtcatcgccgtcgctcgggaagaccaccgtcgtggtcgccaagtcgccgccgtcctcgtccgccccttcgccgtcgccgaagaccgccggagcaccgtcgccgtcgtcaagccgaagagctccgccgtttcaacctcgtcgccgtcgccgtccgttggtcttccgccgctcctttggtcatcggtgagttcgccgcgtcgcgctctacccgttggtgccctccgttcgtgccgaagtgccgccgttcgcaggcgagcatgcgcgtccgagccgccgagccgccgccgccggtggtgacgtcatcgctgacgtcatcgttgtcacatcctgatttttgtttcaggatttatagattatttaataaattattattagaatttatattaaatgttcattaatttacaagtgaagttaaatgtgggaaataaaatttcctaaatataaagcatggatggatttaatttttattaaattctccatggttaattatactctctggaattttctcggatttttcggagctcaattgttaattttaatcatacaaagagcagttcagcaattgtttaaatattaaattaatcattaaatggtctgattataattttgttaagtactttgagtgtccaagtattttcaagatttttcttgaaattatttgagcattggaagtatttttaacaattcaaagatcatttcagtgattaatttaattggaaaagtaattaaagttcaccttttccttttcgggccgaattaggaaaagtcctctcactctcggcccagtctcctctcagcctgcagcccttttcctctctttcccgaagtctgctttatttccctcctttaatcagtccttggaagtagaagcccagccgaaagtctagtttgcctccctggcactattcatcttcaagcttggacagagccgagccgccggtgctgtgccctgtgcagccgccgcttcctccgttaaatccgccacatcccgagctccgtttgcaaaatttgttgaggggaaatattcctcttatcctcctctatcctctcccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgttttccccctctcccgtcctctcccgtgcaccgtagcccgccgtcgacgccgcatagtccgccgccgccgccggccgggttgcagccgcgccgagtcgccgtcttcgccgtcgccgccgcttgccgccgccgcctttaggtgcgccaaggtgaagagaagcccggccgcacctcctccttcgtcgccggccgccgtagctcgccgttgccggtcaagccgagccgccgccgccgttcatctcgtcgccggccgtcgtcgttcgtcgtttggctcaagggtgagtaccgttgggttcgtctcgtcgttctccacgtgtacatgtcctccaaatttgcagccgaccatccaatctccggcgaggtcgccaacccgggccggccattgatgatgtcatcatgacgtcatcattggttttttctttttcccgtttttctaatagattaaatcttctgaaaatcataactaaataactgtagatccgattcgagtggttcaagttgctaaatttttctaaaatcaagatctactgccggccgggttgcagccgcgccgagcagccgtctccgccgtcgccgccgcttgccgccaccgccattaggtgcgtgggagcgacgagaagctcggccgcacctcctccttcgtctccggccgccgtagctcgccgtcgccggttatcccgagccgccgtcgccgccccttcgtcgccggccgtcgtcgtttgtcgtttggctcgagggtgagtaccgttgggttcgtctcatcgtcctctacgcgtacatgtcctccaaattcgcagccgatcatccaatctccggcgagcttgccatcctagccggccacctttggtgatgtcatcatgtcatcatcggttttttctttttcccgtttttctaatagattaaatcttcggaaaatcataactaaataactgtagatccgtttcgagtggttcaagttgctaaatttttctaaaatcaagatctacatgttaaaaatatccacatatactgtttatgcttttttttgtactgttttgttgatttttattctttcgctttagtttccgacgttccggaggagagcgttttcgttgagcaaggttcggaagtgtttgcggaagctcaaggcaagtcacacagatcccaaacaaccctttgagcatgttgaacccgtttaaagctattattttatttcaactatgcattatttttgaatgtcatcgggtggtgaacctttccccgttaattaatggccgaagatgatcttatttttctatgggttataatttgattagcatgaaccttatatattggtttggttcagttaaatgctatatgtatgtttgcttagccatgcttagaaacattagctaattaaaggggattaaatataaattatattatattattcttattaattatggttatatttaatggtagctcacgatgattaatcgtgtgatgttaattaattgataattaaaacctgtttaaggtgggttgtgagcatatggttttgatggttgtgctcatgacaattaaggaccggttcgcgagctactgttgtaaaacatttatcgtgccaaccacaagctagcgtgggcaacggctttatcttttgtatagcatgattcattttggagtgccagactgagaagcggcgagaagtccgtgggggtcgctggggagtccatgcctctggttgtagagggggtgattatgatccaggaacggtgcactgttttgagttgtgttgtgcagagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcgatgtttttcgtgattagtctcacactactcatcaatgttaataatgtgataattaatttgactcctggtttggaatggataattcctggtttggaggtttgatctgtacgaccggggttggttgttcaggtttggttaggcctgagcagcatggatgtgctgtttagtgttgattaaaattgatgattaactactctactgttttacttatcttaaatctttgctaaatgctgcttttgcaaatgagcctatattatgccatccttcggaatccatgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttctttgtaagtatgtaacgttattattaagatggatttgtatattaaattgtcagtttgtgtacctcggctgattcctggacgaggattttatgcacaaattagttcggaaattactagtgaatttccgggcgtgacagtttagtggtgtgagagtcttcagttttgtaataatgaaactcagttaagatcaataaaagttaaagtaattctctgtcctaagtagtttcccccggtttctcttcttgtgccctgtccatgccagatggtgctcactcgcagcaacgggaatggccccaacaacaacaataacaataacaatggagagaatcccacacttgcccaagttcttgctcaacagactcagttaatgaacatgatgatgcagcaacttcagaaccagcaaaaccagggaaataactatgcgcctccccaaaacaagttagcagaatttcttcgtgtgaggccgcctattttctctagcaccactaatcctgttgaagctggtgattggctccatgccatagagaagaagttggatttgcttcaatgcactgatcaggagaaggtctcatttgcatcccatcagttgcatggccctgcctctgaatggtgggatcacttccgtctgaataggactactgctgaacctatcacttggcttgaattcaccgctgctttccggaagacgcatataccatcgggagtggtgtctctcaagaagaaggaattcaggtcgctcactcagggatctcgctctgttacggagtatctgcacgagttcaatcgtcttgctcgttatgctccggaagatgtacgcactgatgaagagcgccaggaaaagttcttggcaggacttaatgatgagctttcttacccactcatgactggggattatcctgatttctagaagttagtggataaggctattcgccaggaggacaagtacaatcgcatcgagcagaagaaacgtcggattgctcaattcaagacacaacaggggaatagtcagaggccgcgtcttactttaggaccccagtccatgccacagggaggttcttcgtctgttgttcgtccgcagcgtcagttcttcaacaacaatgctggcaacaacatccgcaatcaagctctacgccctgttgcagcctcgacacagcaacaacctgccaagagggagcaaggcagaaagcccgtggtgtgtttcaactgtggagacccaggacattacgctgacaagtgtccgaagccccgacgcgtgaaggttgtccctgctcagagcaactctaccgcaccagcgccaaaggcccgtgttaatcatgtcgctgctgcagaagctcaagatgctccagatgtgattttgggtacgtttcttgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcctctctgtcagaatagaaattcaaggagtaccatttctggccaatcttatcctgttagaatccaaagaccttgatgtcatcctagggatggactggttagccagatataaaggtgtgatagactgtgccaacagaaaagtaactctcaccagcaatgatggtcgagttgtaactgttcatgcattgtcttctgagtccttaaggtcaagactgaaccaaataactttggaagagattcctatagtccgggagtatcccgatgtgttcccagatgatttacctggtatgccgcctaaaagggatatagagttcagaatagatttggtaccaggaacaactccgatccataagagaccttatagaatggcagccaatgagttggcagaagtcaaaaggcaagtagacgatttgcttcagaaaggatacatcagaccgagttcatctccatggggagctccggttatttttgtggaaaagaaagaccatacccagaggatgtgtgtggactatcgtgcactaaatgatgtgactatcaagaataagtatccgctgcccagaattgatgatttgtttgatcagcttaaaggtgccactgttttctccaagatagatcttcgatcagggtatcaccagttgagaatcaaagaggaagatatacctaagacagcttttaccactagatatgggttgttcgaatgtactgttatgtcttttggacttaccaatgcccctgctttcttcatgaacttgatgaataaggtgtttatggaatacctagacaagttcgtggtggtctttattgatgacattcttatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggagagtaaacgtcacaatgcttgaccaatatccacaagaaacagaggacaatctcgtccatctcctgaaggcgcagcattacaagacgttcatactgttgccgtacaacatagagttagtttaattttactgtcttcctacataccaaatttcattcccgtacgaacttgctaagtgtttcatatgtaatgcatcccacgcacattgcagattccactgggtgcttttactcttcgacctgtcggcctgcaccgtcaacgtatatgacttaatggataaaaaagagtctacgtttgactattttttcgaacttatagacaggtaccgtcataagttcctctgttaattaagaaaatcttgttatgttaattgctactacgaatcatagctttaaactccatgtagggcttggtatcgattccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaactaacttgtgcagctattacgtgtgcgagtattgccactgccttgcagaccaaatcatcaccacaagagagctcgatgtacgtacaaataaattcaaaatttcattacgtaacgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactactacgtcgaaatcgtagctatctaggacatataatggattgtaattaatacatgactacatatgtttctatatgcatgtgtacacattttctataatgtaaatatattttggtcatatatatatatatatatatagtaaatttgtttgtatatatacatatgcatttgcataacatatatatgtataagtacacagggccatgcaaaaaaaaaaaggtcagctcgatctttagtcccggttggtaagatcgatctttagtaccggttatttcacccgggactaaagataaagatagcgatctttagtcccggattggtactcccggtttggaaaccgggactaaaggggggttataaaccgggactacaaagggtttctccaccattgacagactcaaattttcagggaaaatgttttgcaaaatattttagttgcactcttctcgattcttctgttgaagtgatgttgccttctcttaatttcttttaacttggatttaaactttatttgcaaagttaatcgctctcttttaaaatgtaaacctctctatcactactaggaaaatgatttgttgctacgaaaaaaatcgtggcaacaatgctaaaatcgtggcaatagatacatattgccaccattttaaaaccgttgctagccgtggcaatagaaacagtagcaataggttattgcaacaatttttatctagtggcaacaaactttgataatgccacaaaataatcgtggcaaaaaaacatattgcaacacttaacatcgttgcaacaaataattattgccaccacttcgtgcgtggcattagttgtgcttgccacaaaatagtttcgttgcaatatctaatatatgttattgccacatagcattaatcgtggcaatatatcatatgggttattgccactaaaatatttttgtggcaataagtattattacaatgaaatgaatttcttctagcttttatagaaaagaaattgtgttacatcagtaattggatggatcatttggtactattgcaacatgagtagaaatatatgttaaatggcaaaacccttgcaactcatgcgcacaagaattatgatgtctgatatttccgcgaataagacataatatatttcagatacccaaagtaatgatgacaatatgagtatgttaaatttccaaatgctgaaatacaagttgtctgataaaactaaaagttctgaaactaatgagtttgtaacattgttgtcgaaactagcttttctagccatcacttgtttgattttgtcgtggtttgctccagccattcaacagtaacagagttgattgttcctcctgtacaaatgtatggacatatagttacaagtcgtatttaaagtaaagaaagtcaccatgtaaaatgcagagctattttatctagttttctgctagcatgtatagttaccaaaacttcataatttcttcaaataaaggacattgccagagtctgcagtgcaactaattttagtatctaacatgattaaattgagttagaagtcatatgccataactatcatgccactgtatggacatgtgtgttctttggattgatggaaacataaacaaatgtgattagtgctcactatatctgacattttttaagccatgcccctgttatttactgacttgtgagacccactgaaatatatatgctttgttacatatgtggtggctatatatagtactgtgttgctaatcatttatatggcatgcatgcttatcttagttagctcagataaacaaaacaaaggtctatggggcagtaacagaagcttagatgccccatatactaataaactaaacaggcaactgtttttgtcagcaaaggggacgtgccaaatactaatacaatccaatgagttaagtagcaaaagtaccagatcattacctggatgctacaccaaaccccgagctgatttagatatttctttcattcattcttccattttctcctctggcctgttacaggatttggccatacacaataagaaattattttttttacaaacagaccatgagcaggaaaacatattgtaaatttttttgcaaaagatcatttcaacatagcagcttgctgaagatttgtaattacctgatcagttcgggaccgtacaaaatttctagcaacattcctaagatgttgtgaagaaatattttgccgggtagtacttgttgttccttgcaaattagcgccgttaaaaagtgctttcacaactgtgttgttctgaatgcttcgagccttctttgttgtgtcatgtggttctctattctcagttggacaatctattgccagatcagacttcacaccataaaacaagaaatatatatattatgattccacatttgacatatataagatatcaaatattggtgaatgtgaacattttggcaatcattacctgttgttccgatgctacgctttgcgtagtaatcattttgagaatatcctcccgtagcatttccctttccttacgttcttctgaatcttcccgtgacattgtcatcatctgaatcttcaccgtggtaaacccactgtatgtaactttcatcgaatccattccttagcaagtcactttgcacttcggagcgtgttttgtgcaccacattaaggcatcttctacatggacagggggcattatccccaggattatcatcttgaaatgcaaaatttaaaaattcctgcaaccctttttgccactctgcagttgccctactcatgcgcatccaactcctatctactgacatgcttcctgcttatcactatacaatattactaatagtatcaaaccacccatttaatgaaaaaaaaacaaggaaaatatggttggcactttatgatcttaaggaaaatggagaaactgtgtgaacataaactcaccttgccagaacttgtctctgtaggctgaccagaaaaaatattcctgtacaaagatatgaacagataaattagaactaaacaaaatcatgaggatttgagctgaaaaatagacattggacagtaacagatatattggtattcccatggaaggtgtttcttatttttcaaaattcatatgggaaattggacaaactgaagaaattaataaatatgagagaccgtgtatagcaaatttggatattgtgcagtataaccaaggtaaccttgtgggagacagaaattcagaaacaaagacagaaattcagaaacaaacataactcatctgagctattctacgctagcaatgctcgccctgcctgctctgcttgcctactaagatagctaatctgaagttctaaactactcactgtcgctgccgctgcggccgtcaccccatctgcagcaagcaacatcctttgctctatgttaccgagatacagggatacggatatggataggatacatcattttctgaaaaacatggatacgggatacgtctatatatgtatacaaaaataatatgaatttatgcctgggaaatcaatagcagtagtaaaaaaaataaatcatgtcttccagtctgatttctctctatcttctccaataactcaatttaattacctccacaacccattggatggcagctttgtgccctggcctacgtggtagtgtggtggcgatggcatagggcgtccggcggtggaggcagtgctacgcccagcggcggcggcggcagcggcgcgacgcggcatattcggcatccgacgatacacccggcttccgtcaacggcagcgctgcgctcggcttccatcgacggcggcggcgctgcgtgcaacttccatcgatggcgccgcggccgaccccccatctgcagcaagcgacatcctccggctccgcttcctcgtcgacgccggggccgaagccgaccctgtgtaccctcgcatccttccattgtagtggctctctcatgcgttgactgaaccctcgtcttccccagcgaaccctcgtcttccccggcggatgtggcgcctctagccaggcacctcgcttggatccctcccgcacacatctccggcatgttgcttgtggaactagggctggaggatcagatcgggatgaggaagatgaattggaggggatgcaggcgtcatccggtcgccggcgcaagtgaggcggcacagaaggcggtgagcgccgacggattgggaaatttggctagaccgtgaaaaaagaaattgtgtattcgaggaggatgaggggatgaaaacggaggatacctgaaggctgaaagctgaatcactgaacggagtggaggaattcctcgtgacgcggttgacggcggcaccgtcgcggtgaaatcaccaggcgctgctcctccgtgagactttggaagtcacgggagcactgcccagccgtgtgaatggaatagattagattgataaatagtactaataactgaactaactttttcgggagttaatcgatcttttcacgcgcccaaaaccgcgaaacacagaaatatttcgcgctaaattttgggaggttcggctgagtcgtggcaaatattgtgtgcttattgccacaaaaatcgaagtcgtggcaatagggcttgtacgttgcaccgatattttttttgtggtgatagcttagtttttattgcaacgatattttatttgtggtgataacttatttttgttgcaacgaaaataaaagatattacaacgattatacatcgttgcaacagaatatacttatttgccacgaaaagttttatcgtggcaatagtatgatatattgccaccaattatttttcgtggtaatactttcgtggcaatagctaatttttcttgtagtgtatttattttctttaatctctaactttagctctagattatatttcctttgactcctttaccgaacatctccaacatccacaaatacccttttcattcccgctcaaccatctctagagccgctcaaccatctctagagcacatgaaatatcaatctctctagagttaatacctttttcatttagagcttaccatacaaccagcaaaaccagttttatcttccaccaaatatttcccctttgatctctacccaaacacatgaaataccaattcttaatttccccataaccaaaaccttccctttggatctccacctaaatattcccatagtccatgagatatccttttcaatatccctctaagtcaatatacctatccttcagaagtttaccaatctaccactaattccgttcctataaaaatccccatccacatatatttctgaatccagttctatactcccacaagtatttcccctttgaaatctcgttcatctaaattatccattcaagatttcaaagactaccatttaacttgggccaataattccctgattgacccgactctttgttatatcccattaaccatttttatctttggggttaaaccagtataactccctttccgttggaatttaatttggatcaacccctatctaaacctaccctctaaaacctttgtcttcttttaatcgatccaaaatattatgtgttcaagttcctattttaatcaagccaccaatttgattcctacggcttgatttcctcctcggcacaagaactatactatcacaaataattgagtgattgctcttgtgctaagaaacttatttctaatcccttctattcaaaatccaacttcctttagccacaaatattccaccaagaatccataccacatataatggaggttaaaatcctatttattttacctccatccattttaccaccatcccaaaaatttatccaaagttagaaattaaattattgcctttctttccctttgatttttttaaaatattaaagaaaatctttgtgacaagttttgtatttggttcttattgaattctattggagcatgttgatccttattgaattcttttaaaattggagcatctttatttttatcctttttaaaatttatatctcaaaaataatatctttgatattattttaaaaatattttaaactcctttttgctttcaaaactttatatttaaattctttttataaagttcaaaagataccaaacattcctcttttaaattttatctccattaaaatctatttcaaaccttccattcaaaaattcccctagttttcaattcctttgaatcctattcaaatttcttgtccaaagttaaaaagtccaccaacctcttcctttagatcaatttcctttgaattctatttgaattccttgtccaaatttaaaaaatccacaacaatctatcctttagttttcatttcctttgaattctattccaaattcttccacacaaaattctcatgtttcctattcctttggaccaaaaatccttcattaggccgattccttctttcctttctttttcctccttttccttccacctctactctatcttgggctgcgcccggcccagccgagccgaagcccagtcgagccgcctaattctcctcctctgtgggcgcaccacggcattgtgccgccgccgccaccatgggcgtggccgcctcgcccaatccgacgcgcccccggccagttgcgccgccgtgccacccgctgccggcacgcaaacaccgtgccgccaccgatgcaaaccgggggcaccccgtgccgccccctaagcctaagccgccgccgccatagccaatccgcggccgccgctgctccgccgccatcactcaccgattcactgctgccgcccgctgttcccgtcgccgccactcgacgccgcgccacgacctcggttgcgtgtcgccacagccatcgcccaccgctttcgccgtccaatcgggagccgactcccatctcgccggctctcaccaaaccggctcacacagcgccgtgccgtgtgtaccaaaattgaacacttgattttgcaagtaccacaggatcactcattcaatgagatgagtaactaacagtagggaaaagaacaggaatacaataatgaagcatgcaacagcagatcaatgctgagccatttgcgtctggccggacgacgaccggcatcctatgaaatcgtacgtgaacatgtttaggttgcgatacagacaaattcagcatggagatgaccagtgatcatgagtgtttatatgcctggaataccgtaacaatactgaaaaaagacgagatcaactgagtgttcaacctactccatcgatgtacatagaacaactgctgaactgcccaataatttccaagcatgcatgcgtacatagggtgtgaagatattatcatgcaccctgatggagatatcttacatgcccctgcactggtaacgggatttgcagccacggccagtgtacctgtctccgcgaccagggcaaatagggttgcaagccgcacctctgccaagcggtctgtagacagtgttgccaccttgtagcacccttctttgcgggtacggcaccgaatccatctcacttagttcctccgcgtggcgggtgcgcttgccgccggccacggcgacgccgacggtggcgtgatcggcggtgagagcgccggcgccgctcaggaggagtaagaatgtcatcactacaatggaggagatgagcagtagcagtggcttcatcactggttattcggcgtttccaacgctgccaactagcaagctaccttagtccagtcctgtatatatagggtgtgtttagtttatgttaaaattgaaagtttgattgaaattgaaacgatgtgacggaaaagttgaaagtttatgtgtgtaaagaaaaagttgagaaataaaccatgccatagttgggcactgcttgcactgctagctagtagtaacaatagtgctgtatactctctccatctagttttgatagacatatttttaaatctgaaaaatttatttatgatagacatatttaaatccaaccacctatcttcttaatgattttctcagatttaatgtgcaactcttcattctttcatacaagattggctataatggacatcgagaaattaaatattaataactatcaggaagtattatactccgtatgatttaattatagggttagatggccattaggcgatgcatgcatgcatgcatgcatatttacatgcgacggcgacggccggccaaacggaagggtctggagctccacgacgactactccccacatgctgatgagcggtgttcttgttgcatcacgtacgtgccgttcgatgcgttatcattgtcattgtaccggccggtggcatgtttatgtcatgtgtccttgcacaaacgtacgggggtggttgtccattagttttctgggtaactagcgccaaagtactacctccgttttacgttttaggttataatatgttttagttttttaaaagttaaactattttaagtttagccaagtttgtagataaaagtagtaagattttcaatccaagataaatttattataaaaatatatatttaattattgatttgataaaactaatttagtattataaatattactatatttatctataaacttagtcaaatgtcaaacagtttgatttttatcaaagtataaacatcttataaactgaaacggatggagtattacagaacgtacacaacctaattagtatcggttggatcatacccatatcggaaaggttccccctcactggtatccgcactcgccccctctaagaaattaagaaccacatcgataccggtccgcatcgtctagtgcacaaccaaaactgattatggggggcaatcaatgtcagcctacataagagcatctccagcagggacactaaatatagcccctaaacagattttgggtgttgaggctaaaaaactcaatccagcagagcccctatgtcacgcccggaaattcactagtaatttccgaacttatttgtgcataaaatcctcgtccaggaatcagccgaggtacacaaactgacaatttaatatacagattcatcaaattaactaaaacgataagtatttacttaagaggcacttagtccccaccatgaagaaaactgcagcggaaaataaaatctagcgaagctccggctccactcccacaggcaactcaactggggtataagccagacgtcttctccttctggatcctttttcttcaactgaggttgattgattattgcaagaatgagcatatgacatactcaacaagccacacagcaaatatgcaagtgcacaaggataccaaaggttggcataatataggctcatttgcaaaaacagcatttagcaaaacatttaagacaagtaaaacagtagagtactttaatcattaattttaatcaacactgaacaacacgcccatgctgcacaggcccaaccattctgaagcaaccatacccggctgtacagatctaatctccaaaccaggagctaagcaaattattaccaggtatagcatctataattattgtgagaggtgtgagactaatcacgaaaaacattgttcaacccgcccataaccgcgggcacggctattcgaatagttttactctggccagaggtgtaccactgtacccacaagacacagccccacaacatgtcaccatgtgcctcagtaccaccacggtacctcggaaaggagctgtgacaataccccttgcacaacacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgtccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagttagtcataagttatcccaatagtgtgctactgtttctaagcatggctaagcaatcatatctaatatctagctgaaccaatatatatagctcaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatcggtgtgacttgccttgcaataatcggtcttcaattaatcttcttgaatacttccggcgcactcgcgaaccttcgcaacgacggaaacgacaagctatcacgcaaaacggggaaaaagactaataaaaaccaaataaacaatacatataaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttcaaatgaattagttatgaatttttaaagattaaatcggattaaaacctttatatggattttaattgaattatgacgcaataatgaattaattttgaaaaggaaaagaaggattattgcgtcagcggctagggtttgcggtggaccgggtgcacggcagcggttcacgggaacgaacggccgagatcaaccctatccaaaacggacggccgagatcgatcggtccacgaccggctcacgggagagggcgacgatgacgtcagcgatgacgtcagcaccggcggcggctcgggcggcgcaagctcaccggcgaacgacggcgcggcggcgcaaacggagagcaccaggacgtagagcgcggcgcgacgaactcaccgatgaccaaagcaacggcggaggagcaacggacggcgccggcgacgaggaagaagcggcggcaaccttcgggtcgacggcggcgacggtgctccggcggtcttcggcggcggcgaaggggcggacgaggacggcgacgcgacggcgaccacgacggcgaccttcccgagcgacggcgacggctggaacggcggcggcgcacggctggagcggcggcggcgacggcggcgcaaaagctcacggggctagggcgctacacacgacggcgggcgaaggcgagggaggcgatgggtagaggagagctcggggatccttttaaaggggctagcgagcggcgacggaggcccacggctgccggcgacgagaaggaaaggttggggaaaaacgaatccgaatcaaactcgaatccgcctatttccaaaggaaattgaccggagtttctataagagaaaaggaagaggagatcgaggagattatttcccctcaaaagattcggccggagaaggaaaggatcggccgaatttggaagaagacggcggcggcttgcgctagggtttcgggcggcggcggcttgacgaagacgatggatccgacaagcgggccccacctgtcagcgaccgaacgcgcgcgcgcggctgcggactgggccggactgggccgagggaaagagagagagggttttgggccggctttcggcccaaagccaaaagaagactttttaaaacctttttcaatttaaattattttttaaatgcaatttcatttattaaaaatacttccttagctcaaataaatcccagaaaaatctaggaattatagaattaagcaaagtatttaatgaaattttatctggcccaattttatattgagatttaacaaattaaaattagatcttctcttctaggcttttaaaattatttctaataattccttttaaacaacaatttataatttaaggatttttaaacaagaaaagctcttaacaaaaataattagatcattaatgatcaaataattactgaactgttctttgtatcatttaggaattgagctccgaaagatccgagaatatttcagagagttgacttaatcatggagaatttaataaaaattaaatccatccatgctttatatttaggaaattttatttcccacatttaacttcacttgtaaattaaagaacatttaatataaattctattaatgatttattaaataatttataaatcctgaaacgaaaatcaggatgtgacagccgagcggagagagctcagagcaagatacataaaataatcatttgcacatatggaattatagtgattgtaggtattaaagtgttaaggtggaggttggaaaaaataacatgataaaaccgtagcaaaccacagctacattcacttgcctctaatgaagggttggtatcatacacgatctgaaggaccaccacctaatcacaaacaaagcctcagaaaacacactcaaatatgcatatagaacagtaaataacatgcatctacggcctcaacacctcaaaacgcaaaaacaaggaacgccgcttggactataaacagtactgttgcttcaaacctttatatctcgaaaaataaaaatgatatgactgcaaataaatacattttgggaatctacagaatgagacctacaactttcgtgtagaacccatatttttattctgccatttagatgccctaaactgcaaatcaagacaagattcagaatctgcccaagaattcagactgccacacttaaaacagccatatctggagttctactcgcccaatcaaagtgtactttaccaatatggaaagctaaggaaaaactctacaatttcctagttataaactttcgcagcaaaaatcattttgatcctctaattggcgaaatacagagacacagcaaagctgacagcgcccagaaacactaatccaaaacacaacacctaatcccatcctctaaccctccaataacgacgaattacaaccctaaaacaacctataacctctgcacaggagagttaagcctctttggagaacttgagagaatatgatgggaaaaccaacccaccactcttcctgctcgtctcctcttcctcgatctgtttttccaatcagattcttgattagggctatggttcttggagatccatggagtagggttaataggggagacgtgagttccataggtgcccagggggaggtgtggcggcgtcggctgggaaggtgggagtcgcctctccctagggtattaggtgggggaggtgggctggactactgcgacgtggcccaaattgattcggcccaattccaaacatgttattttatttttaatttcagggtattacaatattggtcagatattgcaggatgcaaaggagaacgatgaaagtgaaaaggaggcccataaattggagcggatgttagaggaccacagaacgtcgttgtatccaggttgtgagcaggggcacaaaaagttggatactactctggagttcttgcaatggaaggcaaaaaatggtgttagtgacaaggaatttggtgatttattgaaactcgtcaagaacattcttccggagggaaacaaattgcccgagacaacgtacgaggctaagaagatagtctaccctctaggactggaagttcagaagattcacgcttgtccgaatgattgtattctatatcgtggtgaggagtacgaaaacctagaagcatgcactgtttgaaaagcactacgatacaagattagacgagaggatctaggtgaagttgatggacagccaacaaagaagagaatttctactaaggtgatgtggtatttccctataataccacggctaaggtgtttgttcaggaacaaggggaatgctagaatgatgcgatggcacgctgaagaacgtcaacaggacgggatactgagacaccccgctgatggttcgcagtggcgaaacatcgacagaaaatttaaagactttggaaaggacgcacgaaacatacagtttggtttaagtacggatggcatgaatacttttggagagatgagcagcagccatagcacttggtccgttatgatgtgtatctacaacctccccccttagctatgcatgaagaggaagtacataatgatgctgattattattcaaggccccaagcaacctgataacgacatcgatgtgtacctaagaccactggttgaagatcttaaactgttgtggaaaaaggaaggtgtccccgtgtgggacgaggacaaacaggaggagttaaacctatgagtgctgctattcgtaaccatcaacgattggcctacacttagcaacctttccgggtagtccaacaaggggtataaggcttgcactcactgtatggatgaaacaaaaagtacgtatcttaagcactgtaggaagtttgtgtacatgggtcatcgtcgattccttgttgcaaaccacctggtacggaagaaaggcaagcactttgaacataaggcggaccaccgtacgaagcctaaacatcgcagcgggaaaacagtgtttgctatggttaaagatcttaaagtagtgtttggaaaggggcctggaagccagcctatagagagcgaagatggtcacgcggcgatgtggaaaaagaactttatattttgggagttacccaattgggaattcttggatgtccgccatgcaatcgacgtgatgcacctcactaagaacctttgcgtaaaccttcttggcttcctaggtgtatatggaaagtcgaaagatacactggaagcacgtaatgatctgaagcatatggaacaacttggcgactttcacccggaaccaaaggagaaaggaagctattacttgagtccagccagctacactcttagcaaggcagagaaggaaagtatgtttgaatgcttggagagcataaaggtaccgtctggatactccacgaatataaagcgaatagtaagcacgaaggagaataagttcacaaacctaaagtgtcatgactgtcacgtgttgatgacacaactgctactagttgtaagaaggggtatccttccagacaatgtccgggcaataataacaaagttatgtgctttcatgaacgcaatttcgcagaaggtcatcgatccgaatagattagaagcccttcagaatgatgtggtgcaatgtgttgtcagttttgagttgatatttccaccttcatttttgaatataatgacgcatctgctttcaatacatgtttcctttcgagaggtacatgggcgttctgaagaagtatgttcgtaaccgtgctcgtccagaggcaagcatcgccaaggggtatggaacagaggaggtcatcgaattctgcgtagaatttattgaagaccttcgcccaatcggggtacctgaatcacgccatgaagggagactatggggaaaggggactctcggaaggaaagcaataatgacggtagacaataatttattccgtaaagcccatttcacggttatgcaacaatcttcattggtggctccttacatcgaggagcacttggctctagttcacgccagaaacatcggtaagtccgatgcatggattacacggcatcacattgatacttttcccgcgtggctatgacaacatctcatgggtaacgagacgattaaccaacaactggccttcctagtgaggggaccatctggctcgatcgcgacattccaaggaaatgagatcaatgggtacacattctacacgagagcccaagacatgaagagcacgaaccaaaacagcgctgtttgtatcgatgccatgggacacgatggaacaactggcacgtattacggtgccatcgaggacatatgggaacttgactatggtcctctcaaggtccctctgttcttgtgccaatgggttaggttgactggttgaggcgtaacgattgatgacagtgggatgacaacggttgaccttaacaaggttggatactcggacgaaccttttgtccttgccaatgatgtaacgcaagtcttttacatgaaggacatgtctagcaaaggaaagaagggcaaagggcttgatgagcctaagcgccacgtggttatcctaggcaaaagaaaaatcgtcggatttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtatgtgcggtcaaccgtcaccgccgatgtaatgccgtaattattgtgtacacgatataaactattttggatgtattgattatccatataaatcaattgatgtatggcataatttactatcattcatatgctacatttaattgaatatcattcatatgctaattataattaactagagaatttttaaaagtattaaatcattcatgtggcatttacagatgttaattagagtttttcacaatttaatttactatctttcataggctacttatatatgactattcgaatttttaaaaggtttaaatcatgcatgtggcatttacatatgttaattagagtttttaacatttaatttaatataattcctacgctaagtatatatgatgattacaatttttattaattttaaatcatgcagtatgtacatacaaatcttaattagagtttttaccaatttaataatatcattcatatgctaagtatatatgattattggaatttttattaattttaagtcatatatttgcttattacgatttatccacttaatttattacagacaaaaataatttttcgaagtaattgtcattaatctttgtaatttaaataatgttaatgcattaacttctattttagaaacacatatgtaagcgaaaataatatgcagtgctataatctttagtgccggttcttaaccctaaccgggtttaaaaagaatttagaaatagtgggaaaatatctttagtcccggttgatgattactcccggttgttctcatcaaccgggactaaagatcgagggctatatatattcctgatgcgcgccctcgtcttctccaccaacacttaacgttttcggccgatcgatctctctcagcctctctccttcgctgccactgcctagggcaaatccccgcgccgacgccgccatatctcgctgtcgtctcgagctcgtcgtcctcgccgccgcctccgcctcctcctccgccgccgcatctctggggtgagagccgccgccgcct

SEQ ID NO: 75591 - DNA, 1353 bp, Oryza sativa
acgacgggcctgacaggtggaccccacctgtcagcggcagcgagggcgcgcgcgcgggcggctgcgaactgggccggctgggccgaggagagagagaaagcggttttgggccgactttcggcccaaagccaaaagaggactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttcttttcaagacttttaaaattattttctagaaattccatttaaacaacaatttatataatttgaatttttagggtgtgacatgttggctatgagattcgatgccctaggtcttcccggagggtcccttttatatcgcaggtcaggaggtctccaagtaggactcggagacatcggaccctacacgatatagtggcgacccagtcctatatgggtaggaacctttccattggtggacttcgaaatgaatttccttaacgtattcagagaacgtccgtacacgcgccgatataccgtattgccgtatagcgtacatccaagggtagagggtataccttatccataaccctgacagtcttcgaggagtctagggtgttcagctaaggagtagtccattttcgctttgcaatacgactttaatgataggaaagaaggtggaaaggtggagtcgagagaaggttgagttaaggtggagtctcttaatgacggtgagtttggtgtaggctcatcgggtggcttacagtgaagattcaaatgaagacaattcaagtttggaggaccgatggatcggtatggtaattctactgcttctaggtatcatatattcgaagctggactttgttagaatatttgtcgaagatactagttctactaggagttggacttggagttggaatatgtcgcagggagtggagttagatttggactatataacccgacaatcctttaaataaagaagggcaccataatgtaaccatgtagtgtacatacgcaaggagaggatatactacaacagaaccattgtttaatgttgaaatagggacgatgtttgagacgctttatttgttgaggacatagtttaagacgctttacaggttagcacaaaattaaatcgtttagagatgaatattgagacgttttggaacgtctcatctgtacagatgagttttgagacgttcttattatatgcgtgtcatcgttattagacaatatataaatatttatatagagaaagacgaaaacaaacacactgatc

SEQ ID NO: 75592 - DNA, 3467 bp, Oryza sativa
tttggacaaaaaaacttgaatatttaatatccagtctcagattaaaaagaagagtatctgctacaggacgcatgtttgaagagttgcaatataaaaaaaaaagtgtatttaccttcaagattgttcacgtcaatgacttggttagtgcctgaactttgcaacccgtaggtgctgtgtgcgagcccggatgaaagcgttaaatattcaatatcaaatatattaagacgtatgtgcctatattaatgcttgtataaaagcgtttctatattttatagatatgcaatttacacgtctctagcaacgtcttatataatgtaggtacgctttaaaaagcgtctccataattttgagacggtgcaaacattgacattcctactatgctttataaaagcgcctcagttatctgtgggagacgaaataaaacgtcacgtctctatcctacaaataaaatgtctccgttgggttgttttgttgtagcgaggctatggacacttggtggctaggtgctatattaactagataaaacctcgcgcatttgctgcgggaattcggtatgataactttaaaaaaataacatgtagatagatagataacatcagattaagtaaattaatgtggtttatgataatttaaatttaattagtatatagattggtgattcaaacgtaaaaagtaagttggtatgactttatggaagaagaaaagtagggagataatttggaccgtataatcatctaaaggctaaaaacaattgatgtgatatgacttaattagaggaaaaaaggaaaaagataatttggaccatagattaatcatttaatcactaagtgaggatgaactatataagtatataggatatcataaaacataaaaagatatacattgaaacattatgtgaatgatgttggatgataatttaacatgtttgtagttgaaaagctgttaaattataaaaactataaagatatagcatgtttgcatgatgtttaaatgtgatgattgttaatggatgatgatgtagcatcttgttaattagtgaatgataatgtggtatcttgttagtagatgatgatatggcatctttgcatgttaagcttaaggagttagtgggagataactttatagtaagataggattgggaggagcgctcatgatcagagctatggagatatatacttcggctgcactttattaacgaatatttcgtgttcctatatcatcatctggtgtatcttgggtgatcattgactgaaatgatagggaagacacaagtcgtcgttccgctatatcggcaaacttgtacaacgtacggactcaggaaaacggaccatgtgaaaccctagttttacattccacttgttcaacgcatgaggatgaagagggaggtaccaccgtagggattcccttgcctggcagtagaggattgaaggatgttgaatctaccttaatgaatggctctaattacaggtaccaccgtaccaggaggtagcaaaggttctcatgactcatggacggttaaaaagctagctcttgcccgttatatggtcgtgtgggaacaatggatttctaatgttagccttgagaacccaacgatttaattattacaaagcaaaaaatatatcggcaaacttgtacagtgtacggactcaggaaaacggaccatgtgaaaccctagttttacattccacttgttcaacgcatgaggacgaagagggaggtaccaccgtagggattcccttgcctagcagtagaggattgacggatgttgaatctaccttaatgaaaggctctaattacaggtaccaccgtaccaggaggtagcaaaggttctcatgactcatggacggttaaaaagctatctcttgcctgttatatggtcgtgtgggaacaatggatttgtaatgttagccttgaaaacctaacgatttaattattacaaagcaaaaatagtttgtgaaacctggtggtacgaatatattgtatgtgtagcttgtctagctccatatattaacaagtgaaaagtgaaatcattgttagattaatgggctaggcccaattaaatcctaataaattccattggcccacattaagttctatgggtaataataccaccttagaaatctaagtgaagaggtctcaacttaaatacggagctagtggagagtctttgttgaccggttgagatggtgcgcggacaaccaggcggggcgaggcgaggcagacagctactgcgctctctcgttttgtaacggacggtaataaacaacggagaattgatttcgtatcaatgaacgcgtcggttacggaattaaacgtcgtgaattgattccgtcggttacggaattaaatgccgtgaattgattccgtattaacgagcgcgtcggttacaaaattaaacaccgcggttgatgactccgaacattaccctcgcgctcgcatatagatactccgcagcaaccagaaggacagagaagttcttcacgactcttgcacttcgagttcctcctccttttttcctgagctgcctacgcgcacaggtgtacaggatgagcaggtgcctccggaactccatccgcttgagaacttgcacgggtaggcgggcgatcaagtttttgggtatcgcttcaaacgcgactgctcttgttcttcgcggctactgctgctgcatcggtgccttcaccaagatgtcaacggagattggagacaagaagatgaacgacatcaacggaggcaatactgcctcaaaatccagcggtgggacgttctcggggtatactttcattctcccgattctattagatgtttctttgttaatactcttcgcaatggcagcattgcgttactttgtaaatgttgatgcttatttcatattaaacatactcaagttgtatatatctagcactgtcactacatctactcatattgcaaatgtcatgtttattgtcttaatattttggattaaaatataccgaattatgaccaaatttccaataatccaaaaacttgaccggtctttttcgatagttgactttgctgcatcactcaaaccagatgctttcgatggttcaaattataaaagatggaaagcacatacacttttgtggttgacggcgatgcattgcttctttgtctcactgggcaaaccgagtgaagcgcctctctctcctgaggaggaggctaagttcgaggcttcggattgcctgttccgtggagcattgtttagtgtactcgctgacaaaatagtggacgtgtacatgcacatgccttcagggaaggacatgtgggattctcttgaggccaagttcggggtttccgacgccaacagcgagcggtatgtcatggagcagttctatgactacaacatggtcgatgaccgttctgtagtggaacaggctcatgaaattcagatgctggcaaaggaacttgggaacaacaactacgagttgccggacaagttttactgatct

SEQ ID NO: 75593 - DNA, 7307 bp, Oryza sativa
cctaacccacacacgtggcgccaaaaccacagggggtcggggcgccccaaccctcgaggccgaagcgggagcggcccgacccctcggggagacagagggaggggtggccacgtcaccctcgggcccgacccccccgagggggtcaggccacgtgggtgaccataattacccaagcctctagtcactatacccccggccccatgttaccgacaatatgtctagattcattaacatcaatatgaatatgagacatgctagaatgacttacattatgaaacggagggagtatattgatagcaaatagtattaaaaggagaaataagaaatatagaaagcatcgactatagtccataacgcttatacaataaaacagaaggatctttaaaacagaaggcaatagtccatatacgaatagggtgtgtttagttcacactaaactttcccccaactcccaactttccatcacatcacatcacatccaaaactttcctacacacataaactcctaacttttttttttcaaactatcaactttccccaaacttctcctcaattttagaaactaaacacagctagtttaaaaaaaattagaattctgaattaaaaaattaataaaagaataaaagtagaggttagaggccttttaaaaatgcaaatttatgaatacgtaatatattttctgttgtgttgtggtccgtacaatttataaacatcctttttggaagaccgattcggcgcttagactcgtcacatccagtcaggccagatcggccgcgttaggggtaggtagcactggccctcggctagagatgcagcagctgcagaaactcttttcgcgccacgcctcaccaccgcactttcttttgcagtgaaggacttccaaacgatagacgacgaagcccttatgagcttttaatatcggatgcattgaccgcccaatgctatatactccctccgtttcaaaacaaagaaaaagtctaatttttaatatccaacgtttaatcgtccgtcttatatgaaaactttttatagagtaaattgtattggtggtatccaaacttattagctaggtacaatttagtacataaacttgtaaattggtcgttttgatacacgaacttatctaatccgtacgaactaggtccaaaatggcttggcaaggttatttccacctaacttacgttgattaggatgtggcgtgcatacgtatagttacataaaacatgctatatttataaatttgttctctgctttatcttaaatttcatatgtttctaacccttatatcattgctcggttttttatatctttctctacaatcactatatctcattctatctttttattgaacgtgtgtatgtctaagtagcaaccttctcatatatatgtttacgtatatgtttacggacggttcaacatcacatatggatttttatgactgcacttattttgaaacagagtaagtatgatactacagtgtagtgagctcttaagaaaaaaatgattttgcccggtcgaatgctctgcccgacacgctgacacgctgaatgcatggcattgtttcagttgcttttatgtcttgtgtcaccggagagctccgcgccaaatataccacgccgtgtcctatatatgagggtagggacgtcaaaacagccaggatgggtacgtaccttcatcccgtggtcacccatataaccaagtgatgtacaaatacacgtggatgcattgccactgcgtccgcagatagggtaggccaagcaggtacacgtgtcgccgcctcatctagggtacatgtgtgctcgcgtgcagattttccaactcatatatatatatatatatatatatatatatatatatatatataatctgacctaaaatttgattttcgatctcctacctacaaataagaagtgagaaaactccttccttcgaaagaaaacctaaatttaattccaaaaattaaaaatggatcattctattaaattaccaatagaaatttccattttgttccttcccacacacgtgggaacgaggagagaggcggggagcgtgcgattgcgagagaaagaggcgagatcgcactccctttatcaacagagccagaattcgggagatgggaactccaaattctgggtgagagagtaggaaatttgttggagctattttttttctgttaaaatctctcgaacatcagttttgggaatggattagagggactgttcgtgatactcttaggccacgtttaagaaggcctaaaatgaagattaagtagaagcacgccacaatgtgcgcctctccggccttcatccaactttgtaaatgaagtcgtggcccgttgatttcaattccccaatacagtactagacgttatactgtcgttaccaattttgcgggttaaccaccgccgatgctaatcgtccatttcacgctagtgttactttcatctcatgattatctctactttaacagcggagtcagacttccccactatcgtagtcagtactgaataaaagagcgctcccttaaaaaccaccccacccaaaaaaaccagcagcatttcaaagtgaaaatcaatccatagaaaaaccagatagaaaaaaaaaactgaatccaataaaaccttccgtcaatatttaccacaattctgttgcaacatacacgcatggtccaactaaaagttagtcgtgagatttacttcggtctaacgaaaagtctctcgagacgataccaaattatttttgattgttgaatctaacaatgttcatcctatctagctatagatacaacgattgaaaacgatttagtatcgtgagatattttccgttgaatcgaagcaaatctcaaaagttgcttatttctttttaagtagttgcccacttaattaattggttgctactcaccacacattctccgtgtttgacatggcaaactagcaatcagttcaacagtctgatcagattgtcccgcacggtccttcggcagcagcgcaagctagcgcacgaaactcataaacccctaacatttgtatcactactcccttcatcctacagagacttaatttgtttatcttcttcatttgtctaaaataaaagcactcccaggaggaagattatcccgttgttgactatgtgatggtatttcaagccgccaagtcgacaacggttagataagttatcccaaatattgtactggtgtgattatgatgaataagagcaacaccggctttcggccaacaggattagagctattacctgtcagatatgaggcccgaacctgtataaaaatctttgtctccatctcttttacttcaatctcacatataccctggtaccaacgatccccatactatagtcgtgacctgaaacgtcgacaacaatttaaaagtgttaactagggacaaatagtcccttatgcccttgtttatttgatcctattatactaaggaaaaagtacgaattacccccccccgaactatcgcggtcgtccgaatttcccccctgaaccacaaaccagatattcttcacccccaactatgcaaaccggacgaaaccccctcgacccaatccgcggtggtttggactacgtggcatacacgtggcagtccagtcagcattctatttattaaaaaatgtgggacccacatgtcattctctctctattctatctctcacacacactctctctctcctcccggcgacggcggaggcagcgagcgcggggaggcgaggcgagacggcggcggaggcggcgagcgcggggagacgagcgcggcggcggcgatgcgaggtgaggcggcggcagaggcagcgaacgcggggaggcgagcacggcgaacggcggcggcggccccccttctggcatgccgtcttccgtgacctgctcggcgacgacatcttcaactccgacggcgagacgtgggtcgcgcaacggaagacggcggcgctcgagttcaccacgacggcgactgcagcagcggctgcgggcgtggaccggatgctgtgctccggctgcgccgtccactgcttgctgctctcactagaacgggatcgcttatctgtgacgggctgaaagcatcatcactatcgggtaaggccaccgtcactgggcaaaggtcactgatgtgaggaaaaatctcaatcaggcaaaatcccgtcatggatggatgttatctcaatcgggccgaaaacaaagcccgtcacagatgagtatgaccagtcaaaccagcgtaataaggagcccgtcacggatgactaatctcaatcgggaacaccactaagcccgtcagggatgagtagtcatctccatcgggcatttagccagagcccgtcaccgataggtttgaccccacgtattgagtcagactagtcccagttcagacgacttatctctatcgggtgtattctaaaagcccgtcacggatgactaatctctaacgggcaggactctatagcccgtcacggatgagttatctctttcgggcattagctaaatgcccgtcagggatgagtttagaaaaaaaaaatttgtctttttggctagcctcaggcctttgctagccatgcccgctgcaaaaatgacagaagcatatatatacatagtcccattcccagcaaccccattcccagcatcaattcacatattccatcacagccatttcatatagacccattcccagcatcacatcagccaattcacattcatattccatcacagcacaaccaattcacaaaatcaaatacatatacattcacatccacaacccattcacatatatgtcattcacatccatttttctctccaaaccgccgacatgtatcaaaacctgcaaaaatatgttataaattggaacaattttatatgtaactagaaatgtaagtatatacagagacgagctacctaggattttactctaaagaatataattgtattacaaagaatatttacaaaaaccaaatgtttgtcgcatatgcattgtgaatgttctgccattacgagacgaaaaatatttcaataaaaacagccataatacttcaaccatcacaacccacatcaattcatccatcccattggaccaaaaatatcccaaaagttttgcaaagaaccaaaaacaagaacaagtgtagatggtctgttcttattgaaaaaacccaaaaatcacaagtgtatatggtctgttcttatgcattaaaaacccacatttatacctaaacaagaacaagagtgagaccggcccaaaaattcatccattttgcaaaacatcccatacttccactcccccccaaataaaatgaacaagtgtagatggtctgttcttattgaaaaaaccccaaaaatcacaagtgtatatggtctcttcttatgcattaaaaacccacatttaaacctaaacaagaacaagagtgaggccggcccaaaaatgcatccattttgcaaaacatcccatactgccactaccctccaaataaaatgaacaagtgtacatagaaaaacagccatagaaaaacagccataaaaaacataccaaaactcacatttcctccaaaataattcaaccatcacaacccacatcaattcatccatcccattggacccaaaatatcccaaaaatggtatgttcttgagcaatcatcactggccattcatccatcatagcccacaatatttcatcatcactgcccacatctaaacaattttcatcacatcccattctcccccaaattcacaaattcatccatcacagccatataaaaatttatcagtagctaacacatatagaaatgcacaagtcatcacagccatataaaaattcaccactaggtaacacatataaaaatgcacaagtcatcacagccatataaaaattcatcactagctaacacatataaaaatgcacaagtcatcactagctaacacaaaaattcatcactagcgcaagtcatcatacgtagacattagcatctaaacattgaatcaacgaataatcgcactatcacattatcgaatttaaacattatcatcgaatcatcaaatcatcacatctaacatgtacacagcaaatcatcacattatgcatcatcatcggtgaggagtacctaccttgcacggtggcgggctcggtgaggaggttgacgtgggctcaggaacggcggtcttgggcggcactgggctcggggacggcgtggagggaggcaccgggctcggggacagcagtcttgggtggcgcctggctcggggacggcgtggagggaggcggtggctgtcggggaggccggatcttgagcggccccggaggaggtagcggcgtggaggaggtcgacgcggcggctaggacaaggtcgacggccgctgggcgtagatatggagaggaggatgtgaggcggccgtggtcggtgaggccgaatcttcgagggaggaggaggcgacagcgttgaggacgaggaggcggcgacggtcggtgaaatggccgtggcgtcggtcttgaggactaggcggagaggaagccggcggtggcggtcttgggcatggaggacacggacttggagaggaggccggcggcggcggcggtcttgggcgcggaggaggcggtggatctgagagagtgagagtgtgggagagtgagaggcagcgtcggcggtggataaggacccgtggatgaggattgactaagtaaaccctagtcaatcctcatctctatcgggcagactactatgcctgatgcggatgacactcatccgtgacgggcgttagtactctgcccgatacggatgatacctatccgtgacgggcattagaactaagcccgatagagatggaataatctctatcgggcatagtactatagcccgtcacagatgacttattaaaatatttttaagttataaaaatcatttataattatcttctacccgatttaaaattgctattacatttgattatcacatataattaacaaatgtcttatttacatagtttaaaattcctattaattttttaaattcatataattgacaattgcctttctcacatatagtttaaaattcatattactttttttaaattcatataattaacaattggatatctcacatatagtttaaaataacaagtataattttttaaaaccacataattaacaaatccatttcttcaaagagttttaactggaatggcatgaaacatatgcaattcattcattaaggctccaatacaaattaaatacatcattcacagtgatatgccttccgaatggtctgaacgaacgtaagccacttcgtcttcgggatcatcgtcaaggtcgatctgaggtc

SEQ ID NO: 75594 - DNA, 6050 bp, Oryza sativa
cctctggcgagagtaaaactattcgaatagccgtgcccgcggttatgggtgatcaaccagatttaccgtgattagtctcacccctagtttagcgtaatgaactggtgtagttcaggtggttggttgggcttgttgcaacgtggtgtagcgttggacagtgattggttaaaattgattaattactacagctgttttactgctttcaactactggtttgaaatgcctgctttttgcaaaagaacacctagcttcctttggttatatcctgcatcatacctccttttccggtatgacttgctgagtacagtgggtagtactcagtcttgctctcttttcccccacaccagagttgaagttcttctcagatggagccgcctcagagaggttggtttcgtcgctgccgtcaaggtttgcctgtggagtggggtcgcccgctgctgaagtcaagcttcccggtttagctcgcttttatctttctcgctgcatttgtaatcttttatatttttgtaagacgtgggtctgtatgtcaacaaatgtcgtttgtgtaccctggctggtcctggacagggatttaatgcacaatcagcttagaaattctggttcgagaatttctgggtgtgacaagttggtatcagagccgaccttgaccgtaggacaagccaactggaaacctaagagccctctgaacccttttttttcatatgcatatgctcttttgcacttggatttgtttcaggaaaatttggggttttgcctctttggtttgtgggaaaaatcttggtcgttcattcggatcggatttttaaaattagctcagtgtagggttttagaaaaaaaaatctatttgggggttttaaaattagctcagtttaggtttgttgcttgtgggttagtcggcggtcgatatcatgtgtcagtggtatgactgcctcaattaggagttgcgtgcctctttttcagtgttttaatcaagattaagataattacacttaaattcataagcaagattagtttctaagccccctgtttttcttccttttctcatatttctccctatccccttcagatggagacaaggaatggttaacgggactccaacaatgccagtggcagcgaagagccgatcaatggagcacgtgccaacagtgcatctgacaacagtccgtccccatcgcctgagaacccaacaattgctcaggtgttgaacaatcagactcagataatgacaatgatgatgcaacagatgcagcaacagtaccatcaggtgttgcagcaggtgcagcagcaagcacagcagcagcagcagaacctgcagtttggtcctccacctcctcagtccaaactgttagaatttcttcgtgtcaagccgcccaccttctcaagcaccaccaacccaatcgaggcccacgactggcttcatgccattgagaagaagctgaatcttttgcaatgcaacgagcaagagaaggttgcttttgctacataccagctgcaaggccccgcttctgtttggtgggacaactacatggtgacccgtccagctggggcagaggttacttggacagagttttgtcatagtttcaataaagcccaggttcccgagggagttgtggcgcaaaagaagagagagttccattccctgcaacaaggaaccagaacagttatagagtatttgcatgagttcaaccgcctcgcgcgctacgcccctgaggacgtgcgtaccgatgccgagaagcaggagaagtttatgtctggtcttgatgatgaattgaccaaccagttgatctctagagactatgaggactttgagaagcttgtggacaaggctattcgtcaagaggagcagtctaacaaaatgaaccgtaagaggaaggcagcctagttcaggactccccaggggaagtgttagaagcctcgtttcacaatgggatatcagggtggaccttccaccatgattatccgacagcaccgtccctaccacccgggtagcttcaacaagaaccaccatagtggcagtcacaacaacagtgagtagcacagcctcaaccctactccgagttcactaaagattccagcccaatcagttcagccacctttgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggtgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagcccacctcattcttctcgaatccaaggacctagatgtcatacttggaatggattggttgacaaggcacagaggagtgattgattgcgccagccgcaccatcaagttgaccaatgcaaaaggagaggtggtaaccttccagtctctagtgccgcagaagccagggatcagtttaaaccaggctgctggtgaagaacaagaggtagcagtggagaaaaccactaagaagctagaggatattcccatagtcagagagtatccagaggtttttccggacgatctgacaacaatgccaccaaagagggatatcgagttccggattgacttggtacctggaactgcaccgatccacaagaggccttacagaatgggagccaacgagttggcggaagtcaagaagcaagtcgatgaacagttacagaagggatacatccgcccgagcacgtcgccttggggtgctccggttatctttgtggagaagaaagacaaaaccaagaggatgtgcgttgactaccgcgcactcaataaggtcaccatcaagaacaagtatcctttgccaaggattgatgatctgtttgatcagttgaaaggagctactgtgttctctaagatagacctgcgatcaggctatcaccagttgaggatccgcgaagaggatattccaaagacagcattcatcactcggtacgggttgttcgaatgcacagttatgtctttcggactcactaatacacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatccagcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattggccgcagttgttcatgctttaaagatttggcggcactagcaactacccgacgcatgatctagaattggccgcagttgttcatgctttaaagatttggcggcactatctcatcggtaaccgttgtgaggtatatacagatcacaaaagtctaaagtacatcttcactcaacctgatttgaatctcagacagcgaagatggttggagctgatcaaggattatgatatgggaatacattatcatcccggcaaggctaatgtggttgcagatgccttgagcaggaagagctactgcaatgttgcatgggtagagcaactatgttgtgaggttcaacgcgatttggaacatctgaaccttggtatagttgagcacggattcgtggttgccctagaggcacagcccacactggtggagcaggttcgcatagctcaagcaagtgatcctgaaatagcagagctcaaaaagaacatgagagttggaaaagcccgaggttctgttgaggatgaacaaggaacaatctggatgggagaaagattgtgtgtacccgaaaacaaggaattaaaagacctgatactaaccgaggctcatcaaactcaatatttcattcatcccggtagtacaaagatgtaccaagacctcaaagagaagttttggtgggtcagcatgagaagggaaatagctgaattcgtagcactctatgacgtctgtcaacgagtaaaggcagaacaccaaaggccagcaggtttgctacagccacttcagattccagaatggaagtgggaagaaatcggaatggatttcatcaccggtttgcccagaacgtcatcggggcatgattctgtttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaaaccaatttacttcaaagttctggcagaaattacaagaagaattgggaacccggttgaatttcggcactgcttaccatccacaaacggatggccagaccgagcgagtcaatcaaatactagaggatatgttgagagcctgtgcgcttgactttggtggagcatgggacaaaagcttgccgtatgctgagttctcttacgacaacagttaccaagctagtctacagatggcaccgtttgaagcactgtatggacgaaggtgtcgtactccgctcttctgggatcagacaggggaacgccagttgtttggtacagaagttttaaatgaggcagaagagaacgtcagagctattagggaaagattgagaatcgcgcaatctcggcagaaaagctatgcagacaaccgccgaagggagctcgctttcgaaacaggggattatgtgtatctccgtatcactccgctcaggggagtacatcgcttccagaccaaaggaaagttggcaccacgctttatgggaccatacaggatcttggaacgtagaggtgaagttgcttaccagcttgagcttccctccaacatgcttggcatccacaacgtgttccacgtctctcagttgaagaaatgtttgagagttcctgaggaacaggcaagtccggatcacaccgaaattcaggaagatctgacatatgtggagaagccgactcgtatcctcgaaaccagcgagagaaggaccagaaacaaagtaataagattctgcaaggttcagtggagccaccactcagaggaagaagccacttgggaaagagaagatgagttgaaggccgcccacccgcacctcttcgccagctcttccgaatctcggggtcgagattccgtttaaggggggtaggtttgtcacgcccagaagtttccccctttttcttgctttaaaaattggttaaataaattgcctgaagaaattatcttaattaacctagagctaactccataattaataaatgcaattaataatcggaaatagcgtggtggaatttttcttgagttccccatgctccaatgcattaacaagatttttagtggaattttcagagccttagaaataattttaaccaattaaaaatcaccaaagtgcaatatttaatcccaggaaaatccttctcctctttttctttttcttttccttcctttttcactagatgggccgtcggcccatctctctccc

SEQ ID NO: 75595 - DNA, 1033 bp, Oryza sativa
attcccagcaatagcgcagaaatacttctgttattttatggttacagagttcatccgcaagcgcacggatataccattgtagcatttcacccgagagtattccaagggtatcgtatttattttatcccgtgggaagatcatgtagagagaacttgactaataatttatatattagttgtgataatcatattctaagcaggggttaagataatccaagggtagagtgacacacaagctctagctactcattctcataatatattatctaagctaagcggaaagaaaagagagagaaaatctattcctatacttctaatgtacatagtgtacatacattctagttaaccgatatactagctaatatcctctatccgatgccctcctggtactttgagaagccacccctgactgccgagttccttatgacagcccgttatgaccatacaaccggagctaaatacgggggaataccctccccagggaattaacttaggattatataccggcgtggaggaatacccatactgagctgtcaccatcagcggtccacctctcatccgcagtatataatcccaaataatgatatcccgtaatctatacaccacgcctaaactaccagatactactctaatatcatcgtcatgacatagagtaattgcatatgcaaacattatacccgcaccaaagcatctcccagataagctagctgtatattcagtataacatgaacataatgtaaagtaggtactcatatactcagaaagtatttcaataccataaatgtatatagaagagtattctaataaaagtaaaaagcctacaaaagaggaaaggagagctactagagccatacccgaactcttccgaaggcttccggactcctgatttctattgtattcctattccaccagctagatactactaaactaaatttgagagaaatgagagagctcttgcttgaggtatgtgttgaagtgaagatagtgaactccttaaataggcaggtaatgatggttatggtggttggaaaggt

SEQ ID NO: 75596 - DNA, 711 bp, Oryza sativa
tagaataaaaatgtaataccagtaataaatatgtaaatattctttgccaaatatgtatatttatctatatatattattaagaaacatagaaatctttattattaagacaactcgaaaagaatgtgccatatttattctaaaggatataaattatcacgttaatcgaacaataaattccaagccgttagactgtggtggaaccaaattagaatggtgaagattgataacagaaatatatgtaatataagtgtatctttagaactaaacaatggtatatagaggagtaagtgacagcatttgatgaaacttctaaatattataaaaatgaaacgaaacaagataataaactctaaaaagtataaggtccaatttttaaaggtttgggactttagaaagtaaaaaaaacaatgataataaagttccaatttaaatcacaatgataataaagagaggagggagcatgcgagccatagaatagtacaatggcaaagccgataatggtttggtgggacttatagaaagtaaaaaaatgaactcaaacaataattatgtttgatttttagaatcctaatgacaataaagagaggaggtagcagatgggccgtagaagagttcagtggtagcgtttgatgagactttaaaaatataaaaatgaactcaacgagaaaataaactctgaaaacaaccaggtcctatttttaaagattcgga

SEQ ID NO: 75597 - DNA, 644 bp, Oryza sativa
ctcgtggacgatccgcactagctcccatgtattgaaatgtggcacattagctttgatcccatctactaattggctctattgatttgcgtgcacacatgacgcacgtacacgtacccatgcatgcatgcatgcatcctaattaatagttagttaatgcatgcatcatcctagctaattagtaattagttatatgtatgcatgcatatagccgaacttaattagttactactaggatgttaatgattcagctatatgtgatgtatgtgtatgcccgccgatgcgatgcatggtcgcgcatccgacgatccgctccggccgcctcctaactccaccgatttcctttcctccaacccaccggccgtcttcttttgtttgtttggttagcttaattagtccctcaacctcaagagacgcggaattaatccctctcaagttacttcttgacaggtaaatatgtattaatgttctctaatcatccttaatctctatctagctattattataggaaaagaagctggatccctaccacctcaaccgcaaccgcaccggtgtggtcgtcacgtctgtcggagtcggagcccaagttgcattggtgcgaccgcgagtccgaccgacgcactaatcttgcggcgaatgaccgggga

SEQ ID NO: 75598 - DNA, 5146 bp, Oryza sativa
cttgcgtaacattatccttagtttgttaatccacaaattacaattgcacttcatccaggcacctaactacataaagaatgcatcaataccacatgaagcataataaaaccatttgtgacaaggttatgttgcttacgaagtagaacattaacccatgcttaactcaaagcccatttgtccctatcagggaaaaggggcccaataaagaacccgctagaagtcttgggaacctttatatcttgtttgatgcatttaaagattgtgtaaccatatgtttggaagtacttagtagtctcttacaaaatcatataatcaggacgaatcaagtacaaacctaactactcaagtctatttccaaatattaaaactggcatgctatattgctattggttactggatgtctgatttctacaaatttattcattgacaagcgtgtgacaaacgagtgaccctgtaatggctggcccaacagcaacagatcaaattgcaaatttgcatgtcataaatctgtccaaagcagaaaaaatgacatctcagctagagatgccaacaggcaacagcatccgttatgtttattaaaatcagaaatcccaactttggttcttaagaaaagtttgttccccaagtctaattcgcaaacacctaaactatcaccaaatcatgatgtttctagtacagaagtgcagatgaatagccaaacagaattcagaatttcttttctcaaaactgaattcaaaatttcttagatatggatcccattcagacagaatttaactattgaggtgaacctgatcaccggagtgcaatgacatcgaaccagggcattcaaacttgtgcctccagagtcaactcttggagatccatcttgcaaccaccggtcatcagacaatcaaagcatcaatagtgatcacttggtctaccagccaccatcaaaaagcatggtttggatcactgaagtctgaaacacaaaccaatggagagaaatctcatcaataaacatcacattgcatattactaatgggattccttaataatgtaatgttgtaaactgagcaacaggcagtaactacaatcgtcctagggaagtaaaagtaaaactttaaaacgttgcaattaccaaaatgtgagcaatgcacaggatccgattttccactgtaatatacaatgtctataacttaatgaacacttcaaaacaaagataccaaggaacacaaaatccaacaaggcattgagtacgattccagaaaccaagagaaaaataatatatgcttgctgcaaagcacggtaatatcaaagtttttttttttagcaaacgtaaaaagtacaaaccctatcctacccttttctaagacaaatctttgcatcaaacgaacacatcaaagatcaaaatgtggctagtaaatactcctaaaacttcaaaaccaaatctggcagcacctaaaaccctacaaaaatgcatgccaaagcagaagattttacccaactccgaggcctcaaaacgagccaagaaatcaaaatcacttcgcataacgcaaaaacaaaagagagagagaacaattaagaaaccaccaaaaacgaagagagcaccgcgcgtaaactggattgcagcgcaaatcaaaatctcccccctttcaatctttggaaaaactgcacccgcaatcaaatctcatcaaaatcaagtctacgacgggtggagtgcgcaagatacagagcaaaaaacctacaggaaagggaacaaagaagagagattcagaaaatcggcgcaggtgaaggggaaacagggagcaattaatacctctgagaacccccgaattaaacccgtcgcctggagaacagcaaaaccaccacaagaaccatgtgaacaccagaccaaagttcagtttttttttgtctttactgctactactattctatctctttccctttctcctagtagtttatttgggataaagatcagagggaagaacagccgcagattcacattgctcacctcgcccacaaaatcaatcacagatcgaagcgaacacacgcggagaaggatgagagagaagcaagcacaggaggtaaaaaagcaggaggttactgtaccagagcagcagcatcaccatgaatgacaccatgcccaagaaaggaggaggagggaaaaaggccactgcttttgacgagatgagagcctcgagtgcgtagaaatcgcagcaagaatccaaaaaccgcctccttttttgcttccttttttctctcttctcttcttcttcttcttcgcggttcgcctcctctctttcccgcccaggcagctcaaaccaggactcactttcagctgctggtgttcttgcctcccctcctctcctctcctcttctactgctcttcaatgtgtcattattgtagtactagtactacctgtgctgctaccactttcatctcaagaagaaaagggagaagggagaagaaaaaaaaatgttgttaccgcagctgttacttgtatactgataaatacttcctgtctttgaccgggcagagagtactgccacggtctgctgctactgtgtaagggtattcctaactcaataactagatggtgtccatagtattaaataagttgttatctatgataaaaaataatgtggcaagtgaataaataagaaaaaaagaagaaaatcatgtgttgcatctacacaacatccaagacattatgtgagataagtaacattaaattaaagtaggaatagtggtgtttgcattggaagagtaatgtctagtactagtttttttgatgatgtggagttcatagaaaccatgtctagtgttatgggttgggactgccctaacgtactactacttaattccactaaacaaccaccattacttatgctaatctatacttgctggatttggatgggattttgcattccataagcataatgatgctaatcactgcctcagctcagctcagatggtggatctctgtattactgcaggtttgtagagcatgggtagagtaggggcctgtttagattcatttggaatggcaaaagttttggtggcaaaaattttggcattgcaaaagtactggttggtgtttagatgcatgttaaagttttgtcattctagtactaaagtgagagagaaaaagagagagggagtggtctcaaagcattttttggtacaatttgctagcaaataccaaatgccaaattgccaacttttactactaatgtttagatctaaaatggcaaaaagtgctataaaataacaaaacttttgctattttagaggatctaaacagggtctagatttgtttagtgaacacaggctgcgttgcacctggggtcctggggaggctctggcctctgggcgtttcggatttaattttctttgtttcttccgatacggtggggcccacctgcagcgcgtcgggaccgaggagatcccatcgtctcgtattcggaagtattcgtatggatcggagtaccctggagcttgcacacacaggtttgaaaatgtattacgtcctccatcgaaatatagaagtagtactccatcaatctaatatggaacttaacacattattttactatattaaggccgagtttagttccaaagtttttttttaaactttcaacttttccatcacatcaaaactttcctacacacacaaacttccaacttttctgtcacatcattccaatttcaataaaacttctaatttaaacgtgaactaaccacaccctaaatccggtactagatcgttatgctatgagacaaaggcaatactagtatggtttggaaataaaatgaaaattttcaaaaaggtcaaattttggccctctagctctaaactctcactccagtgggagcgggctcctatgagagttggggacaagctaaaaagtgtttgtctagcattcagctctagatctaaatagaaaaaaaaaagggaaaaaaagcaatccccaatctgaagccctaggttgccgtctccgtgtgtgctaccggctgtcggccgcgcgccatcgcccgccactggacacctcccatgcgccatccccacgtgcgccgtcggtcaccgcccgcatgccgtccccccaccaaccgtgcgccgcccgtggcctaccgcgcaccccaagccgtcgactatgccgcctgtgcgcctggccgggtgggagaggtgaggattatgggagggaaagagaggtgagaggtggggtagttcggtggcatttttatgtaaatatgttgaaaaattaaatggtagtgggtcttttagattggagtggaactgtgccgcagcaaaaatttagctccacccccgtattttattttttatgagtagcttagctaactccacttccaaaaacggaggatctgaactgtttggcacagctccggctccgggtaaattagagttaggaactagagctatgccaaaggggcctttctttgggacacatgaagtatatgcagtttttataaaatatattattccatttcaaaatataagagcacgggtccaataaattactcgtctatcctaaaaacccaatcttagaggatacacgctcatctacatgtgcgatttgaaccctggtgggtggagttaggcaccaaggactccaccatacttccggtgcttccccattttttttatagagggattatgtgtgagagagaaatgggacatatattaatgatgacgtgttgtgtagcgcccgttccgtcgtggcgcctagcgggaaaattatctcttaaaaaccctagttgcgaaatttgtttctttgcttgttgtctagtgtccgtgccatctcaagatctcaaatccccgatctatcgtcgagttcaattccgaatccaaatccttccaaatcaaattcctccgcaaaagtctattttgtctcccccagggtcgatgggccgaatttcctcccggctatctctctcgctctctctctctctccccctccccctccgctccgcccgcgcgccgcgcgcgcgtgcgcgtgagccgccgagccgagccctcctcttcgctccctcgctgccgctccccgcgcgtcgttcgcgcgcgcgcccgcgtggtcgtcgcccgcgtcgcgcctacgccgtctgcgccgcccggccccgctgctctgccgcgcctgcagccgctcg

SEQ ID NO: 75599 - DNA, 1389 bp, Oryza sativa
ccgccggaaaaattggagggggggaaaggtggccggttcgactgggctcccacacgccacgattgatgaataccccacgtgggagttttttcacatcgatctcttgatgacgtgtcaatgtcaggtgggtcccacacatgcacttgatgggaactaataaccagatggaaaaagtccactttgaccgaatctaatagccgaatctaattcgtacccctcaactaaaaaaggggataggacgactcctcgaactattgaaaaatcagtgtaatttaactcctccaagacagttaagtacaaattgcggagattcgcacccgatcggaaacaggccatacgagaagaactcgacaaacttctcaaagctggtttcatcagagaagtcatcaatccagagtggctcaccactccagtaatggtacgcaaagccaacagaaagtggaagttgtgtgtcaacttcaccgacctcaacaagacgtgtcccaaggactacttcattctttccttgaatagaccaatcggtagattcaaaagccagttgtgagctcttaagttttcctaatgcttactccggctaccaccagatcagcatggcaaaggaggacgaggagaaaacagcgttcatcacaccctttagtgtgttctgttatatgaagatgccgtttggattaataagtgcaggcaacacataccagcgcgggatccaaggagcacttggcgatcagcttggacgaaacgtcgaagcatatgtggacgacatcatcgtcaagatcaagacaggcgaataactgatcgatgacctaagggaaacgttcgacaacctctgaaaaaaaaagatattcgaagtcatactttagtatgatttatcactcacctgtagtcattgttaagaaccttcggttttcttagaaagcggaagaaactaatattctgatgtgctcagattcatatgtgacgggtgattagagaaggttctagttttagcaggattgagatcaaatgcagtagctactaggactgcacggtaactactgcacacaatctgagccctctatgtcaaaatctaacggccaaaacggatttggcacagtaaaatcagaacagtacctttccatcactacagtgttttgctacagtgctcggatatatctgggacgtccattttaaatcatgcgatgctagtttgactgcttattttgcagtcccactggctactgcacctgaatcggatccgttttagcatgcaatatgtaaaagtgaaaagaaaatgaaatagtgctttgttttataagctctttattggttggtagatatgctgcttaaataaaattgttacggtggtaatatactacctccgtcccaaaataagtgcagttttgcactattcac

SEQ ID NO: 75600 - DNA, 612 bp, Oryza sativa
aactgttatttcataacatattcacgaatctatttctccacaagacgacaagtaatttattcaaaactgtaggttgtaaaatgttaaatacttgcattcctaaagcctagaatttaaacctttggacattttttgcatgcatgatacaaagttcaaaccaatcatttgattgccacacagtagcgctgtaaccattagcatcctaaatctagcaagacatgattactaacccaaaatttgctaaagaagacaacctaatgcaaacggagagagaatggcgcacagctcagttgccagatagctgccaagagctttgcgccagcctgcgttcgatgacgtagccactcatcacctccattttcttaataattgataccgcattcctccttgatatcccacatttatcccagctaatgcaaaaaggaactttataactcgatagtaccttcaatatttgggcattcccgtctctgcactccatgccacagagcccacatataggcgccatcccaggcgcccactctccaaatacatcactatacaaggtcagcggcggcaaacggaatccgttctcgttgccccctcctcccttctcctccgcgaagtacgacg

SEQ ID NO: 75601 - DNA, 2078 bp, Oryza sativa
tgtttgagtatgaagttttgagtcttagttggaagtttcatattttgaatagaaaatcatgcaacaacaaaatacaagttaaaaacatgagcatccactaatacagaaaacatatgtgcaaggaagttcaaaacctatttacacatgcgtttttttaaccgtatgcaacttacggcccatagaaatcgaggatttacacatgcggattccacaacaaactaattttcacggaaggttgtggaatgaattaatatccagtttttcatttttgtggacgaataaaaactgaaataaatatttcatatttttaggcatctataaacacttgcaagtcgtgcgatattacgtgtgcgtgtggtatagaggattcgaacacttgacctcactctacatatatccttcttaccatctcacctatgacactcagtgattgtggggtgaatgttattcttttgacttctctaaaacttgtaacacagtctaagtgacatcaaatgaaaaagtcatcaactacaaatttgtgtagatctcatcgagctcaatactttggtaaagagaatctctatccaagctcactaaaaaactcaaacattcaaaaaaaatttcaaataatataaatgagagtttgtaacaaatatttaggctcataaatgatcttagatgaaaaaacatactcaattataaattgtagatctcgtcgacagctataatttcatataaagtttatcaccatccgactttatataaaatatctactccctaggttgttatatatccgacaaaaaatttaaaccctaaaaagttgttttatttaagaacggaggaatgtgattttttttaaattttattagtgctcatattttcacaaatggcagttttattaacagaaatgcccacaaaaatcaaactttacatgtttcccttatcagaactggccgtaaattcgccccttttttattggcagtttttcttaagaaaccgcccgcaaaaataggcctaatttggtaggcagttttcctaagaactcatctgtaaaaataaattttcgcaggtggtttatgacccttagttggccttgcttctatagtgagttttccttttgcaccacatgtgaaaaagcaagtcaagggcctacaaaaaacattttttatagtgcactgagtaggaagtttcgatgatctgagttgaaactgtaacatattgaatttttgagattttagattgagaattctaaaatcctattggaatatattaactcggatcagctcgcatttaggtgcgaaatgaagtgtctatttgtgcactaggatttcaggaaaaacaaaacgtgtggagcgggaagaataaagcacgtcaatgcggtcacccattagcttatctaaaagaataaaggttcgggggatacacactacacatagaattcagatgaattgcagtcacatgcatattcatttaccactacatgaaggttccactacaccaggatatattgcaaatggtatttcactgtcaatcaaacgccactagttcttccaagaaacgaaaatcaagcaccaaaattaccataaccttgtatacaagtcagtcaaacactactccaaaaagcaatatacacgattgtttttttccactccagagcacccaaacatggcagtggcaaattccatttggagattcagatgcatatggacggagatggccaatagcatatctccagtaacgtccgctcagtggtggccgtgaatcccctttgcagttcttttgaataaaacagttcaatgcaaatgggttgacacatatatgatcaaggtgagcactttctgtaacaaccaggtgagcaatacatttgacaattaaaaggatatttttatttatggcatactatgtcaaattttgttttatccctagaagaaaacgcttaatacacactcaaaatgaaagtagaacaaacaacaatattaccattgttgtttgcttctaagctcttgctcagttcaccggatgggtattattctcgccatttgcacctcaactcctcaagcttagaaagtaattttagatttgtgacaggtatgatc

SEQ ID NO: 75602 - DNA, 3136 bp, Oryza sativa
  unsure (1)..(3136): unsure at all n locations
tctggtactatgctcatggtgtaacgctcaacccagtggatggctccttggtcttcagcgatcagatacgcgaggctgcgagtcgactaatggacgcagtggaagcctcttctcagggcacgttccgacccgacagagagaaggacgagctgtcactcgccctacagactcccgagcatccaggacgaacacgagggaaaggcgtgattccctggaagatgggattcaaggaggacatccacacgtataggagtcggatgaggagcaagagagataccgaggcgaagattgcagatcttgagtacagggtatcgagctacgagctcagcttgcaagaggaggtggcccggaaggtggatgaacgcatggcagcacatcgttcacacgatccccagccgtacatacatcctccaatggtcagcccatcaggcaatcgtagcagctgcgcctcaacggggcaggtagtatcacatagcatggacgccatgcaaacccaggacgaaaccacctgccccgttgatgagatcacgcatcggacaccatgtgagctgcatattccctttaagaacttattaatcaaggtatgctcgatgtaatatatgatttttggattcgtacgttccgcaagttgctgcttaggttgattactaatagataacctctcatcacgtgaaggtggcgtcgggaatggccatcccaacagacatttcagggacttaccactgcaggccgattccagcaagatactcgagggtcgaagttgagctggtgaaagccgtgtacgaggacctcgagttggactacccaggaggagacggtgagacgcatctacgagacacaagccacgccattatactatggcgcaagcggtacatcatcctccctgggcgacaagcggcgtctcgtgcaccatctcctccggctccgccgtctcctcctgcaccaactcctccggctcctccgccacctcctcctgcaccatctcctctggctcctctgccacctcctcctgcaccatctcctccgcctcctccgcctcctccgcctcctcctccaccgtgtccgcctgcacctcccaagacaaggtctcgccaagctccacctcctgccagcaaaagggcaacgaagaaggccaaagttgacaccaccaaaaacaaggagccgctgtacggttgcagtcaagaggagcttgacgcttatgtggcaggagaagtgaagaggcaactcaagcctcggagtcctgaaaagaagatacctattgacctgagcgtgaagaatttcttcaagggaatgtccaccgcaaacaaggaggccttaaagctatcggattgtgaccgaacacttaggaaagcctattacaagaagtccaaaccagttcctcagcttggagaacaaccacaccaagtggtcgagccgttggtgaccagcgaagactttggcataacggatttcatttcggacaccggtctaaccatggctcagttggttggagccgcaccaatcccgaaggcggaagtggcatacaagtttgaactcggtaaaccgcttgtcagacctgagcagctgcagtccctacgnnncaaatgtacaaattccatgaacggtacatggaaatgagcgccaatggtagagagatgttcggagcgaggatcagaaaccccgacttcttgcaaggagaagatgttctatggatccatttcaaggatgtcttcgatctgtaccatcgggacaccctcgacgtctctcttctaagcgcatggattttgtaagtatcttggagttcgatttgtttcgttcaataattagctcctggcatatatgtaagcaataataatttcctttcattgttgtagaatggagattcaaagggcccgacggcggggagtttacgatactgggttcatcgaccctcggaaaatcaacaccgaaatgctcgacaagtacgagaaagacacagaggacaatctcgtccatctcctaacgcagcagcatttcaaaacgttcatactattgccgtacaacacagagtaagtttttattgtcgttcgaacaaattttattcccatacatataacatgtacattctgatatttatctcatctcacgcatattctagattccactgggtcctgttctttttcaacttggacgcatacagagtcactgtgtacgactcaatcaataaggaggagaaggttttttacaaggtcttccaactgatagacaggtaatataatgccatctattccaaagtcgcgggactctgttgctattatgttgatctcgggtaatatttaattaatcatagcttgcaactgcccatgtagggcttgggatcggttccgtcaattggtccgcgggacttggaaagaaaaacttggacggaggtttcattttccagtgagtacatgcatgatctaaaattatattgaattgaatctctagttacagttaatataaagagtatattaaatctctcatcgtttctcatgtagtgtgcaaagcaggacaagggaactaatttatgcggctactacgtatgcgagtatgcccactgcctatcaaaccaaatatacaccacacgagagctcgatgtacgtatacttaaaccattcaaaatttcattgcgtatcgatttgttaagttgtttattaattttatatattgatatgtcattatttttcgaatgatagcgtattcacatgagggaaaaactcccacacaaggattttatcacggctgttcaagaacaactgatggggttcatcaacgaagaagtccttaatcccgatggtgaattctactacgacggatcgacaattcgtaacgtcggtccttcctcttctgacgtaacgcaggcatcgaagtcgtagctatagctagagagcaaatgaattgtactatacatgcatgtatatatatatatttatatatgtacgtatatttactttagtgttaatatatattttggtaacatatatgtacataaaatgttaagtgctttaaattataaatatatgtgtaatatatgtatttatacatatatacatacgcatatatatatatatatatatattatatatatatatatatgtattctatatacatgcataatatatatattacaatgcatata

SEQ ID NO: 75603 - DNA, 4477 bp, Oryza sativa
aatttacttgattgtttcgtcctgacaaatctgcatgcttttggtcaacaaacctaggattacttgacattgactcatataaaccttagcttcttctcttctgtgatgtcacattctttttggggtggctgttgtttgttgtagctgattgtagatgctatttaatacttctgatggttgtcatattccatatattctcttcatgttacttttttgttcatgcttatttattttctttatttttggatgtttgctgatgcatattaattaatggaatgctaacttcatttcaggagcttgagaagttaacacaaaagttcagtgaaaatgtgctggatgcaactaagaaatttgagaaattaattactgataagaatgaaattgatgggttacctgccacagcacttggcttagcagcacagactgccgcgtcaaaggtatataagctataaacaccattattgaagcttaaaagttctctcttgattcatcacactgacaagccattttgttagggtcatgaaaatgcttcggctgaaaacggaccatggatcatcacattggatgcgccaagctatattgctgttatgcagcatgcacggaacagagcacttcgtgaagaagtttatcgtgcttacctaacccgtgcctctagtggcgaccttgataacaccaatatcatcagtcaaattctaaagttgaggctggagaaggctaagctactcggctacaagaactatgctgaggtgcttgcatttgtcactgtttccacattaaaatcatgtatacaattatctaacttttctaaactagttttaaatcctgaaggtaagcatggctcagaaaatggcaactgttgaccgtgtagaagagcttcttgagaaactccgtgctgcctcctgggatcatgctgttaaaggtagccaatcaaattattgagtatcttctttgtatttctcttgtgttatttatgtatcatctttgttttcatacatacctgtcttagtgtgagcaaatttttgtggcatattctataaggagtaggcatcttttgaggttcgaatatcttagctgttggtttctgtgtgcagatatggaagatctaaaagcctttgctaaagagtctgcttctccagaagccaatgacctggctcactgggacctaagcttctggagtgaacgactccgggaatctaaatatgatatcaacgaggttctttctttgctctctagaaatgtttaatggatttcttatgatcagtactgttttgatggctaaactgtgatgggttactgcttttgtccatatatacgttgagctgaactctattaaatgtgctcctgttgcgatgatgggccattgagttgatttctagcattgctactgcaggaagatttgagtccttactttgcactacccaaggttatggatggcctcttcagtctcgcaaataggctctttggtgttagcgtagagcctgcagatggactggctcctgtaagcagttgttttcttttcttcagcccactatatgttaatgttctgcagctattgaccactgagttacctttttcaggtttggaatagtgatgtcaaattttactgcgtcaaagattcttcgaatagccctgttgattatttctacttcgatccatattcaagaccatctgagaagcgtggaggggcttggatgaatgtggttttttctcgcagtcgtgtgcttgctcgcaatggttcacctgtcaggcttcctgttgcccatatggtgtgtaatcagaccccaccagttggtgataaacccagtcttatgaccttccgtgaggtaagcaataataaatatggcaatggtaaattattccagatagtctccaatgtatgagtattctgttacatcaatatgtggaaaactgtacactaaagtactgatgagagcatcagtaattatcaaattcacctgaagattgtgacacacctgcttccatatcaattaagtagtgctatactgattatgagggtaatttcttttttttttggcatgtgtcttttgtaggttgaaactgtgttccatgaatgcggtcatgcgctgcagcacatgcttaccaaacaagatgaaggatttgtttctggtattcgtggagtagaatgggatgctgtagagctgccctctcagttcatggagaactggtgctaccacaagtaagatggatctgtatcattttgtttttttaacttgtagccttgaacctgtttgttaaacagttgttttgttggtgccaggaatactcttttgagcattgcaaagcattatgaaacaggcgaacttcttccagaggaaatttatgcaaagcttgtcgctgcaaagaatttccgtgctggcaccttcagtttacgtcaggtatgttttatattttatttttgtctgtattgtgtataggtcatggtcacatacacacatcacactaatatctaacaagtgtatgaagtaatttatgcttcctttatgcctatgttctttctaaatggctaatccttgccatcccttctgcagatacgttttgctagtgtggacatggagctgcatacgacttacgatccaaatggttcattgtccatatatgatgtcgaccgaagagttgctgagcgaacacaggttcttgctcctcttccggaggataaattcctgtgcagctttagccatatatttgcaggtttgcaatgctttaacctacatgtacattcattcatttatttgactgcagatctcactattttttttattgacaatctgcaggaggctatgcagctggatactacagttacaaggtatattgctgtaaacgtttaaaacattacgttccttctgtggcatatgagtatgctgaaactagtatcttttctatgtgcacagtgggctgaagtattgtcagctgatgcattctcagcatttgaagacgttggtttggacaatgagaaggtacagtttttcttgttttcccccatccagggaggtgctctggatgtgtcaaaatgacttgtttagtagtcattttcttaacttaatttgtttatttggccaaacgtatattttgccctacaaaacaatgtgtggcacatagaatacagaaaggatataaaaatcaatgatattgactctagctatgactttatctaggcaattgaggaaactggcagacgattcagagaaacagtccttgcgcttggaggtggaaaatctccactcgaggtaggcttctggtgcctttgacagcatctcttgacatggatgctttatttgtgcaataagcgtatgtaaagggcatagtttgcactaacttatgtggaataagacgacgtacgctaactctggaaatgaaaatgcaggtgtttgtgtctttccgcggacgggagccatcaccggaagctctgctcaggcacaacggcttgctacctgttgctgcattgtgataactcatgctcgattgtccccttcttttttcttttaacttgcgaaaacggcttgtaagatgttattgattgatggcatatcagcaacacgctaaaagtgccgtgtcctgcttacaacatgaaaaacaagttgctgtgcacaaccattatataatgatcatcgctgcttcttgccgttcactccgttgtttctctctttaacattgtggtcttacacgatacagatttacaacaatgaactaatacgtttcttgatttatgaggcacatatcccaccggaagagtcactgaatcgtactccctccatccacaagagctgtacgtataatgtttgtataatgtttcttagtttttccacaagagttgaacttattttgtttgtgcctcgatgaataaatggatcggaggagttagtgttctccttggtcatagtgaaaaaagagttatacgtacaactctcatggatggacggatgagctcagcgtctcagtcgaatctaaaaattgacggaggaagctgagagacggacgggagtcagtggtgggcgagcatccgctccagctgctcggcgacgtctatgatccacgcctcgtgcgaccggtcgccggcgacgaactctctggcgacgccgtccacctccaccatgctgcaccctggcaccttgaccaccttcctctcctccatccccctccgcacgcccaccacctcctcccacttcccccgccccgcgtacaggttcgacagctgcacctgcaccccgctgcggtcgtccagccccagctccgccatcatcgccgccacctcctccccgccctccgtgtccccgcgcgccacgcacgcgttcagcagcgcccccagcacgtacgagtcgggcctcatcggcatcctccgcaccacctccagggcctcctccaccatccccgcccgccccagcacgtccaccatgctgccgtagtgctccacgccggcctccatgccgtgcaccgccgacatgctccccaagatctccct

SEQ ID NO: 75604 - DNA, 1261 bp, Oryza sativa
agctcaggattatacctgtatggtctcaggttgactggttgagccccttcaataagaggaatcttgtggtcacaatttctacgaggtggcaagttcttaggctctgcaagcacatcctgatagctttgaaggacttgctgaattttttcaggtatgggaaattcttcctcatgagtagtctcagctatcttcaccaagtacattatagctccagatttagccattcccaccagttgctctatagaaatgttagcataggtactactttgcttcttaatgccatggagcctaatcaactgattctgatattggaactcaacccatttttgaatccaatctatctgcataggactatgttgctgcagccaatccatgcctaaaattatatcataacttcccagaggaatcaacttgaaatcatttttgaagctatgaccttgcatacaccaattacagccaggcagaattttagagcaaatcaactgtcctccatctgctatttgtaccttcagggaatgctggaactcttccactccaatcattttcatgccaacttgctcatcaatgaaagaattagtactaccagactctgtcacatttgctgcttgttgagaaattgccatgactattaaatcctccttctgtgtcgcagtttcagcagacaatatttcttcagtgtcctcttgcagaatatccaggagctcatgtactacatgcaactgtacagaaggagagcatttgtgatcttttccccatctttctccacatgtaaagcataaccccgtagatcttctataagatttcaatgttgcaagtctgtcctcttttgtcttggcagattcagctccctttttctcctccccttgagtaacctagttgttccttgttggagtggtttgtaaattcacttggaaattcaccttgtgcataggtctcagataattggtacagtcactcctcctgaataccccgattttaaccccttccaacgcttcctcctgcaagagagccactaagctggcagtatccatgtcctatggtctatgaataatcactaccctcctcacttcatccttaagtccatcaataaatttctgaacaaaatacacttgaggaactgactgttcataagccaacagcagatgcattagggaatcgaacttctccacatactcagctactgtattagtttgtctaatgtggaaccattgcctcaccaaagcttcctgcctgtccctagtaaagcgagcacatactcttt

SEQ ID NO: 75605 - DNA, 6365 bp, Oryza sativa
ccgccctgttggggcgcacgcgggccctgagcatctcctggaacacgtcgacggcctccgcgaagctcccggcgccgacgtaggcgctgaggatggcggcccaggcgatggtggttttgtggggcattgcgtcgaacagggcgcgcgcgtggtggaggcgggcggccctgccgtaggcggtgaggagcgaggtccaggagcagacgtccctgcaggagacgttgacatcgaagacgcggcgggcggagcagaggagggcgcaggaggcgtaggcgtggatgaggccgttggagacgtaggcgtgggcgtcgcaggcgacgaggatggcgagggcgtggagcgattctacgaggacgcgcggcgaggcggcgtggggaagaggagcgagggaggcggaggcggtgaggaggaaggagaaggtgtaggcgttggggaagaagggattggtagcgatgatgcggcggaggcgcgggaagaggcggagggcgcgcagcggggagtgggagtgggagggcgggaggagggagcggaggagcgagttggggaagaagcggtcggctaggagcgaggagacgaccaggtgggcgtgggcctgccggagctgcgcggcggtcagccaagggcgggacagtagcagatgcagtgccgccggcggcgccaccatccagaccgagccagagccagcaaacaagcagctcccctgctccaggtcgaaggaaaggaaatgaaagtagtgggggaaaagaaaaactgggccgaatttgttcaagctcatgtgcgtgggctaactcatgcatgccggcccagcccaacagatgccactcggagttgcgggagaatgaagatgaggaggggacgacaccagcacgtcacgtcacgagcagcagcggcggcggcggcgaggaggagtagagtaggtgaggtgaatcgggggagggaggaatccaagaagaagcaggtaattaatcgatcgatcgggagggggagatggctcgcgcgggcgggcatgggatggggaacccggtgaacgtggggatcgcggtgcaggcggactgggagaaccgcgagttcatctccaacatctccctcaacgtccgtcgcctcttcgacttcctcctccgattcggtccgttttttctcttcctacctcttcctccttatccttcccataattcctccatggacctgcactggattcacatttatttctgcttcctctactcaggcatagccacatttctctggatctgcattaccctttttcctttctactactagatctgccttgctccttccctaactgggcttccacatttccattagtcttggcgacacagctatgcatatgcaccaaccaaaatttcatttccactctccctgccttccacaaatgtgctctacctcacccatgtacactagtaccatcaactctaaacccattctgcctcccttctaatctgaacttgtttctgccattgtcaacacagtatctataaatcaagcctttcttctgcccttccaacagctgccagcgtcacaccaaacaaactaacttaagcatattcggaaattcagttcagtaacggtgttactggatatagacctttaattgttcttaaatcttttctacgatatgaattctctggactataagcttattaaatcaacgttagttaagcttccattgacaagacagcatatttcctgttggccagccaactactccagtgactatgttctagtcagtctgatttgcacaattgtcattatctaaaattttgcataattgtggagtagttgttacttggaaaggagggattggcttggtgcttttccaagccctgtatgcttcttattatgtccattaaaccactgtcaaaaacaaagcttgaaagataccttgaacattactgtgcagaatatatgtgttctgtactttgccctccgtgtatacatttagtccagaatgcatattgaaccttttcaatatggtccggattaaggcactggtaactatcataccttccatttttgctccaaacaagatgcattcacaacataatcgctccatgttgattaggaactcgagcatgtcagcaaaacagagtggactgggggtagcatatcttatgcatgcatgtttattcaagttaactaatatgcttacacaggtttgtatgcatttgtgcagaagctactacgaagagcaaacttgcgtccttgaatgagaagctggacatcctagagcggaaactggaggtgcttgaggttcaagtgagcagcgcaacaaccaatccatccgttttcaactagtaagtgcagttaagggctgcttgtctgcacataagtagtgctttcaatgtgttatgggttcaaaaggacagagctttggatgtctgtattgtgggtgcaagaggagaggttgttcctgtgtgtttctctgtctgtgtgtgtgtgtgtgtgtgtgtgtgtgttaatctgtatgcagtgccagtagcgtgcaaggcagcttcttttctactcaattccatgtacaattgtaacgtgttccaagtttgtgtggagataactaaccgattgttgagtgcaaacctgcaatgttgcctgcttgcttgttggaatgtggagtttttcccttgtaaaactgtaactttttaggggaatattgcacgtttgcacgcagtcggacaaacgccggcccgaattttttatttatggtaattattatccttgaaattaaataagtagtaaatcatggaggggatttaggaaaatagaatggacgttatctactaggacatccagtgatggacgctgctgggaacaacgtccgagtgtggacgctcttcctaaccacgtcctcccatggtgcagcctagcagcttcttcctgtatgtcttgactgccgcggtgcttccttaccgcactaacgctgcctctagtgatttgggcaggcagccatccaggggtgtggcgtgtgcccttctcatatgctcgcgtcagggataggtaatggcgctgcagccttttcaaatgtacaggggtaagacaatcgatcgccatccacctcaagatttcaagaagagctacgttacttgtagaagccagcgttatgtgtggcacacttacactcggtgatgacatccccttcccccaatctcctccattttgtaggcgccctcgatagattttcgtttttcttattccaaagtgaatccattagcaagattcgtatatacgtatatgttcatgtgctgcaaaactaaagcagatcaactgactatttgtctattatgcacccctattacatgactaaacattaacttgtatgaaacatgtgttcctagctatatatgtccgcatggatgctattgtcaggttttcttactacatgttagtttggtattttaatttggtttacgacacccgtgctgctccaaatggcacatcatcattgttcatgataagccgatcgatgagcatagtcgcttggagtgatggagcgaggacagcgctgccgcgatgaattgatagaaggagaggagagcttggacctcaccgagaaagcccacgactggtctcgccaggccacaccgccggagacacaagggatgtgacgaaaaacaacgagggcggctagttgcggcaagcctcagcggcgtactgagactataaaggtcacgatttgaacgagagaggaattacgaggactgctgtaggcagcgaagcaagcccaagcttatacgagagtctagctagtcggcgatggagcagcatgcaggtcgtggacgccgttacaaagagcgtcctcagctggacgttgttgtgaacaacgtccatacatggacgtttcacaaaacagcgtccttcttattttcataaatatcagtttccatttactaagtatttaattctgagactattaattactatagtaaacaaatcgggacgccggcactgaccgaacggttggtgtctctaaaatgtgtatgatcagcctgttaagtaatccacactttttttttcttttcccttgaaggagagcaatttcttatttggggaatggcgctattatcatttgaatatatacagcaaaaatcgggaccataaaaccaaaataagagaaaaaaaagggtaaagaaatcctggaaggaatttattgggaaaaaaaatgtggtgctggtgtttcatccgtcttgacaaccacataagagaagccggtctctcgctgtctgccctgtgtctcgctagggacctcacaaaatgaggagtggtagaatagttggagcccacaggccgcttctcttctcttctcctgcttctgcttctgcttctgctgcttcttctattcgaacttaccttcctcttgctcagatcttcttaatcttccttcttctctcatctttcgtattcaaagctgtaaatgactgcaggccgaaggtaggatccagcaatattttgctccgatcctcgcaacatatattcttgtttcaaaggtaattaattcgttgcgattgtttcttaattactccattaatttccagatactatatacatgcttgcttgctcggggatcaatataatattccattatatatgtttgaaagagggagttctctctcgctcgcttaattttgttgttgatgcagttgctcatcaatgaatgaatcaatcaatgggaaaatgaatgagttattcgcagtggcaggtagggcgggggtggcgatgatgaatatggtgtcgagcagcagcatccaaccggggcagatacatagcatatggcagcgacgacaaggaggtgagagtagagggagatatgtggtgatgagcagcggcagcgtcaggaagagcagcagcagcaggaggagggtggtggcggttatccgggccgtgggcgacggcgcaggtgaatcgacgagcggcaaggacgaggaggaggaggagaagaggcgtcgggaggagctggagcggttggtgggtggaccggaggacgcgacgttcagcggggcggacctggcggcgctgataaggagcaagtacgggaggtcgtacgacgtgacgctgataaagaaggagttcatggggcggaacctgctggccatgaacgtcatgtggaagtaccgggagcagcggtccttcccgctgacggaggaggagtacctgctccgcctcgacgacgtcgccgcctccctccgctgctggggcgccgtcgcccacgtccgctcctccctcgccaagctcaaggaccgcccccgcatcggcaaggccgtcagcatcttcatcgacatgcccaccgacgactccggcgcccgctccaacgagtggatctacaaataatataatcccttctatttatttatttatacttcatcgccatctcgaattctcgatggatcgatcgttaattagctaccttgctccttaattccttcatgtatttgcttcagcttcagctcaacgatcgatcacacattcacactcttggaattgtatgtacggccacttattaattacctcaagattcatcctctctgcattgtcttgtgctgcttcttgctagcttcagctccaccgacaccgatcgttaattatgctcgatcctctacttatttgcttcggctcgacgtaccatcactctctcgctcctcaatacattagtatgtacttcaacttgatcactgatgatgcctcgtgttatcttcttcatcctcggctcttcctccagtgctcaggtagagtaggacgtagatgcgccgctggattgttcacagcaaatatgcgccgttcgatctgtcacttgactatctatcacgggaaggcccagtttcggcccagtgagttacttgtgtttgtggactaaactgcaggtccatttgaggcccaactagctagtctaaaccctccaactctctcgtctctcccctgcaccatcgaacaagagagacaaaccccttccttccgccaatggccgccgccgccgcccttcgccggagcctcgctgctggccccgccccggccctcctcctccgccgccaactcctcatgcgcttcctctccacccagacacagtcacagacgcaaacccccgccgacctcgccaccctcaagaactccattcgcagcgccgcccacaccccggaagccctcgccgacctcttcatctccggcctctcccacccggccttcctcgccgaccgccccatctttaccctctccgtccaccgcctcgcctctgccggccgccgcgacctcgtcacctccatcctctcctcctccctcacctccctccccgcaccccacccctccgagggcttcctcatccgcctcatctccctctactccaccaccggcatgcccgaccactc

SEQ ID NO: 75606 - DNA, 2423 bp, Oryza sativa
gaactatctcacgatccgacaggatcggagccgccgccgtcgtcgtcgccaccaggttccagtcgatagattcgttttgaactcctactcgttagatatacaggttctccctctcaccaactctcttacataggcttaatcacacggcccagttacacaaccctctccgaagacatatatttagtgttagccttgcgcttgcgcttctccttctggaagacggcttccgccttcccaccttcgctctgttgttcacccagctcattgccgccatgctccttctcctccaggcgttccagcggtactctgacaccactcctccaagaaccccgccacacgtccaggatgcagatggagcagcgcgtggaagggcaccacagccgctaccgcgaacgaagggtgacggacagcgcgcgaatggagaccgccgccgctgcatacgaaggcagatgagtcacgggcggatgggcactgccaccgcttccacaggtcaagggtcacgcgcggacaagcgccgctgccatagacaaagggcgacaggacgtggcggcaaactgcaattggtggctcgcagctaccaccgccagctagtggaggaggttagttgggggaggcggaaggtggaggtggaatagggaggggattgcggacggagaggaggaggagaaagaaggagcgtcatgtgagacggagatgaggatgtgagtaggcacggatatggtttgctcggtcggctctcatagcggttttttatttttttttagagtaaagtgtacgggcggtctttaaaacttgtaggggtatgtcttttaggtccctaaattctcaaaatgcatatctaagtcccaggacttgtcatagtgtgtcatctaggtcccaaatcgttacaacccattcaggatcctacatggcgttgatgtggcatgctacacagacatgacgtggcatcattttgaatgacaaatggtacccatttaaaatttttcagttttcatttttcttctctttttttccctttcttctcctttatctgtgaccagagcagaagaaaggaaaaaaagaagaatgagaagaaaacgaaaaagaaaaaacaaaagaagaaaaaaaaagaaaagaacatgtcatgtccatgtggcgtcatgtaggatcctagaggagatgtgtcgatttgggacctagatgatacactttgataagttctgagacctagatatgcattttgatattttagtaacttgtatgacataaccctacaagtttatggaccgccaatgcactttacttttttttatataggttttggtttttatctagaacttgcactataatataagtataggtgtcgatttttatttagcggctactacaatttattaaaggttttggttttttaataaacggcacctaaagtattgtgctagtttttctctatcaccggtacctatagtagattgaaggtgtcggttctataattttccatcctgtggagatacagaaaggtctatatgtatcggttttaggatttatggcaccaatagagctgtttcttttgtgcgtttctatagtagtgagtggctgggcctagggaagtgtggtcgaagcacgcccaccctatgtgcgtctttcacgacatgctcttgccttcggtttcttcctctggtcttctagcggtgtctgttccggtcatctgcaacatactctcatggcctttttttatgacaaaacctatctgaaatcgtcccccaggataaagactttatcgaccctcgagggatcgacgtaaatatattcgctagctataaaaggactcgaaaacctgagttaagtcaggcaagaaggcaagcaaaatcaagaatttcacttcaaattccggtcctcaacatccggctgaagacctcaacatcctgctgctcatggtatttcactatcagtattgaaaatgaaagctaagaagtcatcgaaactcataactagagagggtcccttatgaagaaaaccaaacttgttcatttcaaaacagctcggaaacggacaaaaaccacctctaccatttcttttttcatacctttcttttggaaccggaatcggaattgaaaacctcggatacaaaaatagaatcgaatatgaaaacgaagcaaacacgaattggagcgaatacggtaatagatatttatcggaataggaaaaccctcaaactgaacttctcatatcaacgcagagatatacctcattatttttctaaaacaacaaatccacatttcttatttttatcaataatataaatagttgtgcacttcaaatagcttttaggagaacaagaactatattcatctatagttgagtatggcatgacctattaaaataataaaaaagtcactaggcaagagaaagatagatctaatgccccggattggaaaaaaaaa

SEQ ID NO: 75607 - DNA, 1568 bp, Oryza sativa
agcttgggcaccaattcgtgtatatcctatatctttcgattggcgctaatactctttattggtctatctggctttatcacaatgatattgctttcaaaaaagaagatactccattcgttttttaatatatgacaccattgactattttagatacgtttgaccatttatcttattaaaaaattagtaattattatttattttattataatttaatttatcatcagatgttctttaagcatgagttaatatattttttatatttgaataacaattttaaataatacgaatggtcaaacgtttgtcaaatagttaatagcgtcatatattaaacaacagagatattatttctaatctaatgcacgttacatattttaccaattgactccaaatctgtatgatgcatgcttttaaaataggagcgcactaggcctgaggcccgacaacccggcccaagcacggcatgggttgtgccggcacggcccgacctttgggttgtgcctgggcctcttcctcggcacgatgggccagcccggtccaatgatgaaggagtcaaatagatgagggagacaaaatggacttattccatccatataacacctggtccaaagatatgagggatgataaatagactttattagccatagtagagatggcccatagaaatgagggagccaaaatggactttttcctaggagccgcataatagactttcgtgccttcagactggcccggcacggttgagtcctattgggccattcctatgccatttggacgggcacgagccggacgattcatttggccatctataggtgtcaccggggtctcttttcgtattatgatttgcgtaataatagtaggctaatatggattagaattttattgtttctgttactctcagaattaccaaagcaactttttccttttcatatatttcagagatatatagcctgttttggagagctattagctgttgtagtttcgtttagaattagaagcttctttaaacaatccagcttttgatctaaattctgagaaactgtaattataaaatctagcaaataaactagaagtcagaagttagaaattaagcttttttagattcttataagctgactatcaatcagttgcttatcagaatcttaaactcgttatgctttttattttataacaatcggctatgtacacctaaatcattacccgatacagaggccaaaaaatataagacttttaattatctcaaaagtgctgaaggcctggcctgtcgaattcacttaattaactctgtgttccattcgacataaaactgggacaaaagtaatagaattttctgaccacagaaaccaagacagataaaattctactagatattaatcagtgaaacttaccagcggcccaaatgagtgactgcaaccaaattctgacaggcccgtaattaatttgcttttagaggaaaggccgggaggccttgctttgccaaaaaaaaaaatggtgatatctgtttgcaaaaatgagcaaagttcaggaatgtggcactggtggagaaatcgtttgtagtcccggttcgtaac

SEQ ID NO: 75608 - DNA, 20112 bp, Oryza sativa
  unsure (1)..(20112): unsure at all n locations
ccttccgcactctccccgccgagctcggcatcaagcccagcgtcgtctctcacaacgtccttctcaagtcctttgttgccagtggcgacctcgcctccgcccgcgccctgttcgatgaaatgccttccaaggctgacgtcgagccagacattgtctcctgcaacgagatcctcaagggctacctcaacgcggccgattacgccgcctttgatcaattcctcaaggataacaccactgccgcgggtggcaagaggcgactcaagcccaacgtgagcacctacaacctccgcatggcttcgctgtgctccaaagggaggagctttgaggctgccgagctgctggatgctatggaggcaaagggcgtcccacccaaccgtgggagcttcaacaccgtcatccaggggctctgcaaggagggggaggtgggtgctgccgtcgcgatattcaagaggatgccagaggtgccgaggccgaacggaaagggggtgctgcccaactctgagacctacattatgttgcttgaggggctagtcaacaagggtgtgtttgctcctgcattggaggtgttcaaggaatgcctgcagaacaagtgggcgccgccgttccaagctgtacaaggactgatcaaaggattgctcaagagcaggaaggccaaacatgccaaggaggttgccatggcgatgaggaaagttgtcaagggtgacgccaaggaggagtggaagaaggttgaggctgaattttcgttcgagcctactgataagaaagcctaactgctaggaatgatggatggcacaatcagaatgtcagttagacgattattttacacttcaaatccattgtctgattgcatgtcttttgtgcgcttgtggccaactctatctagcctttcgttccgtttagcgcataagattattttccatatgaggtatttgcatttcgaacaaatacaggtactactctttggtggtttaccgtgtagaccatgtaacttgaatgatcacatatgatgcaactctttccagttccttatcttaatttatctcaaacttggtacatttcaatcctctatatctttatgtgaataacccaaaaaataatacagattagtcatcatcatcactgttataattgttggatgaagatgctctatgtactgttttctgtttggttactccatctgcttgcctgaacaatgatgttacagaatgtggtgttgtattaatctgccgtctggatgtgcaagtttgttatgttgtacgaattgttttcaccagctgaattacaagatgctattctgagaagagtcgagcataattgtgaacataagggacaagttcagcttgacgatcgtgtgacatgactttggctgtatctgtatggagtgctgaggttcttcaggttattgcattggttggcaggcaccctttaccgacttattaccagttatagtccctcaagttgagaactgacatgaatgagtgatactgaagttgcatcttgcagccggtcgggtgcgtccaactgtgctgattggattgcagaggtgcctgctactgctgatgttggtgggagtctacgtttgaagtggataacatcgagccactggtaagtgtctcctttttttcccttttcatgtgtcttcactattggcatgctcattgttcatatgggatagaatatcttgtatgcatatactttttttttttggctggttgtaggttgttatcatataatttcatgttatgtttgcaagtcgcttcttgccaatgctaaattgctcgtgctgaccatcatgttccatattaagttgttgtgtcgggcatcgtcggcaagctctcacttgctcgtgctacaaaatacagagagacagcgtgacagtggctcgtcgcagcaggtactctgcattccctgtgtgctgcctatatgaccactgggtgtcaaatcttgctgttgcttttctttcatttctctgcatctttcctttgcctgctttcttagtttcctccaataatggatatggagtattaggagcaagtatttatatggctttgacaataacctgcacgtcacattattatcttgtttttgtcttcttttgagccgtcttttgtgtggctgtggttcaatttctccactattctctcagacaaatacctattgtagagtaagttattttacccctaataataaaatcatttattgacctaaccacctttgaacctgccatactatatacatacaactgttttagagtgatgtcactgctgtctcaaaaggtagtcaaaatcttaattagacttgtgtcgtatcaagccagaaagaggcttttaattacagtatactataagggtttactaagaaacagactttgataaaagcacaccatccaaccttattgtcttcaatacgcataaataaataaatataatagatgcagtgagttttcgattcaaattcaaatgctcttaattgaaggaacgtattggcattattacattgcaaagtaaagacaattaagcagaatcaatctaagtatatccagcgctaaaaagaaagggaaggaaactaagataagttgtggtgttggtcaccggctgcggccttggccttggcctggagaggaggatgatcgtggtgggcaatgccctccacggcgcgcagcagcgcgtcgatcctggtggtgcctgtcccaggcgaaggaggagcagcggcaggaggaggaggaacgtgggcgttgccggtggcgttgaaggcgacccgatcggcggcggcgcggacgaggtcgtcggcacgatcgcaggaggcatagaaggcgtcgatgcggttcttgaggtcctggatggcccccgtggtgcggacgggctcggcgatgaaggcggccacggcgtccaggagggcgtcgtactccgcttccatcgagtccaccgcgctgtccatggcgtggcggcggcctcgatctctcgctcgcgtgcacaacacaatcacaatgcaccaaggaattgaaggaagaagcagagggctccttcctcttcgtgttcgatcttctctttaatctgttattacttctattattactacgttggttttatagatatatacacgtattacgtagtaacaaaccgcctctctctctgcatctccacccaccccgactccgtcgattcggtctcccttacccttttctagtaggatgggaagagatcgatcaacatacatacgtaggagtaatatgcaggtaccacacatacatacatgtcaaaaaaccttaacaaactgtcacatactctttcgtttcataataaatttatttttttgactccttccatttatcctaaaataagtttattttaagtaatcatcattgtatcaaaatttgtgaaagtaatataagaaataattatattagaagtacataaaacgaagaataattatattgggatgggataaagtatgaattttctggggtttttcttatgttagtatatgtgtgggatgtgtgaaaaatgaacttatctttatgacagaggagtacaatataaccatatactcctcctatataattaactttggtcatcaacattttattatgaaaatacatatatttcaattgcatatacaaaatcatgtagtacatatacagtgtcttgacaaatatttacatagtattttaatcttatcaacacttcgaaatatatgtatagcaaaaaaagcaatttaccttatttaaagactgtatatatgccttaataaaaatatattatagtactcctccgttctaaattagatgtcgttttgatttttttttataatgtttgatcattcatcttatttaaaaattagtgcaaatataaaaataataagtcatacttaaagttttttttataataataaagcaagtcacaaataaaataaataataatttcatgatcttttgaataagatgaatggtcaaatgttacaaacaaaaaaattattttagaatggaggtagtaatatgttttcgtgattgatgaacttcattgagactcaaattcatttttgtttctgaaaagagaaaaagaaaaatctttctgttgttcacaaagaaatcagtaaaacagtcgtagcattgggggtcggggtcttttgcaggcttgcaggttgaggagcactagacgctgtggagtggagggaggcnnanatggcggaacagtagccaccatgagctcctcccactcccatgctcatggcggcctcctccccacctcccgccgccgctagcagcagcgggcgactcgccagggtgcgcctccacgacctggcgccctacgatggcgccgcgacccccgcctacggccgcgccgtccatgccctctccgcctccctcacccgccacggcgccgccctcctcgacctccccgacgcccacgccgccatcctccgctgcgccctccaatccgctcgcgccttcttccgcgccaacgaccaacccgccttctacctctaccgcgcagggggcagcgcaaggtttaggaattctctcttctgccttccattctgaatttctcaatctcaatcgctctcctctgaatcgcagtaggacatccgatgacggcggcggcgacctggtccctgcttgcatggacgacgccttcaggtgtttcggtgaggctgcccgcgctgctctctctgcgattgctcgccatctccgacttcgtaccaagtaagtacaaatacaatgcaatgcctgtttttttaatcccttcatctatgactagtaacatcttgctcttcacacttactcacaattgagttggtctctatacattttccagtgtattcgaccacttgctcgatgatactccattgcctgttaatgaggtctcatcctcggagttgctggtggcttattccaaccaacacctccacaccgatcatgcttcttctactgcctgtctcggctcttcagtgcctcaagttgacaggggcttccttgtgctcattgcttctgatcatccaggaattgaggtatccatgtaacaactgtgcaaagttcaattttttttaacctttattggttttagttttccttgaaatacattactgttttcttagtttatttatgctttttagctcatcttttctccctgctattctggtcgacacatttcagttttattcagtgaattagcctataagtgctgcctggcctctagttcacattgtttagctacttctctggtaggtttgtgacccaaatggccaatggtacctagcagatggcatttcagggcctggtgacctgttgcttctgactggaagggcacttagccatgttactgctggtttgcgcccaacttctcgctacaggatcacaaatgagactaggtcagtactatggtaacaactgatggtttcatcatctcatttcgcctccattttttcgtggttatatttgtatacttccctacatggatgctactgaatgatttgatatgataaacttcttattgcaatttcctttgctgttgtagagcatcactcacctttaggctaatgccacatgccaatgctatactggattgctctcctattgcagcagctgggcactgcgtaccccagatgtaccaacccatatctgcaagccaatttatggatgacttgtgtgctgaagaacgtgctgtttcgaatcattcggaagcaccttctgtgagtataaatccagtaccgcatcaattcaatagcatgcatggcatacatccatattcagctatagtgatgcatgagagaagcacacctcaactctctaagagtgggaaagtgacatgttgaaaaagcaagaggatttctgtacatgtaattgtgtctttctcatgtgcgcaaaactaccggattgctcatatcttgccaaatttggattgcaggaatctcagggcagcttcattagtgaaccatctctcagaagtgtcctatcagatccattgtcgtaagtttttccttgcggaatgtaccacttcatcaaagaagcccacgtcatatgtatagattgtcttattctgcatggatcattcttcatatgtatttacctataagttatatgctagcccccattttctttgagagagagactgggagacagagtgatagacaatcaggcacacatacaaaaatgaaggggagaaggagcacatttttacttagcttaatcaaaattgaataactgatataaacctacataaagttttgttccttttttttccaaactagtgtggatgtcatcaccatattatttagttaactacgcatcgcagtcagacaacaagcacgggtgatgaaatggtatttggtctgttgcagtggggcttttcttgaggatgctatggttctgttatgtggacactctttcggtggcctcatgctgaagaaagtcattgaaatggtattttttcaaaaaacttcatactcaggcttccagatggctattaattctcttgttgtaacttatgagggcaaagttctctcttttactgtagattgcactcttcaatgtactagcttcaactagcaattcaatttgattattgtccttaacacagatactggcattgttcactaaatttgtgttttttgtttgaaattaaattatttatttatgtcttctttattatttaatagagggccctagcggtaggttatccaaaactggaatgtactacttaacagagaactgtgactattaggactttaggagtgctttttagtagcaatggcacattcttgtaaaaaggtattttacgcctgaagcagttccttgtatttcacacagcatatatcataaaacaatagattatgtttctacaataactatgcgacatatatttaataaaagtgtattttcaagtcatttctattttacttatcttctgatccagtggggtgacaccaacaatcatgccagtttttctatttttactatgattaggcaagatgcaccatttgcaatggagaagttgatccggccaccctgtttcctaatctcggtatatttctgactactaattttcttccacgaaactggcattatctatgtctcacctgctcacgtactgctgttagtattttggatataatagctttaagagcagtagctacagtggtgaagatggaagatgataggagactctttcataatgctgctcttcgcaaacacaggaaagaggtgaccgaacgtatggatgtgctgaagagcactggaggtagcagagtacgtaatgctgtggctgtgattgtgaacataccctcaagcaatcaatggtggtgcatggatctgaataattactttcattgttttaatcagggcaatggtgagctggtgttggatgctgaaaaccctacatcacccaggggtgtgcagtatccatttgtagtgggcgagagggtcctgatcatggtacaaggagcacagttgcttttggctcttgcattactaagaaataataaagggcagaaatgaattcttatcgttaagagcatttgcagggaaacagaaggacgcctgataaatttgttgggaaggaggcagtcatcacatcgcagtgcttgaatggctggtgagtccatttggatagctcgctttgaaaaacagatggcatttttgggggtgatggaagaagatgtatgtgaagttgttgcgacttagaactaattacaaatggtgaatcgcaggtatcttgtgaaggcggttgatagcggggaaagcatacggctgcagtatcggtcgctgaagaaagtgtcggagctgcagcttcagtcagagatgaggttgcagccactcaccttcctgcacaacaaataccccagtagtggcagctgagttgattgactatcatcagtcttaaaacaaaaaaaaaagaaaggagaagcatatactgtagcagaatagtcatgaggcatgcatcgccatcaagcgtgttttgttgtagtaatactaataaaaaggtcagttagaaaagtgtggtgatagttaatctggtgatgatatgaaaagggtctatcctattggaaggagaaatgtcatgtgggggttattaaaaggacataaagagtttgctaggaagttccaaattcctagcggtggatgcagcgggtcagccaagccaaaccacaaaccaaactgacttttctactgcactgcaacgcaccagtagatgccagttggtaattcttgatccaagcgtgaaaatgtgtaactggaccggctgggcacttgcagaaaaagtcgataaatgtgttgtgtttgctgtgacatcactacgtcagtgattgtttggatgtatgctcctgggaactcaattggactcacgataccgccatccatgtccatggcgctgagccttctcttcgccgctgcaccacgagctgttgcctcgttccgcgcctcttcggcgtcctccccggcactcgacagcggccgccgcccgcagaacgtccccggcgacttcttcgtcggtcagccctgcacctaaactcatcattaatcgctcgccatttatgcgctgcttcagttgaatttgtaattcgctgtctggctgcagatcaccgatgcatcgactgccagacctgccgctggatggcgccggtaactagtctttcatatatgcataatatgcttgatgcttcagctgctttgcttggtgatggtgatttgaattgaattgaattgcaggaggtgttcaagagggtggacggaaaagccgccgtggccgcgcatcccatctccgacgaccacaggaccaaggccctgcaggtagctctgcctctcttttactgaatttcaatgcaaaattaaactatgcctgccattgatgcccaggctctgctctcctgtcctactgcctccattcacaccgagaaacctgcaaaagacattcttcaagtgcaaaacatgttccccctccccatcgacactcatcttctccctgtatgacttgctctcctcattccggatttcacccaatttatctcaattaaattaatactctcatgttatatatgtcatccatcctgcactgctcaaatctttccagggtgtttatcattgtggttatcattctgaagactcgtttggagcaacttcttatcttataacccatccagatggaaacatactagtcgacaggtagattccaatgcacttactaaattgtttatatccctagtacccatcttgccatggccagacaaacaacttatcaagttccaatcggatacattgatagttttccttctgacaagtattcaatttcacaaattggtagcatttttcacaaattggagatcatctctagcaagtcttcttgtccagcttacatgtggttatcagtaggtcttctgatatttttctgattttctagcccaaggtatacaacgaaactggcaaataacatcgaagaacttggtggagcacgctacatgtttttgacccacaggtatgtttgaactaaaagttgtataacatgtttatctattttttgtttttctgaatgcgccgcttctttattttaaatattttatttggatattgaatagcgtctaatgagttacttacagggatgatgtagcagatcataggaagtgggctgagcggctaaaatgtgagaggattatccattcgggcgatgtaagaccctcatgcaaacgattgcatctttttgtagcaaattttacctatagttcataacttgaagtacgtagaggacaattattcatagtttgcactacatgtactagtgtagagtctagcttacctatttttccagcgagttttgctctcagatgcctctcctgatattctttactgcaattaccatgctcatgcaggtagagcgtgctaccgtagatgttgagcggaaacttactggcaatggtccttggaacattggagctgatttcgaacttatccatacccctggccatacccaagtaagaagttcaacttaatgaaataagttgtttaagcaattacttgttgccttcagtatggaaggcttctctggattgggtgaaacattcttaaacatagaacactaaagagtagcagggtgaaagatatgtgcgctgttgttggacattaagagcattttttttcagggttcattcattaaaatgagcatttttttttcagggttcggtctgcttgttctacaaaccagtaaaggcgcttttcactggagatcacgttgcaaaatcagaagaatctgatgatttatatctctttcttatgtacagcaggcaaccaggtagaatcctccctagattttgtctaactggacataactgtgcaattgtacaattagcttacaaatcggattaataatctatctattgcataaatttgcagtgagcttgcaactggacagcatgagaaaattgttgaagttagacttcgagtggtttttacctggtatgcgctcattcaagcattgcggatagagtataccttcttaggaaatgagaaagtccctgccttagcatttagtttctgttgttttctttaaaacggcatgattgagtcactgaacactgattgctagttttttcccttttccaggacatggctatcgaatccattataaagatgtacacgctaaggattcagcaatcgagtccctcatagctataactacacaagctaggggcatcttataattctctctaccttcagacttcagtgtacataaataacgatcaattctggaattaagtgaccaagaggaaatgtacttttttttgaaagaccagcgtaggcggctggcattctatttatcttagaaggagcaatgtacaaattggcgatataggaaatgtaaaaatttacacccatgatggcaaacaggtttgtcaccatgtctatgatcttctctaaatcttggtacctcccatgcttcaaaattttatctcgtccaggacttggttgcatactagttgtatgaatgattcgttactttggaagacgcttgtttctttcctgccaaattttctattgtagtcagtaaaatgcaggtgtacatgcttgagatgccctagagtaagcggcaggcccaagttgacaggggaaaattgctcgctgcgatgcgaagtttcctaaaatgacatccagatcagtatccgggcaactgattggtgtggaggtcggttgcttcgctgaatcttttggcaacatgaagttagtaactgatctagcatctctaatttagtccagaacatatttattgcatcctatcttccgaaaacatttgcaccaaacaggtcgtaattatcaataactgaaccttgagagaactgaaaagaaaaacccagcatcatactagctggtccggttaacagtctagtaatactgtttacacccaaatttgacatctagggataaaataagaaaacttgccaaagtttggaagtctgccggttttcctctgtgagggccggtctgaccggcgtgtgttggctggtcagaccgccgacaatgggccggtcagacctgcggtgtgtggccggtctgaccggcagagtccgagctctcttcgggtctcgagttttcttgctcgggaaagctatatttcgtgtttactttggtttctatcccgagttggacgtggagaagggcttgtagagggcaagaacaacctctatttaaggggcaaggccgattcattgtaataccctgaatacaatctacttgaatcgttcttttactatgttttctattttaccctagtttagtccatctttgtcggtttgcgccgtaaaccgtccgccgccgctgcaagagtgcgacacctctttgtaggtttgtcctaaaaaccttctgttttgcccacgagacgggtagttatcctcatatcgatctaaatcggcctagaggctgattttgatctctaaatcggctccgctagccgatttagctgtttttctataaaacccatcttgatttagccttttggctagatcgaggtggttggcgatttcatatcactgcaaggcgtttagttgttgcgatcgtgcttgtctacttgtcacaaaaagttatcaacaaatacttatctcaaaaacatatctataatgggtacagactcatttcatactagaactagagtagtttattattgatcgagtgttaaaatgggcactcagtaaaaaaaagaaagaaaagaaaaagggaaaaaatcgagccgtacgtgcaggatgttgggaaacggatcctctgactttggtggatgttggcgtttgctgtgacgtcagtcgtgagggtcgttttgtgcatctgctgccctgcgcagagcgaacgctgctagttgtagcacgcacgctgtcgctgacgctgctgttccgccatggcgttgatgatgagccttcgcttcgcccccccagcgtccgtcgctgctccgccgccgcgacgaccacgagctgttgcctcttcggcgtcctctccggcactccaacgccgccgcccgcagaacgtccccggcgacttcttcgtcggtgagccactgatcgagccctgcacctgaaatcggtctccatttaatttctcttcctgatgcgcttcagttgagtttgtttgctgcagatcaccgatgcatcgattgccagacctgccgctggatggcttcggtaactagtctttcatatatgcatatgcttgatgcttcagctgctttgcttggtgatggtgatttgaattgcaggaggtgttcaagagggtggacggaaaagccgccgtcgccgcgcagcccatctccgacgaacacaggaccaaggccctgcaggtagctctgcctctcttttactgaatttcaatgcaaaattgaaccatgcctgccattgatgtccaggctctgctctcctgtcctacttcctccattcacaccgagaaacctgcaaaggacattcttcaagtgcaaaacatgttcccgctccccatcgacaatcatcttctccctgtatcacttgctctcctcattccggatttcacccaatttatctcaattaaattatattcatactcatccttgttgcactgctcaaaacttccagggtgtttacctctgtggctatcattctcaagattcatatggagcaacttcttatcttttaacccatccagatggaaacatactagttgacaggttaattccaataagcttatgaatttgttcatgtccctaagtacccatctttccatctccagacaaaaaaaattatcaagttgtaatcagatacattaattgctagtgttcctgctgataagtattcaatttcagcacagcgtactggtcaatgtgatagcatttttttcctcacaaattggagatcatctctcccaaatcttattgtccagtttatatgtggttatcactaggtcttctgatattttctgattttacagcccaaggtatacaacgaaactggcagagaacatcgaaaaacttggtggagcacgctacatgtttttgacccacatgtatttccggacttaaagctgtatcacatagttctcttttttaattgcctttttttaacgcactcccttttattttggatattgaagagcgtctattgagttacttacagggatgatgtcgcggatcataggaagtgggctgagcggctaaaatgtgagaggatcatccattcgggcgatgtaagaccctcatccaaacgatttcaaagaatcatgatcatccttctgtctgaccctagaaagacatcgcttattcctgagtcctgactgatcctcatcgagtactcaatcaacactgtcaaactttataacctgcagtacaagtactgattagcagtacagagaggacagttatatcgtgtcagagcttgcatgacatgaacatagtgtagagtctgatttacctatttctccagtgaatgttgctctcagatacttctcctgatatttactgcaattactgtgctgatgcaggtagaggatgttactgcagatgttgagtggaaacttactggaaatggcccatgggacattggagctgatttcgaacttatccataccccaggtcatactgaagtaagttcaacttaatgaaagaagttgtttgagcaattacttgtagctttcagtatggaaggcttctctggattggatggaacatccttaaacatacaacatcaaagacaaagagtattagggtcaagatatgtcatatgtgcactatttttgcgcataaagattagattggattatcaccatatcctgtcccaaattttcctcaaccttagagacgaaggaacatgttctgtcaaaaattgtccaaagctcataaactgagatttggacaaccaatctaaccttcttcagcatatatagggttcattcattaaaaggaacatttttttcagggttcagtctgcttattctacaaaccagtaaaggcgcttttcactggagatcatgttgcaaaatcagaagaatctgatgatttagatctctttcttatgtacagcaagcaatcaggtagaatcctccctagattttctaactgaaggtaaatgtgcaattgtaccattagctgaaagtaggactaggattaatccatctgttgcacaaacctgcagtgggcttgcagctggacagcatgagaaaattgttgaagttagacttcgagtggtttttacctggtatgcgcttcttaggaaatgagaaagtccctgccttagcatttggtttctgttgtttcctttaaaacggcataactaagtcactgaacactgattgctagttttttttttccttttccaggtcatggctatcgaatccattataaagacgtacgtgctaaggattcagcaatcgagtccctcatagctaactacacaagctaggagcgtattataattctctctaccttcattgtgtataaataacgaccgattctggaatgaaggggcaagagagaatgcacttgccattttgtcagcgagagtggcacttcatatccttggaagatgatggtactgtttttgcttcacgacatttgcaatatatcaagtcgaaaatgtcattgatgcacaagaatctgtgcctttaatgttctttttttccagcagaagaatacttgtttatgatgacatgaagtttcctgcagttactctggcatctctaatttactccaaaatttgtttcttgcatcttgttttccagaaacatttgttgcaattgaacattaactatcaataactgaaccttcacagaaaactcaaaagaaaagcccagcatcatactagctggcctgaaacaaaattgaacgatgttacgcaatgggaacttaatttcggaatataatcacgtgttcttaatgatatcaatgaacaaaattgccctttcctcgaagttacacctcctggcaccgattccacaaaaagaatgctgtcccattcttcatggtacagaaaaattaaaagaggggcaaaaaaaaaacaaaactcccgttgtatactctttagtgttacataaggtacaaaactgaaactcttggccagagaaatcctccctgttagagcaacgcttccaagtattcgtcgacatatgccaaacatggccaatgatcggttcttattctgaccaatgtggaggcataacctacttccatcgaaaagaggaggtgataccttggtggtagaaatattaggacacgcacaatgcccatatccctcttgcttagatgagcataagtctctgcgccaacctcaaattcgtcttcatcaatgcgctgaagcgaaaggtttgtgtccactgagtatggaaccaatgcatcagcaccaacaataggagctgaatcactttcttcccacacaacgtttttaataattgcattgcctcttaggatggtaataagtgaatctccagcaacgctgacaacgaagggagccaggtatctttcaatagctctgatcaaaacctttggagtcacctcaagaagtttgacagatcgtgttccattaatcgcagctgaccctttccctcctgtcaaagggaaggtctcccgacctgtgttcgaacaactgttgcaggcctcccatagcgcatggaacagatcctggtaatactcagctgcatcctctttcagaatatcaggaggtacactggccttcagaaacatgtcctcaatgccaactgtaatgggttgaatggacccagatatgacttggcaattctctgtgttggcggtgatgacaacatcaataagaccaggtgatggttctcgaggctctaattctatcactactgaagcacaataacttgattctaaccggtggccgttatccaaaggcataatgtccataccagaacctggaggttctcctagaaggaaaggtacatgacatgagggaattttcccaaactgtgcacttgatgaaaagttaattgtcgccgcataaagggccggcaaaccatcaaccccttcagaacctggaactgctgaatcggatccccaagcatggttgaatggctctgaatcgaacctaaatgtgcaaggtatttttattttgagaccaactgagtggaggtagtcaggaatgcatgcaaagtgcctcctaaggatttccagtgtttcagcacccttagaatccatcacacgaagagcttcttgtgtgtaggcgattctctcgatggtaggttgtggtgtcttttcttgctccggaggagttgagcttacatcctgtatacttagaatttggccagatgctctgctctgaatgctgaagttaggcaatgtgagggcccaagactgtttcacgaccagtggcacaactctttcaagatgaatgtaagacgccaaatcaggcatgctcttaagatcttgagcaggacgtggtgatgggacatcaaacaaaggacctggatgagatggtgtaacacctgcaggttgctctccgattcccatgagatgcctcagcttctttccaggaatgcaggacagcatccgcaaacaaatcctggatgtaatatttgaagaagtgagaagataatagaaaaacagctatcacaaaacaagaaatatcagaaattcagaatgcctaccttgcatggtcccggacctccaggtctgggtaggacttgatagtgagtacaagtaggcatgagaggggaaagaagatgcgagagctgtgatggtgcttcatcatgacacgacaaatgccaacgaccttgctgccctgagaccatgttttcagttctgtctctggatcatgcttcttggcaagagaagccatctgcttggtgagcaactctattaggcggagctgaggaactgtctcattctctgcgatcttctcaaagagtgggtagtatgacgccagttggtagcctggttcaagcctcggaagcagattctcgtcaagcgtttgcagcaactgctcccctgcccaccgatgagtgttgcatgctagaagacggttgatgaaatcagcaattactgggactaagcctcgatgttctgatgtcatatcaaccaacatagcctgcacacagagtgacctagaaatttgagaattgctaaattttcaattcactgtctggaacataattagggttcttccaagttgatggatgcggctatcattaattttcctttcagtagatttctacctgtaaatggtggaagatagtagaattcaggagctcaccagctccggagcaacctgagccatcagtactgtgaggggcagcagcaaccaagaccacatgcagcgcccggaacgccacacaagtctcggtactccatcccgggagccacctgaaggctgaaacacaagccaggccatcatcgacaagcccaattgtctggtccacatctctgcctccttcaatcttgtcagcatcaacgccagcagcaacaagagctaggcaatctagcttcttggccttgactgcaagggggtcgaacacgccaggataaaaccatttcgcgaggccgggcaccgcatatctgaattttccagatccaagcagccaatgtaatgccagcaagcgcgctgtgagcgggcggtgtgcctcacaagcagccaaagctagacggcgtgccattttacgctcgtcttcggccccgaaagcatctggaaactggatgaacagcgtgagcagagagtgtagaagcatgaggctggacgaatgtgccatcccgccaaactgcaccttgacgtgcgctgcgatcgccggagcccacccgaccacagccgcggacacctctgcaaggatggccgccatctccatgcccgatgcaggcgtgaggacctgcggcctgtccatgatcagagcgagcactttccttatgtccctcaaattcacctcggaaggcggcggcacggggttggcaggatctggtgcgggtgcgcggagatgcgcgggcacaaagaagggggtgggcgggccggacaccgccaagatggaggtggtggaggggagcctgccgaggcggacgacgtggcgggcggcggaggcgaggaggaggaggtaggactgcgcggccggcgagcgctcggcggcggcgagagcgtagacgtggccgaggacgtcggcgaggaggcccgggagcgcggcgtcgagggcgcgcagggcgcgcaggcgagggcgcgggcggcgcggtcgggtgcgtggttggggcggttggcggaggcgagcagggcgttgacgagggcggagagggggtcggcgtggtcggtggagacgggaagggagagcgcggaggcgaaggcggatgtgacggtgaggaggaggtggtcccggagcgggtggtcggaggggaaggagaggaggcaggagagaaagagggggaggtgggtggggtaggncggnagcaggtggtcgtcgaggaaggagaggaggaggggcctgaggtgggaggggaggtcgcggcgcgggagggaggagagggcgaggtcgaggagggggaggtggagccatcggtggcggcgcggggtggggaaatcgtcgatgagctgctcccactcctgaggcgagagggaggcgggaggcggcggcggccggtccatcgctggcgccggcgaggggaggggaggagaggagtgatgcggtgtgtggtcgggtcgggtcgggtcgtgtggtgtgtccgggtgtcagtgtcagatcggatggtggggtagggggaaggagacgtacgtgttggtggttccgccgcctattgcagaattttttttatttataattttttttattaaaagttttaaaaaataattttccattttgaaaattgacggaagtagtcccctaccgccctctgggagggcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcgagggggggcatggaattttgcaggcggcccccttgccgccctccgctagggcgattttgtactgtggggggggccgcctgcaaatgggcggcgagggagggcatggaattttgcaggcggcccccttgccgccctgggggagggcgatttttgcctcccccctataaagcccagtccttcctctgtgaaatttcattatattcactaaaaatccaaaaaaaacgaaagagagagaggggagggcagcagaaggggagcgccgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacaatagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatat

SEQ ID NO: 75609 - DNA, 45860 bp, Oryza sativa
atctttactcccggatgttctcaccaatcgggactaaagatcttttcccgctatttccaaattctttttaaacccggttagggttaagaaccgggactaaagataatagcactgaattttgaatttcattacatttgtgtttctaaaatagtaaataatgcattacaattatttaaagtcgaaaaattaatgacaaaaccttcgaaaaattattgttgtctgtagtaaactaagtggataatatataattagcgcatgaatgatttaaaattgttaaaatttttaataatcatatataattagcatatgcatgatattaaattgttaaaaattctaattaatatatgtaaataccacatgcatgatttaaaattaataaaaattctaataatcatatataattagcatatgatgatatgaaattgttgaaaattctaattaacatatgtaaataccacgtgcatgatttaaaattaataaaaattctaataatcatatataattagcacatcatgataataaattgttgaaaattctaattaacatatgtaaataccacgtgcatgatttaaaacttttaaaaattctaataatcatatataactagcatatggttgatttcaatttgataaaaattctaataatcatacataattaacatatgccatacaacaattgattttatggatattcaatacatcaaaaatagtttacatcgtgtacacaacaattacggtaatacatcagcggtgacggttgaccgcacgtactttctcctgactattgttccttccttgtgatcgctacgtgagtaaggggtgtcttcatttgttaggaggatactagggtcaatcgtcactgtgaaagggggttgcccatcaaactgatcgtaatcttcgtcagtcttgttctctactccgacgatttttctttttcctgggagaaccacgtggcgcttcggctcgtcaggccctttgccctttttttcctttgctaaacatgtccttgacgtaaaaaacttgcgttacatcattggcaaggacaaaaggttcgtccgagtatccaaccttgttaaggtcaaccgttgtcatcccactgtcatcaatcggtacgcctccaccagtcaacctagcccataggcaccggaacagagggaccttgagaggtccatagtcaagttcccatatgtcctcgatggcaccgtaatacgtgccagttgtaccatcgtgtcccatggcatcgatacgaacaacactgttctggttcgtgctcttcatgtcttgggctctcgtgtagaatgtgtacccattgatttcatatccctggaatgtcgcgatcgagccagatggtcacctcgccaggaaggccagttgttggttaatcgtctcgttacccatgagatgttgtcgcagccacgcggagaaagtatcaatgtgatgccgtgtaatccatgcatcggacttaccgatgtttctggcacgaactagagccaagtgctcctcgatgtaaggagccaccaatgaagattgttgcagaactgtgaaatgggctttacgaaataaattgttgtctaccgtcattattgctttccttccgagagtcccctttccccgtagtctcccttcatggtgtgattcaagtaccccgattggcgaaggtcttcaataaattctacgcgaaattcaatgacctcctctgttccataccccttggcgatgcttacctctggacgagcacggttacgaatatatttcttcagaacgcccatgtaccactcgaaaggaaacatgttgtgtaggtacacagggtcgagaataccgatctctttgacaaggtgacaaagcagatgcgtcattatattgaaaaatgaaggtggaaatatcaactcaaagctgacaagacattgcaccacattattctgaagggcttctaatctatccggatcgatgaccttctgcgaaattgcgttcatgaaagcacatagctttgttattgttgcccggacattgtctgggaggataccccttattacaactggtagcagctgtgtcatcaacacgtgatagtcatgagactttatgtttgtgaacttcttctccttcgtgcttattattcgctttatattcgtggagtatcctgacgataccttgatgctctccaagcattcaaacatactgtccttctctgccttgctaagagtgtagctggctggactcaagtaatggcttcctttctcctttggttccgggtgaaggttgctgcgttgttccatatgtttcagatcattacgtgcttccagtgtatctttcgactttccatatacacctaggaagccaagaaggtttacgcaaaggttcttagtgaggtgcatcacgtcgattgcatggcggacgtccaagaattcccaatagggtaactcccaaaatatggagtttttttttcacatcgccgcgtgaccatcttcgctctctataggctggctgctaggcccctttccaagcactactttaagatctttcaccatagcaaacactgttttaccgctgcgatgttttggcttcgtacggtggtccaccgtatgttcaaagtgcttgcctttcttccgtactgggtggtttgctgcaaggaatcgacgatgacccatgtacacaaccttccgacagtgcttaagatacgtactttctgtttcatccatacagtgagtgcaaaccttgtaccccttgttggactgcccggataggttgctaagtgcaggccaatcgttgatggttacgaacagcagtgctcatacgttaaactcctcctgtttgtcctcgtcccacacggggacaccttccttcttccacaacagtttaagatcttcgaccagtggtcttaggtacacatcgatgtcgttaccaggttgcttggggccttgaataataatcggcatcattatgtacttcctcttcatgcatagccaaggggggaggttgtagatacacatcgtaatgggtcaagtgctatgaccgctgctcatctctccaaaaggattcatgccatccgtacttaaaccaaaccgtatgtttcgtgcgtcctttcaaaagtctttaaattttctgacgacgtttcgccactgcgaaccatcggcggggtgtctcaacatcccgtcctgttgacgctctttagcgtgccatcgcatcattctagcattccccttgttcctgaacaaacgccttagacgtggtattatagggaaataccacatcaccttagcaggaattctcttcttcgttagctgctcatcaacttctcctggatcatctcttctaatcttgtatcgtagtgctttgcaaatggggcatgcttctaggttctcgtactcctcaccgcgatataggatacaatcattcgaacatgcgtgaatcttctgaatttccagtcctagaggacagactatcttcttagcctcgtacgttgtctcggacaattggtttccctccggaagaatgttcttgacgagtttcaataaatcgccaaatgccttatcactaacaccattttttgccttccattgcaagaactccagagtggtatccaactttttgtgcccctgctcgcaacctgggtacaacgacgttctgtggtcctctaacatcctgtccaatttatgggcccccttttcactttcgcagtcctccttggcgtcctgcaacatctgaccaagatcatccgcaacgtcgtaaccatcagcatccatttcctcctcgcccgtttgatttccttcaaatccagagtactgagcaaagtccgaaatattgtcgtcttccacttcatcttcttccatttcaaccccttgctctccatgggatgtccaacagttatagcttgggatgaaccccgactcaaacaagtggaaatgaatagtcctggatgcagaatactccttctgattcttacacttattgcatggacaacaaataaaacccttatgcctgttagcttcggccactctcaaaaaataatgcacgccgtcaataaactctttggactgccggtcagcgtacatccattgccgatccatctacatgaaatgaaaaaaaatcgtacacaaataattattcgtacaataatggcagtcatacaataatgataaaataattacaaactctttcaacactcgtacaataatgacatatcattattcatacaaaaattataaaatattacaccaaataattcttatttactatttctaaagttttaaactaatattaatgtgttttacttcttttagttttcattttagtttgttttctattatttaagattaactttcactatattttccttctcaactattttataaaaccttatttagcaaataaactaaatttctatatattctttcttccccacacaaattctctctcatcaacttacaacaaaattttggagacaaaaaagtgtgcaaaacatagctccaaatgtaatatgacagtaaaaaacattggaggatgaagttgctaaccttttaggcacctccgatttgtatataatcaccaaaataaattcactagcaattttggcaagacctcccctcttttttgaagaaattttgaagcttgctcgggctagaggaggaagaagacatatatacaggggtaggactttagtcctggttggtgttaggaaccggggctaaagatcgccgggaccaaccgggactaaagttacgaactttagtcccggttggtgttaccaaccgggactaaagatcccggggggcctgacaagccctgacagcatttgaaccgggagtgttaccaaccgggactaaagatcaaatatgtccgttaccctttttaaccgggactaaagatcatctttagtcccggtttttattacaaccgggactattgtggaattcggccgaccgacgaaagatggtttctccaccagtgcttgctcgctggttctcgaaccagtacgtagcaatctcccgcaccacaaacctccattggtgttcgagagatgattctactcgctcactggttctcgaaccagtacgtagcaatctcccgcagtgcaacctccattggtgttcgagagatgattctactcactcgctggttctcgaaccagtacgtagcaatctctcgcaccgcaaaactccattggtgttcgatagatgattctactcgctcgctggttgtcgaaccagtatgtagcaatcacccgcaccgcaacgtccattggtgttcgagagatgattctactcgctcgctgtttctcgaaccagtacgtagcaatctcctgcaccgcaaccttcattggtgttggagagatgattctactcgctcgctggttctcgaaccaatacgtagcaatctcccgcaccgcaacctccattggtgttcgagagatgattgtactcgctcgctggttctcgaaccagtacgtagcaatctcccacaccgcaacttccattggtgttcgagagatgattctactcgctcgctggttctcgaaccagtacatagcaatctctcgcaccgcaacctccattggtgttcgagagatgattctacacgttcgctggtcctcgaaccagtacgtagcaatctctcgcaccgcaaccttagatggtcgaggtacgactacagtaataacgcagcagtcctcgcacgacaacttcaaatgatcgagagacacctactcactggttctcaaccagtcaatcgtagcgatctctcgtatatttatttctagtggttgagttacgactactacctggttcttgaccagaggtgtagcgattctcccattacctctacttcaacaaagttgatatcaggtacacaatatctccaagtgttttacccagagatcccttaccacaaaagacacctagcgttgaaacctatcctaatgtccctttacaccgtcttgacaaagcctctgaggaacctaagggaacttcggctggggaagtctagagcggataaggtcttgtcggatcctttagagacgaaagaccatgtaagatctggtcgtgtaagagttcttgccgtgcgtattaaccaagccgtgtaatcggaaatggattttccaacctcacggctgggggctaggatcagtgcttgttcaaccgaggtaggtcaaaggtccaagagccttatcctccgagaacgattctacgacgacaagggtgggggctagggagagtgtataactaaacaaattgactgatcgaagtcggtaaaagagtagatgctcatatacaaaacattggtttgtaaacctaattcattttcagtttttcatacattctataacatgttaccctttgagcactcgctcgggggctatttctatctaatattcttttttgagtattggttttagaaaattctattcggcattatcaaagactccatgtctctatggttctacaccaagatcgactaaggcgagtacgacaaatgttgacaaggctccgtcgcagactctgcgccttctcgatcactcaagaacggttggtggatatcgacaaggaatacggaatgaagaaatggtgtacccgccgagataaaatttccttgacttcaatccaaattctcgattacagcaagacgggagacttagtcgcatgtcctatactttcttggttgacatcggagattgactcagacgaaccctttaggtgcccgcacgaggctgataaaggaagtctaacattatctctgaactcaccgagaacggtcacgagagctcgataacagttcctacaaggtctgcggttgggaatatgaactcgctcatttgcattgaagttgggggatactgttagggttatggataccacatacctaatagtaattgactaaatctcggtaagacccaccacataccatgtctaatacggaaacaacctgcggatataggaggagttccggataaggaaagacaaccagagttctacatggaaatgacaaggactactcgggttgtatccatattggtttccctagttctacttggacaaggggacacctatgggtataaatacaaggccccctaggaggagaggggacacaatcaacgcccaccatagacggaacaacagaagccacaacatacaagccaacatacgctaagacaagacgccggatatcgacttcagggataggcacggctagtcccctacggtgtctccggatactgtcaggagagacgaaagcgctatctttgatctcgccgggcacgaactcgaggaggaagactaccctgttatcgactacgagtcagaccttcagaccgccatgtcgacaacagttagataggctaccccacgtattgtacttgtgtgatctagatgaataaagaacaacaacggcttcggccaacaggatgtagggttattacctgacaattcaggggcccgaacctgtaaaaaatccccgtctccatctcttttacctcagtctcgcgtataccctactaccaatgatccccataccatgcaaataccggaattgcgacatcaaacgtcgacagcgagtatattattatatgtgcagagtatattatatagttatttggtcgtatatagttatttggtcgtatatttggtctatatagttatttggtcgtatattattatatgtgcagagtattaattaggaatattttttttgacagctattaattaggaatattacccatactagctacttgcagcttgggacacatgctcttccctggagcaggcagctagagcaaatcatttcggcctagcccaagaaataatggcccgcttggcccgcatgtgttccggcccaacttgcatcggcttcagttgctccttcatttttcttgctgatctcagttattgggagcactaaaacactgattatagtagtattttttttgaatgattggcacatatgaaggttgaggatgatctaattgattatagaggtgaattaaatattatatatattataaacaaaataataacttaagaacaagttgtctaagcaacgaacacgaaggaaattttatgagagaacatatatatacttttaaaagcgtggatcaaataaagttttttttttaagaaaacaaactttgaaaactgtggagcaagtaatctgaccagcgacaataatccggtggataatctgaaaagaatgaggtcaattagggcttgttaagttcgcaaaaagaaaatttttgggtgtcacatcagacgtttgaccagatgttgaaaggggtttttgatacgaatgaaaaaactaatttcataactcgcctgaaaaccgcgagacaaatttattaagcctaattaatctgtcattagcgcatataggttactgtagcacttatgactaatcatggactaattagactcaaaaaaaattcgtctcgcgatttccatgcaaactgcgcaattagtttttcattttatctatatttaatattttatgtctgtgtccaaagattcgatgtgacgtttttgggaaaaaaatggaaactaaacaagcccttagtctgctaacatctcattcttcctgcagtaaaaccctttctactgcggttccaaaaaaatgagtctaccctacgtacgtggcttgccctatttttctaactgacatgcatggaacattcttttggagaatttatggatgtattttgaaacatcagaattcttttgtttgaggtaattattaattaaacattccataccaacatttccagacatccaaattaaaggtctagacagtgatgttcaccagtttatttctttttttcctcctttcaaaagtctggcaaatatgttcctacatcttccatcaaattccacgtagtttttacttaccatccaagcttcatttttcttgaaccatgcatggtccatggacaaacacacgacgatgacacttttagtcgtttactgttcttcagctggaaatgcagcaatcctcaaatcagctccaaacttgggagatctagcctgccggaaaagcactgggttgttcacacaagtgaagcagactgaaaggcacatctcgtcgtgaagactccggcaccaagaactaggtggatctagggtggtcccgggaccacccaaaatattctagccaatgcatatatacacatatgtgaaaagaaacttttgaaaaaaaaaagaaaaagaacttgtttctaatatatattatgatgcacatttgatctatttatatatttaaagtatttaaaaaattatataagttggatcacccatataaaaatcctagatatgcccactgaccaagaccttgctggctgcaggtcttgccgtcgctacctttatctgaagccaaaaaaaaatacgtacttaatgtagaggctgaattgaattttagtatatgtatgtatctctactactttataagcgaagtcatcctccttttagttatctcctcatctcaacacgccagcacgttcttttgtcacttttcaattatgggtttagcccatgcattaatgtatgggctctcagtctatttcagttatatagatctgacccgttataacttatgggcatgtaactagtatgaaaaaaggagcattaaaaatgtggtcaaatttcagtcaaaaagaaatgtggtcaaattggtatgtatggttattcagatatgaatctttacatgatcgatcattcaagtacattgaacctgcctagcaacgtgccggcctctctacctgttattacaattaatcatagtgtttcagacctgatcgtcttaatttatcttttttgtggacaatggtatgccaaacatcgtactgaatgaaaaaaaaacagtcttcaaggtactataatactgtggaaatggtttttattgtggcttaaaatcagtttataaactgtatatgattgagaaagatgctgataggggaaaaaatatggtaagcttccttgcaagaatgcttggctctggattgattcagagatcgatgatccatttgtgatggcctgatcctttttcacaggactgacaaaacatgcatgcatggatggatgccaaaacctttgcagtttgcagtcaaagatgtgccacagtacttaaaatgaaatatttgacaaagatgataatattactgaatctagttttatacatgctgaccattcactggctacagttgataaaatgccgttttttgcttcttgatcgacctcagtcatatattgacagtagcaccaactgatcagagaataatcacatggttcttgcagtaagtaaacctactgattagagggtaggtcatatgtatctttccaactgacagggtataaacggaagaacagtactgttcagagaatttttagattttttagataattaaccactgcagtcaatagcaacctctccagctgtcaagagaggtcctaattaactacactgattttcatcagaccgtatatcaaaagtcctgccaaccaatttgtcgagactatgcatgcatgtaattcgcattttttttctgacatgagtacattcttagaaacatatatatttacgacatgaggactcatgattcacattttggacttttgtgtctttttgactgatactggcaaaatgccagtacattgctacgtacggaatttaaaatatcacatcggtacattccaaaaagaaaaaaatatatgttaaattttagtctttagagcctaattttatatttagttagagttttttttatcttcttatattttagctataaaaaagtttaagtggattcaactgacttacgttattgcatacgttccatcccttaaaaaagttgcatcgtcaatccataaaaaatatagaagatggcagtgtgtttattctttctttcttttaacttcagtaaaacatgtctaataatccgcaactagcttatataggcaagtcttagatgtttggtggtagggttataatcgcttcttacttttaatacaagataatccaacaaatgtaattgatatgtgtgagttcgatatcgtacaaacgattttgtcccaaaaatattattgccgttagggttttgtccattccgtgtcgttaaatatactattcatcctatagcatttaatggcacgagatggacggaagtctaacggcgatggtatttttaggacaaaatagttcgtacgatggtatttattggaactcacacttgtcgatggtatctcttggatttggacgcttgtcaatggtatttcttggattatctcttaatagaatcaaccttgttttagaaaaaaatagcatatgtttattgattgagcacacaaatctactacgagaatatgtgtcaaacatactaatcctactaaaagtttgaacttagagttggaatatgtgtagcatagagttaaatcggactctatcatagattcactcttaaatagagagagtgacaccacaatgtaatcatgacaactacaatttagtgtaaacgcgtagggagaggatagcgcggcgagcccatggactcgtagcggttatgtgctatgttgattggggaggagcacctataatcagaggcctaaagatgtaggttttcactaaacttcgttaacaactattgtgtgttgatgtatcgtcctttagtgtatcttaatggatgatcactgtaccgactaacgtttataaaccgaactaacgaacacccttttccccaccaaaagaaacaacaaaaaaggcgtaacagacacgtcccgcgaatcgtagagggacatgtggctagacgtacgaggtgctggctactgctccactcgcttagagcaagtttaatagatcctagttagcaggcggtaacatgttccacatcatcaaaatcccaggtggaggagtgagaagagacgaaaaagggcggagcgggcggtccatttatcgcccggctgaagcgtgccgtacgagaaaaaaaagccttcttgcagcccgatgcgagcgtatctgccggcgcttcgttcctcctcctgatcccgtgcgtttctctgccccttcgccgttcctcctccccgatgccagattccttcatccgcgtgccaaattggcctcgcctcccgccaaatcgatgtataaatcctcaatccactccaaagcaaccgagtttgcccccaaattgtctcctcctaaaccctagatgctaaattcgtcaccaacctgcagcaagatggggcggcagtctcaaagggcatgtgtgccgacgcctatggaggtcccgtcgccggggaatcagccgatcgcgccgccgctgccacctcagttcatcgtcccgccttcgtttgcttccacctacagacccggtgcattgttccctgcagtaataacgcagtccatggcgccctcgtccgcaccatgttggttcaccacgttgcagcaaccaggcatgactggttcgtcgactcaaggaccttggttgttctctactggaattagtccatctacggagaatgctgagcgccctgatatccatgcgttgtatgatactgtccctctcttctcaatttttttggttgtttaattttttttattctgtatggatgatttttctgcataatcgattgacatggtagtagtattcagccagcagccggcaaaagtattagcatcgctcttacgtcgcccgcgtgggccgtagtgcatgtgcctcatgcccacacgtgaaacggcgccgctcatctagatatttctcactttagtaccataccgcgtgccaagcagcccctgggcccagttatatagcttcctcctcccaaaattaataactcgtcccaatacctatatataaaggcctgatcagtgatcaccaccaccactcgcttcctgctccctcaccccacttccacttcatcgccatgagctcgtccttcctcgggccattcaccgattttgactactcatccgtgctcgccgccggcgacttttttgccggtcaccatcctgaccagccgccgtcgccggcggaggtggtggtggccgtaggcggaggtgatgccagtgggaagcggagtttccaggccgacgacgacgatgccatgggcgtcgtgtcccgcttgtccaagaggacgaggaaggcgccgtcgagttcgagctcgccgtctcacagcgatggcggcggcggcggcggcggcgaggggaacgagccggcggcggagaggggaggtggccggcgggtgtgggtgcgggagcggagcacggagtggtgggaccgcatgagggacccggcggcgtgcccggaggcggaattccggcgagccttccgcatgccgcgcgcggtgttcgacaagctctgcgacgacctggccgccgccgtcgccaaggaggacaccacgctccgcgccgccatccccgtgccccagcgcgtcgccgtctgcctctggcgcctcgccaccggcgacccgctccgcgaggtgtcccgccgcttcggcctcggcatctccacctgccacagcatcatcctccaggtctgcgccgccatcaccgccgtcctcaccagggtcgtccggtggccggactcccacgccgcggccgcgtccaggttccaggccttgtccgggatccccggcgtcgtcggcgccgtgcacaccgagcacatccccatcgtcgcgcccagggagaacgccggcgagtactacgaccgccgcctcaccgaccggaacaacaaggccacctactccgtcgccatgcaggccgtcgtggacgccgacggcgccttcaccgacgtctgcatcggccaccccggctcgctctccgacgccgccgtcctcacgaagtcggcgctgtacgcccggtgcgaggccgggctgctgctcggcgacgacccgcagtggctcgtcggcggcgcgagctacccgctgacgagctggatgctggtgccgtacgcgcagccgaacctgacgtgggcgcaggagaggctcaacgcgcgggtggccgacgcgcgcgcggcggcggtgggcgcgttccggcggctcagggcgcggtggcggtgcctgcggcggcgcgccgaggtgaagctgccggagctccccaacatgctgggcgcctgctgcgtgctgcacaacctctgcgagcgcagcggcggggagctcgacgccgacctcctacacgacgagctcgtcgacgacggagtggtcgccggcggcggcaatacagtgcgctccgccgccgccgaacaggttagagacaggatcgctcacggtctcctccatgccggcaacactgcttcgagtagctaccaagattaccattacgggcggttataggtgttggaatataaagtgaattgtccatcttttcttatctgtttaatcttttgggttgaactgatccgtgtatgcaactcaataatagataaccgccgctagtaggttcacagccgataaccggttaaagcctaattggagggaggttaatttctagctatcctgattccataagaacatatgaaattatatatttatttatagtttaaggtaaaatttagaattatttctgcatgttaccggttacaaatttaattattggatttgcatttttatcggaataaattcagtaaccggtggtaattaatcaacttgttattggatcgggatatcctccgagtctagtaattattctagataaaccagtgtttcggaactctggtagatactttgcttatactataagaatttgatcaatttttatggtgtacaaaggttttataggacaaatgcaagattgattcgatggatctcagtataatgtatgtctcatgtgtttatgattgtaattgaaatttgaataattatcagaacacaaatttcatctaaatcttatattatgtttgtatacggttcgatcttatactagacatatatatccttgaactcaaatttcaaaaagggctacgttcactacgccagatccttgcacctgtgacggcatatctgtgacgggcataagtgctggtcagtgatgagggtcacctttgacgggtcctacaggatgccgtcatcggtgagccatcaggaggtgacccgtcacaggtaactagtcacctgtgacggttcaaaaatgaaacccgtcaaaggtgaggtaaaattacatgtgacgggccaaaaatatttagcccgtcacaggtaactagtcacctgtgacggtccaaaaacaaaactcgtcaaaggtgagataaagtcacctgtgacgggtcaaattttatgagcccgtcaaagatgataaaaaaaaaaatctttctcataaccctcccctctcatcccggctcatccttatcctctactaccggctcatccttatccatctcaaccactccccccatctctctctccctctcaaccctctctcttcatcgacctgtgtcggaggcggagacggcaccggcgccggcgggtgcgggggccgcgtcgtggtgaccgacgtccgcctcttcgccctctccggctcttggggctcgtctcggggagcagcggcgcggcgccgtccatcgtccatcggcggggaccagaggcggaggcggcggcctccttcgcccacctccgaaggtcgccgcctccttcgccctcagcctcatggtcgccgccgccgtctctccgccgccccgtcgtcagctccttcgcccaccgcctccgggtcgccgcctccttcccgcctgcaccacgccagatccgggtagcctcctccttcctgcctccaccacgccagatccaggtcgccgcctccttcgcccccctccccgaccgccgggcgccacggccgccgtcccccgactgctaggtgtcggatctagcctccacgaggttgggggacacggatccgcccgcccgccgccgccggttgttcttgcagcggcagcggcgaggagggctcaacggcgcgcggcggtgcagcggctcgacgcagcggtgaggagggctcgacgacgtgcggcggcgaggaggaggtgagtggcagcggcgccgcatccatccccatcctcctcccccttctctaatttctagattcggtgattcttggagcggcagtggcacggattttgtgaatgtgtgatggatttgtgaatgtgtgtgatggatttgtgcatgtgtgtgatggatttgtcccttactgttatgggtgatggatatattgttgatgagaaatttaggttatattttggctaatttgtgatggatatattttgtgatgcttctgtttactgctgctgaaatataatttctaaatattggctagcgatttgctagccaatatttagaaattttttttgtctggatgtacctcatcactgacggttcatattgaaaaagccgtcacaggtaaccataccagtgacgggttacaaaatggcatgggttagcgcagacacttacctctgacgggcggaagagttctagcccgtcagaggtgactgtcatcagtgacggtccttcacccgtcaaaggtgattggactcaccagtgaccactgatcactgaccaagcccaaagccgtcaaaggtgagggtttgggcccgtcacaggtgaccttgtccagtgtagtggtttcttttctcaaatgagaactatccggtacgttcaacaaattaagaaaagttttgcttgctagcacgcactactggaatgtataacagtatcatgctattgctctaattaaaatttctgaaatgattgaagatatatatcattttggagcccgccgggcaccatgatgccccaattaaatttagtattaattttctaacaagattaattaatactcgattggctttttttatgaccatttaaatatatttttgcgaagaaaccctaataaatccttaacatgagattggtttggcaatgcatgtcaaatcatcatttcaacgtgttccctcgcttatcctatcttactataaagttatcccccactaactccttaagattaacatgcaaagatgccacatcattatccactaataagatgccacatcatcatccactaattaacaagatgccacatcatcatccactaacaatcatcacatttaaacatcatgcaaatatactatatctttatagtttttataatttaagagcttttcaaattcaaacatgttaaattatcatccaacataattcacataatgtttcaaatacaaacatgttaaattatcatccaacataattcacataatgtttcagtgtatatctttattatgttttatgatatcctatatacttatatagttcatcctcacttagttagtgcttaaatgattaatctatggtccaaattatctctcctttttttctctaattaagtcatatcacatcaattgtttttagccattagatgattaatgtacggttcaaactatctccctactttttttcttccataaagtcataccaccttactttttaagtttgaatcaccattctacatactatttaaatttaaattatcataaaccacattaatttacttaatctgatgttatctagctatcttacacgctattttttttattgttatcatactaaatttccgcagtaatgcgcggggtttcacctagttccatatatatggatgctctcatgtaatcttaaggcatccaataataacatcttaagaaaaatcatccataaattgaagctttctctgatcgttatgattttatcaccggaaattacgccctttttccactcgggggtgatgcattaattaacggggtgatataacaaaagggttcatttttttatttcattttcatgtgcatatgacttggccgcgtgcaaatctctgcatgttagccgtgcaccgcagtaacagttggtgtataatctttatcgtcaaattaattactttatgataatatactacatatagaatacattccggcatgtcgagctgcaaatttaatatatccctaatttaatatgactggctgatttattttctaagaaacatagtataaacgtagatgctcgtaacacgtgcacacacaccctgtaagcacacatgcatatcttatccgtattagcacctctagaagactaagccggcttatcttgaaattggcgaagtcaccacaggtgcctcgttatcaatgggtatgtagcttaccaattaaaaaataattagccgtaattgcgagcacccgtgccatgtctaggatttaaaatcggatttaaaatatatatggaagtctaaccagtggctaaattttggatagattagggacgcgccggaacgtgcatgaagattttgattattcggattatgaataaattagccaaagaagaatgtacatgtgtacataaaacacaaggtaaaagcttttgcctttgcttaagaaaatagttgttggtaattagctttgctttagattcgcaaatatttgtatgtaatctaaaaagagtctaattagatggttcagctgccaataacggtagatcttgaatataccgaatttaaacatttccagtgtattggtacacagccataaattaatgcagattaataatagcattataaagctaaggcacaatttaagccacttggcaggtgaagtggtcactattgtagaaaccatctttatccggtcaggcaaaaaccacaataatcccggttccaataaaaaccgggactaaagatgggttttagttccggtttataagcaaaacgggactatgtgctctttagtctagtcctggttcatatgctgtcaggggctgccagcccccccccctcggatctttagtcccggttgataacacaaaccggaactaaaattcgatgtatcgtatataatccctaggacttatcctcccaaactcctcatctcctattcttactctctcttatcattttctttgcactatcctctccttccttctagctacagatggagcttatccttttcttgccttatcctctccttgcagatcgagcgaggagcgaagagcgaggacggcggagggccgcggcggccggcacgcggagggcggcgcccggcggcggccggcagggccattgcacgaggatggaagcggccggtgcggagggccgccgtggtggtcggccgtgcgaatttgttttttcttttatcccttgtgaatgtttgtttattgaggataatttgttcattcgatctatgattttagaatgattgttgttgtggatgatttgagattgtttgttgaggataatttgttcattcgatatgtgatttgagaatgactgttgttgtggataatttgagatgattatgttgttgtggattatttgggattatgttcttgtggatgatttgggatgttggaaaatgatgaaaaaaaacttagtcccggttggtaacaccaaccggtatctttagtcccggttatttcaaccgggactaaagatattttgtcccggattcttagtcccggtttgcaacccgggactaaagggggttgtaaaccaggagtaaagatggtttctccaccagtgggtaatgttagccaaaaagacacgagtctaattaaatggaaattgttatgcatccgattcaactatccaactcacacacgactgaatttgatcaacggttgcaaacgactacagtgcatatgcacatgatctcctttaattgatttatggtttcatgtttttagttgtacaactggatagtatgtatagcattactcaattaaaataatttcaaagtgaggcgtgagtctcgtgtgcacaaatatgtttcaaagaaggtacaatctcataaaaatgggaacatgtggatgctaaaattatgtggatgtcagtggaagatgctactgtcagaagaaatcggctggcaaagacttttaatacagtcttataataaatcactgtagttaattaggacctgtttgacagctggagatgttgacatggaacccaatggttaattcaaacaaaggatatgataagaaggtttccaagacatataaattcttcaacattgttcttccttcaagaaccaaatatacgactttagaaacaataattgtcctgcaaccaattactgcattttgtcaagaacaagtgaaaaggacattttgtcaactgtagccaccacattttgtcacgtagaaaaaacttgaaattactatctctgtcatttttcacacattccacacatatcaatataaaataataggattaggataccctccactttatcaaatcccaataaagttatcctcacttccaatgcatttgtatcctactttcataactccaatacaacttgattgcttaaaaagaaacttattgtgagaccaagaaaaagaggcaaaaatcaatttattttggaatggatggagtatgtaattttatcagctttgtcaaatagtatttccattttgagtatactatatatagcacacctttgaccgcgaaggtatatatgctcacatgttctgggagtcctgctaacaaagatcaaaatttgacaatcaactccgtcaaatggatcacctctgaaccaatccagagccaagcatctctatgcaagcgcttatcagtattattcggcctacctatcagcatcttattgtatacaggaattgtatcagatttgtagaatttcttcagcatttgcaaggcatcttgcaagttcttgaattcgcctgctgcaacaatctggcccttaaccctcctggcctatatatctttgttcagcatgaacccatgtgtattcaatttcagtgaatagatcttcagttaattattggcagccggtttttaggcaactctaagaatggaattaatgttctcgatcgcatatcacatatattcccactgacatagctgtgaacacaacatatacatcacaaccagcactgttaatttactcacttcttaaacctgtgttatagtgaaaataattacaattctgtcttattatgggaagaaaaggttgaagtaaaaactgcagttgcccaactctgaatttccttgacatccattatatttacgactagtacttaaaaaatagctatccacacttccacaaattagttgtggagctaggatattcatttttttttaaaaaaaattgatccatatatgaatgaaattaagacaataaaatgaccgtgacaataaaattgttccgtacacgaactattcataattgtgaagcacaataaagtgacaatgacaagttttaaagtaccaatattagcaaaaatatgccattcaagatatgtcctaacgagccagctcatctctacataaatatcattgataaaagtgtgtaattaagctgaaatgataaatgtgtcaacttagggctgctaacagatggaatttttgtccatttaaggtgtattattattgtttcaattcaattttctatgcacatgcataatatatcaaatgattttttttgtttgccataacttaatggatattaaacttaaatactctctctgccccactcaataaggcgcacacacattttaagactcattaaatatttgacctataaatagtttattataattaaatttattatgattttgttgctagaaacattataatacatgagtaatttaaataaagatttatattgaaaactctgcaagtttgactgtgactaaatgactaggatggagagagtacccatgaatcacattggatcctcccttgtcagaaaccattcaaacccactaggccactatatggtccactagctagcgagtgggcgaatgccactgacccatattttctacatatatatgtagacaaacatttggctgtacgtaggagttttgacggaaattaagttcacgtcatcaggtgggaatttaatcatatatacgaactttcgaccctttttttttttgataaattgatccttctcaaaacttattttgaaactagtccttgcaaaaaatttcaactaaaaatatgccgtcaactcagcgtcaaggacattggcgctaaactctaatcgaggtgacatggatttgccgagtcatcataactcatcgccaagatatttggcgctaaagtcctgacgatttaaattaatgtaaaggcgttcatttccaatgaaccacctataggacaatggtagcaagcttcagctatagccccatacaccaaggttcggttcccatctctccttttttttgttcttttcagttttcccatttctcttttctctctcttcatttatttatatgttttttctttttggttctctcattttttttctctctctttatctatatttttccttttctgtttgtctcgtaatattatcttcaaacgatatactttatttgcaacttttttcttgaatttgaaaaaaaatattaaagtggtatattatatggcaaatgggaacttaaaccgaaatttcaaatcaaatttaaaataaaacaaattatagaaatttaaaggagcatatacttctttcatattggcactcaaaatcaaactcaaaataaaaaaaatttacaaatgaaacaatcattttgtaaagaataaaagtgagtagtcaagagaaaagaaacttattttgtcttactctcataatattatatagattttaatagatagtaatctaaatactatataatttaacttttcaaatatgcgatgtaaattgaaaattaaaataaatttataagtagaacattttaatttgaaaagaatggtaggaaggtatgctaggaggaagtttgtcttactctcctaatattatatagattttaatagatagtaatataaatattatataatttaagttttcaaatctgcgatgtaaattgaaaattaaaataaatttataagtagaacattttaatttgaaaagaatggtaggaaaattatgctaggaggaagagaaaaggaaaaaaaggaaggatagtagaattcaaacccagcaccttagggctcacagttgaagacttcaaccaccaagctatcacagttttgttgcaatataatgcttgcgcatctatttaatctcatttggacctcagcaccaaatcacttggcgctgagctatgatgactcaacaaatttatgccacctcggattagagctcagggccaatgctattggcgttgggaagttatatctcagcgccaaggtccgtggtgctaaatccacggcctatttttggttaaagttttttttaagggctagtttcaaaataagttttttgaaaaggaccaatttatcaaaaaaaaaaaacggcaactttcgtgtggagtgcaaacattgagaaactttcggtcagctcgcacgacaggatcaatttcaatagcaaattaaagtcaacacaagtagtgtttacaacttgcctataaacttcgtaaccttgtacttccctatcacacatatattccctcagtctcaaaatgatataagcagttcgatttaaaacttttcacgaagagtaatgtcgacgtttgatgttgcgattccggtatttgcgtggtatggggatcgttggtaccaggatatacgcgagactgaggtaaaagagacagagacgaggatttttatacaggttcgggcccttgaattgtcaagtaatagccctacatgctgttgtcgacaacatgctcttattcattataatcacaccagtacaatatttggggtagtctatctaactgttgtcgacatggcggtatgaaggtttgactcatagttgacaacagggtaattttcctcctcgagtctgtgcctggcgagatcagagataacgctttcgtctctcctgacattatccggagacaccgtaggggactagccgtccttatccctgaagtcgatatccggtgtcttgtcttggcgtatgttggcttgtattggcttctgttgttctgtctatgttgagtgtgtcccctctcctcttagggggccttgtatttatacccatagatgtcccctgtccaagtagaactagggaaaccagtatggatacaatccgagtagttcttgtcgtttccatgtagaactctggttgtcttttcttatccggaacaactcctatatccgcaggttgtttccgtataggacatggtatgtggtgtgtcctgccgagatttagtcgactactattaggtatgtggtattcataaccctgacaagtaagtagagaggcgtaaaattaaattaaatatgattgtaattaattaagatgtaaaattaggtgaaaaaaaattaaataagcagaaacgattatgattggataagatgaagtcgagaagtgatggtatcttatgagttttacgagtaactttaatgttataaatagctactatattctagaaaagatgacgtaacaatatcgtacacgtacactgtaggtgaagatgattaatttatatagaaacctgacctgtaacgggacactactacaaaatatgaaataaaaaaaaaatgacatctttaaacaattatagataccgattttttttaaaaataaacctttaatattaaaaacccgcacctcctaattgagccgagctgacgggcccaccacgaacgacgagataaggccccggtatcatgaggagataaggcattcacagactcttgcaaatctctctccctcatctctcgactctctctcgctgctcgtggccggtggaggtggcggtggccgcgccgtcccttccgccagatccggggaggggcggcctagcggcgggaggcggcatgtggcggcggaagggaggggggatgcagcggcgggacaagaggaggtggcggcctggcggcggcgccctccctccatcggatctgaatgttcttcaatgttagtgaatgatttctgtgatgttctttaatgttaatgaatgatttctgtgaaagatttctgtgatgttcttcaacgtttcttattctgtgatattgtttgattggagattggggattgcgattgatttggagttctgtgatgtggggtggatgagctcgatgcatcggctcaatgcattgagctttttattagctcacgaggggtctcaaaggtgccggtttttaaaataggattggtgttagagcactcatcagtaccgcctccgtgatgccggttaggaaaaccgacatcttaaggtgtttcccaaccgacaccttttacgtgttctgtgttagtgggagaagcccgtatagtgtagtatagtcgatcgtctccaatcgatagaaatctcgtaatgtatcgtacatgtacactctaggtgaagaggattaattaattgggaattaaacctgacttgtaacgggaaaagacaggctagtgtagttcaatcggtagaaatctcataatgtatctcatgtgctgatgtacgtacatatagtgatacacacagtactatgtactccctcctaaatatagaaatttatactaccattctgaaaaagaaaaactctatctctactaaattcgtactccctccgtccccaaaaaaaaaaaaaaaaagacaaatcttgagtttccgtgtctaactttgactgtccgtcttatatgatttttttttataattcgtattttcattgttgttagataataaaacatgattaatattttatgcgtgacttgtctttttaattttttttataattttttcaaataagacggacggtcaaacgttaggcatgaaaaccagggtttatcttttttttgacgagggagtactgagtagtacctattctaattaaggttttatatattttcggtaagacacggagagtacgtcttgtctctctaggagaacaaaacaacaaagcacgcaatatttggatggaattgacagacgtacgttcaaatgagagaagtggcggcggccgccgggcggggtcggtggcggccgggctgggaggcaggaggaagaatcttttggtaggatttgtgttgaatttgttgtttagaatttgtgatgtatttgattgtgatgtgaataagtgatgttttgtttttaaatttgtgatgtaaccatctttgagattttgtgatgtatgatctgtgatttggagatgatttggggatttcacgatttgggatgattgatgtgtgatttatttggggatttgacgatttacggataatttgggaattgagtgaaatcaatatgcaaggagttaaaaataataaaaaactaaaaaaacatatcaatcgggacctggcctcttccatcgttaccaaccgggactaaagatttcatctttggtcacggttgttaacaccaaccggtactagagatatttcacccgagactatcttttgtcccggattcgtagtcagtgttagaattcacgttgtcaacaatcgaacaagtacacacgaacacacggacacgaaagtggagggcaatcaactttattgatgtttctctctctgttacaagtattactttgccctcaacctcactattgtatttatacccacaataggatatcctatatggatacatacatatatatttggtataagcccacttcattaataaggaaacagaagaatagaaggaggaggtaccgtgatcctcatgatcacggtcctacaaatccgactccttcgggagatcggtttcataacactcccctttggatgaataccgcgctatacatatgcctcatcaaaactccttccaaaaatccagtgggagaaaaggaataggagaaggagtacatagtacacgctacttatattgcactgttgtctcattaaaaacctaaatgtgagaaacttcaaagaaaactcactaaagggaaaaagagtacaaccataagctaatctactggataactctttcattcttcaagaatgatatactgatctgcatgatcaatatcaacggaacacagttagggaagtgctccccttgatttgtgcacatctctcatcctcctcataccgatgccatgcacaagcttctcaaaaacactagttggcaaagacttagtaaataaatctgcgagattttcactagtcttggtgagagtcaccttgatttttatttcttttgcaattcatgcatatagaagatttaggcgatatatgttttgtgagactcgtcttcacataacccatttgtatttgtgcaacacaagctgaattatcttcataaataatggctggagttggtgtgatatttagtccacatgtattctgtacatgttgtatcaccctcctcaaccacatgcattccttgctcacttcaaataatcctataatctccgagtgatttgttgatgtcgcgaccatcgtctgcttcgtcgacttccatgagatggttgtaccaccacagagaaacacatacccagtctgtgacaatgctttgtgggggtctgacagatatccagaatcagcatatcccgccatggttaaatcttgattttttctaaagaataaaccgagatcttgtgtgccacgtaaataacggaggatttgcttaatgtcattccaatgccgtttggtaggagctgaactgaaccttgcaagtaggttaacaacaaatgcaatatcaggcctggtaccattcgcgagatacattaaagctccaattgcgcttaaatatggacattcatgtcccaataattcctcgttattttcctgtggtctaaatgggtcactctctactgctagagatcttactaccatgggggttctcgtcggatatgaatccttcatattaaatttctccaatatcttctggatatatgcagactggtgtaacaataccccttcaggagtgtgctcaagctgcagacctaagcaatatttagccttacctaattctttcatctcgaactccgtctttaggtaagaactagcttccttaatcacctgtgtggtctcgatgatattcagatcgtccacatatacagaaataatacaaaatccatgttctgattttttgataaacacacagggacagtcatcattcttgatgaatccttttctaggaattcactgagccggttgtaccacatcctaccggattgttttaacccatacaatgatcgttgcaatttaacactgtatatgttgcgttttgtttcttcaggaacttgaatcccgtcggaaactttcatatagatttcagaatccaatgacccatataaatatgcagtcactacatccatcaactgcacttctaagttcaaattgactgccatagatattaaaaaccggaatgtaattccatccattacaggtgaataggtttcatcgaaatcgatgccaggtctatgcgtaaacccttgtgctactaatctcgctttataccgaaccacctggttgttctcatcctgttttcggacgaacacccatttatatcctacaggggatatccctacgggggtacgatcaacaggaccgaatacttttcttttattgagcgagattaactctgcctttattgcttctttccatttgacccagtcttaacgctttttgcattctgccatggactttggttctgggtccagatcaatgatcttagcgatcttttcggcaaagtatatgtcgacaatagtagtctctttattgtatgtttcacctgtatccacataattggtggatatttcctctattctttcacattcctgatcttcattgtttcctgcaatgtttaagtcaggaatttccggtctcccagtgctagtagtaattgcgcgcgcattctcactaggttcattgccatctgggcatatcactgcaggtggctcatcttcctggtgagctccttcactattctctggtgctgtggtattctgtccaatctgttgtttcgtaggacgtctcctagaaactttagtttggttgtgtgcaaccggtggtctccccctcttcctagaagttagggtagatgtagaaattaatttgaaaaccggttcctctgcgtcatgaggtatttctattctttccggtgcattcacagcaggtatatgagatttcatgatcccctttgggttagtgaaggcttctagcagattatttgcaattctttgcaaatcaattatgctctgaacttcatggtcagattccttagtacgtggatctaaatgtaggagatttttagtttcccactcaatttcgcggcattcgaccttctgtaggtactttcctccccctaatgctgggaaatgatcttcattaaatatacaatcagcgtatcgacccgtatgtacgtctcctgtcaatggttctaaaaatttaatgatagacggagattcaaatcctacatagattactaattttctatgaggacccattgacgtacgcttaggtggcggtatagggacgtatacaacacatccaaaattgtgcagatgggaaatatttggtgcatatccacgtgtaagctgcataggggatacaacattgtatgcagtgggtctgatttgaagtaacgccgctgcatgcaaaacagcgtgtccccaacatgtagttggtaggttgctatgcagtagcaatggcctagcgataagcttaatcctcttaattaatgattcggcgagaccattgtgagtgtggacgtgtggtacagaatgttccactttaattcccaaagccatgcaatatgcattaaataccttagaggtaaactccccggcattgtccattctaatggattgtatccggttatccaggaaattggctctcaactagattatttgggaaataagccgcgcaaaagcgtgctttctagtagaaagtaagcaaacagtgctccagcaagttgatgcatcaattaataccataaaataccggaatgatccggacattggattaattggtccacatatgtcgccctgtattcgttgcaagaatactggtgattctgcgtccacctttaaattagagggtctaacgattaatttccctgttgcacaattagtgcaaacaaaatcttcttggtttgggaaatcgttagttcgtaaattatggccatttgaagtgttgcacaatcagtgcaaacaaaatcttcttggtttgggaaatcgttagttagtaaattatggccatttgaagttaagatgattcttctcatcatccctagaccgtattctgtatgactcaggatttttaaatattgttttcagtgcaacattttcgggttttatatgagtgtagtacagtccagatttcaaggaagggagtttttcaacaacagtcttatgatttccgtctaatttcgttatgagaagaaattcgagtttattctcatctttggtttctacgtgataaccataagcacggatatctttaaagattagtagagtacgactggactttagatataatagagcatcatttataatgatcttggtaccatgtgggagaactactgttgctcgtcccactccgacgatgggtgcattgcttccggcaatagtagcgatttgaccagtctttttctttaaagtctggaaatacgtggtatctcaaaagatagtattggtggtacaacagtctaccagacacatctcctcttccattgccatagtacgtaacactgttctatcataaagaatttaaatatagtcaattcatgaccatatagcaaaaataacactttaagatagaaaaataaaaatctggagaatatattaaactaaaagagttcactcaattattaagataaccacgctctgaaggagcttacagaaactatagttctgctaggaacacaaactaaatgcacacttgaaaaatcacctaactttagtctattacatagtctaaaatttaaagtaacttataatgcaggaagctaagatacaaattggaagacttaaatgtccccatataactgatcagagtccatgagatcatctgagagcttcagctctgcgtctgctgcattcttttccatcttatcatcgatgtgcattgcaaccactgccttctcgtcgacctgcttgtcgatatgcatggcagccatcttctcttctgagtgctggatctcaacagtgaagtgtgactcatgctctgacttcttcttcctgtgcttctcttgataaagctcaatgagatgcttaggggtgcggcaaatgcgagaccagtgtcccctagtgccacacttgaagcatacctgatcttgctttccatattcaccactagtagagcccttcttagacttactgttctgatttcctttcttcttgaaagacgtcttgttaactttgccaccatttttccagaaattcttccctttgttctggttattctggtttttccccttcttaaaggagctagcatttgcttcaggtgctgctgaacttccagtggggcgagacgtatgattttcaacaagtgtctcatcttctccttgtgcttcgatgagcatggagaccagttcagaatacttctcgtatttagcctggcggtattgcctctgaatattcacatgattggcatggaaggtggacaaagttttgtctatcatgtcagcatcagtgattttctctccacatagcttaagacaagtgacattgcggtgaagaactgagttatattgctccacagatttgtaatcttggaaacgtaagtgaagccactcacgttttgtttttaggagcaaggcctttacttgatggccatagcgatccttcagtgagtcccaaaggaccttcggatcttcctcagtcatatactcattcttgagagtagtattcaaatggtgcctcaggaaatgcagtgcctgatttttctcagctgaagttggtaaattattaactcctccagctgatgttgcaatagttgggtcctgaatgcagttcaggagtttcttagcaccaagcatgattttggcatccagtgcccatgtcaggtaattcttgccgctgactgctagttcagcaaaatctctcttagcaatatcagtcattttcctacattagtcatgcaaaattcaataagtactgcaagtaggagcatgacaagtgtgcaaatagtaaattctggttatctaaatttagtactgtgtcaatatattcccataattctcccaataattttcagaattgtttcactaattatttaggtaccaaagtaattactgaattactaacccattaaatagtattctgaaaacagctaggaaaaataaaccataaacacgatgctcaggttcaaatgatgagagctcattgcctaaaaaccatgtctctaggattttatggttgattcaaaaattaactaataaatagttaatatacagaaaattgaaaatacggaataacaaaaataatctgacattctcagtaatttctataatcccgagggactattccgctaaaattccaaatccgcgtgtatcctgaaaattctaggacatatttagaagtttgccattttcgggccaaatttcgatttgagcccgactccttttataggcctaatttatactcggcccacctctatgtaccggctactcaaattttaaccggcccgtcgggaccgtcggcctgctaatggccttggcccataagcggcccaacaagagcgctgcaccttatccaatcgggtggctagggttgaaaccctagcccccaattccaccgattcgatggtggcggcgagtatcccggcggctcatgcgagtgaggcggcgaggttgacggggctcgtcgtcatggcggggtcgacagagctcgtcggcgcggcggggtcgatgacagaggcggagcggcggtgaggctacaagcagcactgacgctggcgtggttggctacgggccgtatccagcgtccggcaagcgcagctccttgctgtgcgccggcggaatttggctcggcatgtgggccggcaaggcggacggctatcagcggcgggaggccgcggcggcttcggcccccgacccagtcgtgtgcggtagcgctggaggcgtgctgtgcgtgccgtcggcgggggggatgcgggcgcggtctcctcagcgtctctgcgggcggcggtcgtcgacggcgagtgcggatggtcgattgaagacccgtcggctggcttttcaagggcgaaccgacgacggaaagccgatggcacgattctgcggccatcggtgaagggggtggctggcgacgcgtgctggcggcagcaagggcacgacggcgcatgctggcgtcatcgactcggtttcgtcatcgtcaacatcaggaggacggcggcgctggcatgaggatttgggccaattcgttcgtaatcggcaattacgttagccaggtacgcgattcttctcatgtgcatcgcgattacaccctgaacgtagcgtcgcccttcgaggcatcactagttctaaaccgtcgttcttgctgtggcttgtctgatccgttcgcgcgtctagggcgtacggtatccgtgtctttgtttgcaagaaaagaaacccagcgcaaaggctgggaacagatctaatcggactatagcgataaccgcttctcgttcgatagatcggttgtacaagggataaccccatacgcctgtcgcgcatagggtggagagctgcaaactctcctgctacgtgcgccataagggacaaatccacgtagtacaacccatcaatcgaacgattagcggagaaataaaaataacagaaaacgatctagcaagtttatcgttatccctatagaacgagattagaacagatcgatgttgacaatataccttggctgaagagcacctcgtgctgataacgtgttagaattcatgttgtcaacaatcgaacaagcacacaataacacacggacatgaaagtggaaggcaatcaactttattgatgtttctctctctgttacaagtattactttgccctcaacctcactattgtatttatacccacaataggatgtcctatatggatacatacatatatatttggtataagcccacttccttaataaggaaacagaagaatagaaggaggaggtaccgtgatcctcacgatcacggtcctacaaatccgactcctttgggagatcggtttcataacagtcagggggttacaaaccagagttaaaaaccctttctccagcagctacctattgttgagaaggccgcactcaattaatttctttaatctcacatgattatttagattcaggacttttggtttgtacagattctgatccttgcacggattgagggttggtcttctttgatgaaccatgcagagaacacgggatgttgggatataggatatccgatcttcttttaatcttctagctagtacatgttgtatcttgtagttttagtctagtaatttataatttaatttttaccaattatctcaccattgcttaaatgactggatgtttgaattgataggctgtgttcttggttaatctctttttttacacttatcacatatataattaattaattatataagtcataccacatgttgagagacaatggtgacacaatcgacttgaaatcctggctccggccattatggcacgtggaggctaagaaataagcaactcaatttacgggttccgcatggtagttgggtggtcactgccatcactactataggttctaatatcgaataattgtttgttaaaattttaaccaaacaaaagaaaatatatatacactttaaaatatactccctccatattttaatgtatgatgccgttgactttttgaccaatgtttgactatttttttattcttttttttgtaaatatgaaaatatttatgtcatgcttaaagaacatttgatgatgaatcaaattacaataaaataaataataattacataatttttttaaataagacgaatggttaaacgtttgataaaaagttaacggcattctactttaaaatacaagctagctagtccaagtccagagatagatcgatgcatgacctaattaattaactctccggtgtgtgcgtgtgttggggctggggcctgcaggcgttgccttcatgcagaagaaataattgtagtggtggtccgtccgccggccattggatatgtcgtcatcgatcgtcttcggcgtcgtcgtcgtcctttctccagctctcgctgacaggattctgtgtggagagcggccggcggagttggtagcgaatttgcaaatgcacgcggtcgcgccgaattctgtgtggatgacggcagcccgcccggtcaccctagcatacgcacccggtcttgaaaacttgagaccagtatgaaacattgaaaacccctctgcacgcatatatatatatatatatatatatatatatatatatatatatatatatatatatatatatatatatatatgagttgcataatatgaaccaaggtgcatatgcacctatatgcatagtttgacacatgtatctacctgattggttcccttcatggtggctgtaagggatggtacatgttatgatttttgtggtccaaaatgtcccttaagtagtactataatagttcgaatgaattgtttttgtggttttcctttttttttcaaagtaatgtcctatgtttatttaatatgttgataaaaaatatgacattatatttctgaaaaacatataatgtagattcactacaacatattgtgagataattttgtaatttttttataactttagatatgtaattgatattttattcaagaataatgtatttctatttcccccctcaacggttgtattatctttttatgggtggattttgtgttctctttggtttgcatttgcaagaattttttttctcatggttttttagtcaatgcaagttataggtttagatataaattattttgtaaatgctatttagagatgtgtcatttgcaagtttcatttttagagaaatgtcattagtatgaacattaggagaccatttgcacattttatttagagatataaaatcattttctaaatgctatttagagaaatgtcaataacagatcatctgcaaattttatatttcatacaaacgaagatatatgatatatcagtatgaacatgttcaataaatcttaatatatattactctactacaaagttaagagaaataaaaaatactaatatttatatgtacgagtacaagatagaaatttgctttgaatcaatgaaccaatgaacgtctcgtattgtaacatactagtataaaagggcaatttgggacaaactcaaagtgggcagtggcattgtgtaccttccctcatctctcccctatatagtaatagcacaaatcttagcagccatcaatggtgtaaattgttggtgcatatgaacctaggttcacatttgcttttccatatatatatatatatatatatatatatatacttaaaaaaaaatttgtgcgttacaacgagtgaaggttattttaatcttattattattatacggtttagttaaggtgaaatttactgtgggaattctcttagatatttttttttacaaaatcaggagctgcaattaaaagtccgatcgtcttaagttagtatataagtttttctttaaaagaaatttcttatatgacttttatggtatttctaaaagcgaaataacttaaaaactgactcaaacacggatctgtatttctaaaaacgaacgaacttaaaaaccgacttaaatacgaatgaggtactaaaataccgataaaaacatcttcaatgtttataatagtaaagagagatagaaataaagatacttagcacaattatttgcttaatatttgattttcttttcctaaaaaaattatactttcggtcgttctatatctgttccaagatgttttgatttctgcaataatgtcgttctatatcggaagtatgtatttgttttgatttccttttatttttttttctcgttcacttagttttcattctcttcttccgtcttccgatgcgtggacgctgcatattggcaagacctccggtgaaaactcttcattcttaattgcatctgacggttcttgttattccgatgatgtggtttaatctgctaacgagaagaaacaaccaactcaacatgaaaaaaaaaattaaacccttactttatctatacctaataaaaaaatacgtaaggcttccggtggtttttttcgtccgtcatcccacgttgctaaaatccgttttactccgcttaatagtcggatcggaccttttctaatctactccaaaacctcggttgatatacaatatttaccgctcatgtagacaccaaccacaactagcagcttgcctacttggtcagtggagaaaatcttcaacccgccgaccacggttcgattcccaccagctctcccttttagacctattactttgcctctatctctccgttttagacctattattactttgcctctatctctccattttagacctattattactttgcctctatcaggctagattgctcagaaatctcaaatcctattgctactttgcctcagaataagtctactttgcctcccacatctcaaatcctattattactttgcctctcctaggctaaattgctccgcaattttttttatccgcctactttgcctcccacatctcaaatcctattattactttggctctggctagattgttgtgcaatttttttctctctgccactagcacgttagtaattctgaaatcttataatgaaccagtttttaatttgaaaattaagcataattatttttttccttttgtcatctgcaaaatacgacatattagagtccgcaccatctatcgtccacgcatgagccgtgaaaacgattcgtctccacgcaagtccatgttcgattttagaaattatatcaggctcttaccatgcatccgatggctgaaaaatcaaaagttttgcacctctttcttcaatagatatttagtgattctgaaatcttataatgaaccagtttttaatttgaaaaataaacataattattttttttcctttcgtcatctgcaaataacactatattacagtccgcaccatctatcgtccacgcatgagccatgaaaacgagtcatctccacgcaagcccatgttcgattttagaaattatatcatgctcttgccatgcaagagttgagagagagcgtgttacgataatatgagtatatcaatatgcaatagcgtttcttatcaatcctaattatcattaatccagtgaacaatttatctatcttagaacattattatatacatgtcaactgggtatttatatcatttaatctgtcaatatacccgtagcgaagcacgggcattttgctataataataacaaagggattttggctggaaaaacaggaacccggaggctatgggccaaagtactgctaggaacttatgggccactttctctggtggaacctgagcccgtgctagtgttgcaccaaaaatgtctctcttctacagatgtggacaataagcacttggatcatctatgcaaccatttggatcccaagatagaaaatacaaaaagaaatttaaataattcaccgagtcttctcgctgctttgcatttgttgtggccttgtggggggttcttcatgcacacctaagtactctgaaactaattatctgcactcatctcaataaacatgttccttaaccgttctatcattaatcaccaaaactcatttagggggctagatgcactttcactattctcaacttgctttgcttgtatatcaagtgtgattgagtctcttgtctagtttttatcttgcttaattgctcgagtcttttgctatatgttgactagattgtcctagagcagtcggacaatatgagcccctttacaactttccgtttttcactctgaccggacaatccaccacattgccaaactctccgactgctcctatagttagactgtccaacctaatgtcagactatccggttaagctttattccactgcaaatttttgaatttccaggaatgcctattcactcttcctctagctctaggcgatgtatcccatcctcaaggccatttcaaggacaacatcgatggcagagatatcgatggcggtgaggtcggaggtggctagatctggtggcctctaacctccgaatggctggatccgatgaggaggagcgggtgttgcccggatgtgatatgcatcctggtccaattaggatgaggcatgtgtggcccatgaaagttgtgtgtgcatgtttggtaccacatttgctagtttagtaagggtgaaaccaagttataagggcatatttagtaccataagagtttttgtgaggcttttgtgacccataagagttgtgtgtgcatatttagtaccatattgctaatttagcaagggtagaacaaacttatattttcttttgtaccagtagtgatgagtcagtccattattgttgggtttttaaataaaccagcactgatattctaggtttttttaggacacgcgtgagttgggggtgggctcgaaacccttatcggtgcttggtttagtctaatcgacacaaataggggtggttatgatggctattctgtagtacactagtacataaatgcccttatgtgcctgttggaaactggttgtaggtgccgctgaatgatcgattaatcctatatatacatgcgatggtgaaaattgcagtgtagccaaatgattaatcctatatgtacatgcaggatgaagaaacacgtggatgaatacaaaactcataatttcaacattgggcagaagaacaattgtgagttgatgaagttaaaatatcgatcatgtaataaataattttagtctaaaaaatcatgacacattgatcaaatccatcaattgggctagggttgaaaagtatggaaggaatgggcttttggcccaaaaccaaggaatagttataattaactttttcaattatagtgtatagcaattttaatgttttaatttgttgctaaactcctaatagttgtaccattgaagaaatgcttttacccgttgcaacactcgtgtattttttctaagttaactttaaatgagtactatcacaaactctgaagttgttaccaggttcaaaattccggaataatactttcaaaaagtcatgaatttaggcccgccctatatgaaactatttcgccgaaattttcaggaatgttttttttttgtgaatttagccaaagtagtttttcaaatttaacaaaacttgttcaaaattcaaattattctgaaatttccacaattagtgaaatttcggttcaagcagagtctccagatatagaaagctccaaacagaaaaatctgaacctagcttggtcgttatcagcttataaccgccagtaatggtagctagtagtagcagctactcaaagaagcattgccgacgtgatgaagaccgtacgtgcgcgatccggtgatctctcacctcttcggcggcggcggagcgcactgtattgccgccgccggcgaccactccgtcgtctacgacttcgagctcgtcgtgtaggaggttggcgtcgagctcctcgccaatgcgctcgcagaggttgtgcagcacgcagcagacggccagcatgttggctagctccggcagcttcacctcggcacgccgcaggcactgccaccgcgccctgagccgccggaacgcgcccaccgccgccgcgcgcgcgtcggccacgtgcgcattgagcctgtcctgcgcccacgtctggttgggctgcgtgtacggcaccagcatccagctcgtcagcgggtagctcgcgccgccgacgagccacagcggctgttgccacccgagcttgtcgtggccgagcagaagcccagcctcgcaccgggcgtacagcgccgacttcgcgaggacggcggcgtcggagagcgagccggggtggccgatgcagacgtcggtgaaggcgccctcgtcgtccacgacggcctgcatggcgacggagtaggtggccttgttgttccggtcggtaaggcggtggtcgtagtactcgccggcgtgctccctcggcacgacgatgcggacactggtggagaaaccatctttcgtcggtcggactaattccacaatagtctcggttgcaacaaacaccgggactaaagatccccggttaaaaagggtaacgggcatcaccaaccgggactaaagatctttagtcctggtttaaatgctgtcagggcctgtcaggccctcccgggatatttagtcccggttggtatcgtaacattagtcggactaaagatcccagcgatctttagccccggttcataacaccaaccgggactaaaatcccacccctatatatatatatatgtcttcgtcctcctccagcccgagtaagcttcaaaatttcttcaaaaaagaggggaggtcatgccaaaatttctattgaatttattttggtgattatatataaatcggaggtgcctaaaaggttagcaacttcatcctccaatgttttatttttttcatattacatttggatcatgttttgcacacttttttgtcttcaaaattttattgttagttgatgagagagaaaatttgtgtggagaagaaagaatatatagaaatttagtttatttgttaaagaaggttttataaaatagttgagaaggaaaatatagtgaaagttaatcttgaataatagaaaacaaagtaaaatgaaaaattaaaataagtacaacacattaatattagtttaaaactttataaatagtaaatatataattattcggtgtaatatttcataattttgtatgaataatgatatgtcattattgtgttactgttgaaagagtttgtaattattttataattattgtatgactgtcattattgtacgaataattatgtgtgtacgattttttttcatgtcatgtagatggatcggcaatggatgtacgctgactggcggtccaaagagtttattgacggcgtgcattattttttgagagtggccgaagctaacaggcaaaagggttttatttgttgtccatgcaataagtgtaagaatcagaaggagtattctgcatccaggactattcatttccacttgtttgagtcggggttcatcccaagctataactgttggacatcccatggagagcaaggggttgaaatggaagaagatgaagtggaagacgacaatatttcggactttgctcagtactctggatttgaaggaaatcaaacgggcgaggaggaaatggatgctgatggttacgacgttgcggatgatcttggtcagatgttgcaggacgccaaggaggactgcgaaagtgaaaagggggcccataaattggacaggatgttagaggaccacagaacgtcgttgtacccaggttgcgagcaggggcacaaaaagttggataccactctggagttcttgcaatggaaggcaaaaaatggtgttagtgataaggcatttggcgatttattgaaactcgtcaagaacattcttccggagggaaaccaattgtccgagacaacgtacgaggctaagaagatagtctgccatctaggactggaagttcagaagattcacgcatgttcgaatgattgtatcctatatcgcggtgaggagtacgagaacctagaagcatgccctgtttgtaaagcactacgatacaagattagatgagatgatccaggataagttgatgagcagctaacgaagaaaagaattcctgctaaggtgatgtggtatttccctataataccacggctaaggcgtttgtttaggaacaaggggaatgctagaatgatgcgatggcacgctaaagagcgtcaacaggacgggatgttgagacaccccgccgatggttcgcagtggcgaaacatcgacagaaaatttaaagactttggaaaggacgcacgaaacatacggtttggtttaagtacggatggcatgaatccttttggagagatgagcagcggccatagcacttgacccattacgatatgtatctacaacctcccccgtggctatgcatgaagaggaagtacataatgatgccgattataattcaaggccccaagcaacctggtaatgacatcgatgtgtacctaagaccactggtcgaagatcttaaactgttgtggaagaaggaaggtgtccccgtgtgggatgaggacaaacaggaggagtttaacctacgagcgctgttgttcgtaaccatcaacgattggcctgcacttagcaacctatccgggcagtccaacaaggggtacaaggcttgcactcactgtatggatgaaacagaaagtacgtatcttaagcactgtagaaaggttgtgtacatgggtcatcgtcgattccttgcaacaaaccacctggttcggaagaaaggcaagcactttgaacataaggcggaccaccgtacgaagcctaaacatcgcggcgggaaaacaatgtttgctatggttaaagatcttaaagtagtgtttggaaaggggcctggtagccagcccatagagagcgaagatggtcacgcggcgatgtggaaaaaaaactctatattttgggagttaccctattgggaattcttggacgtccgccacgcaatcgacgtgatgcacctcactaagaatctttgcgtaaaccttcttctcttcctaggtatatatggaaagtcgaaagatacactggaagcacgtaatgatctgaagcatatggaacaacgcggtgaccttcacccggaaccaaaggagaaatgaagccattacttgagtccagccagctacactcttagcaaggcagagaaggaaagtatgtttgaatgcttggagagtatcaaggtaccgtctggatactccacgaatataaagcgaataataagcacgaaggagaagaagttcacaaatctaaagtctcatgactgtcacgtgctgatgacacagctgctaccagttgtaataaggggtatcctcccagacaatgtctgggcaacaataacaaagctatgtgctttcatgaacgcaatttcgcagaaggtcatcgatcctgatagattagaagccctgcagaatgatgcggtgcaatgtcttgtcagttttgagttgatatttccaccttcatttttcaatataatgatgcatctgctttgtcaccttgtcaaagagatcggtattctcggtcctgtgtacctacacaacatgtttcctttcaagaggtatatgggcgttctgaaaaagtatgttcgtaaccgtgctcgtccagaggcaagcatcgccaaggggtatggaacagaggaggttattgaattctacgtagaatttatcgaagaccttcgcccaatcagggtacctgaatcacgccatgaagggagactacggggaaaggggactcaagggagactacggggaaaggggactctcggaaggaaagcaataatgacggtagacaacaatttattccgtaaagcccatttcacggttctggaacaatctttattggtggctccctacatcgaggaacacttggctttaattcgcgccagaaacattagtaagtccgatgcatggattacaaggcatcacattgatactttctccacgtgggtgcgacaacattccatgggtaacaagacgattaaccaacaactggcctttctggcgagggaaccatctggcttgatcacgacattccagggatatgaaatcaatgggtacacattctacacgagagcccaagacatgaagagcacgaaccagaacagtgttgttcgtatcgatgccatgggacacgatggtacaactggcacgtattacggtgccatcgaggacatatgggaacttgactatggacctctcaaggtccctctgttccggtgcctatgggctaggttgactggtggaggcgtaccgattgatgacagtgggatgacaacggttgaccttaacaaggttggatactcggacgaaccttttgtccttgccaatgatgtaacgcaagttttttacgtcaaggacatgtttagcaaaggaaaaaaagggcaaagggcctgacgagccgaagcgccacgtggttctcccaggaaaaagaaaaatcgtcggagtagagaacaagactgacgaagattacgatcagtttgatgggcaaccccctttcacagtgacgattgaccctagtatcctcctaacaaatgaagacaccccttactcacgtagcgatcacaaggaaggaacaatagtcaggagaaagtacgtgcggtcaaccgtcaccgctgatgtattaccgtaattgttgtgtacacgatgtaaactatttttgatgtattgaatatccataaaatcaattgttgtatggcatatgttaattatgtatgattattagaatttttatcaaattgaaatcaaccatatgctagttatatatgattattagaatttttaaaagttttaaatcatgcacgtggtatttacatatgttaattagaattttcaacaatttattatcatgatgtgctaattatatatgattattagaatttttattaattttaaatcatgcacgtggtatttacatatgttaattagaattttcaacaatttcatatcatcatatgctaattatatatgattattagaatttttattaattttaaatcatgcatgtggtatttacatatattaattagaatttttaacaatttaatatcatgcatatgctaattatatatgattattaaaaattttaacaattttaaatcattcatgcgctaattatatattatccacttagtttactacagacaacaataatttttcgaaggttttgtcattaatttttcgactttaaataattgtaatgcattatttactattttagaaacacaaatgtaatgaaattcaaaattcagtgctattatctttagtcccggttcttaaccctaaccgggtttaaaaagaatttggaaatagcgggaaaagatctttagtcccgattggtga

SEQ ID NO: 75610 - DNA, 669 bp, Oryza sativa
gctgctacattaattccttgccagcttaattgggcggaataataaactaacaccttgatttccccaacagttttttctatccaagcgattctttccgctgaaattaaacaatctaaacctaccgacgctaaattaagtaggtgtatagtccgatcaactgagcgcacgaaacgtggggagagaaatcgttcgttcttagacctaccaacagtggcctgcctggagacttgctcgccgagcttgacgacctcagaccactccgtccgctccaagccgccgggagccgcctccgccatcatctgagaacccaaagtaaataagcacgccgccgcgccgtgagttaccgtgggattggaggcttagagccgtgctatgaccccatcgggatagagagactcgggtgccaaacctggaaggtgtcgttgatggtctggaggtgcgactgcaggaagcgggacagctcgccgccgcccgccggcttcttcgccgctccacctctcctcggcatggcaggcagctaccgcctcgtcgcgtcgcgccggcgaagaagagagggagaggaagagggatgcgagccgcggcgaggcggcggcggcggcggcgggggcggaagggtttatttcgttagggcttttgggggaagttgggcttggccggttggccctcctg

SEQ ID NO: 75611 - DNA, 1825 bp, Oryza sativa
gaggaggagcctaagaggggtgtgtgtgatttgtgaaagagatgggaaagttaaagaaaatattttttttttgtgtctcgcaaacttttacattagggtccttgcaagattggaaatagagcataagaaaagtatattggagggaagttattatacgtttattgtgatatggaattactctcccttaattttgtttaattctcttcaaatcaaacaaactgacctatcttttttcgtttatgtttatacttatcagccaaaatttaaatttttaaccttaaatttaaacctggttttgaggttttcttatcaaagtttagttttcagtctttacttttatgcccctgagaacacgtatataaaagttttattaataaattacttctagtttacaaatatttccacgaataagccaaacaatgaagccaaaagacatgctaggttcactgaccggtttaattttcttggtttaatactttaatcgccatcgggtctggaccgcaaggaatggttcctttggtgtctcttgtggaacacaatttttaaacatgtggtagtagtacggacatgatcattatagaagagctgtgcacgccttacgatgtccatgttgattagaaaaccagctgcaaatctggatctttttcaaagcttcatcagatccttggtttacaaggagagattagccaataatcacatgctaatgctcaatgagaacaacaaaagaaaccagtactagtacgagcactacaattttcgagaaagtgtagggtggtatgtgcaaatatggtcctttaatcggagccccggcccatcagcacgggcagggggggacgggcccggtcggcggaagcccccccctttaattcgaaagacacggtcacgggcggagcgaggccgaccgtccgatggggagtggcagaggccgcacggcgcggggagggtcgtacacgtgtccggccgagccgggcggtgcggccgccggcacaatcgatggcgagcaaacgtcacgggtggcggtgggcacggaccaccctgacgggcccccgtgccgtccgtctcgctgctctttccatcgctcggtcgccgacaggtggggaccgtgagacggcgtgagagcctagatgtttcctgagtgggtatgtgcctgttcaattcagataattgtcaagatcaatctttcaaattttaacttttagttacttggtataattttcaaactttgatagtatagaataaaaatatgttgtgccaaaatttcttatgcactatcactatttggtacttcctccgtttcacaatgtaagtcattctagcatttcccatattcataatgatgttaatgaatctagatagatatatatgtttagattcattagcatcaatatgaatgtgaaaaatattagaatgacttacattgtgaaacggaaggagtacataaactaaatgcaactatattttttttaattttactaaatattggtatgatttaaaatgacactaatttaaacggccctatgacttctgattcacggtaacatcttcggatacatgtgtgtgtgagagagaggatcagcgatattttcttgtagtcatatcgcccgcaatcaatggcgctgatcggtattgctggctgcagccagcctaatgcaagttcattttctaccgctgcaacaggatgcccagcttgctggctgcaacaaccagcagaaacgatcagcgccaatatggtggtggtctggctgcatgatctgcaatgaaataatagcagtagttccttgcttgatccatggggaattggggatggacgtgcaatgagtagagt

SEQ ID NO: 75612 - DNA, 1187 bp, Oryza sativa
  unsure (1)..(1187): unsure at all n locations
atttttcacctccactgaacacatgctaaataagggtggcaatcaaatttgctgagggttggcggcctaacaggacggctgtatggcccgtcactggctggaaagaagcagctgattctagcttctcccatgttaacctcctctttgattccagtgaagctgcccgttttncgtcctccttgtacttgaccaggcacgccgaaaagagcacgtcatccatctcagaaaacatcttctttacattatctgtgagattcaggacagcttggttccaatgattctggctattatgttccaatgctggaacaatgataggcatgatcatttggcggttttgtgcaatcaagctaataacgttatcgttgttccatatgaaaagcgcccgttcagcaacctgaaaaaacccatctcgttgaggcaattacttggataaaaagcattagtctgtcatggcagacaaatgtcttcaattcttaatgctggtccaaatatctcacatttgtgatattaacagtacagagcaaccccatgcccaaagcatgattagttgataacataatggcccactattgttgtccacatttatttcggaccatcagacatctattatctcatccatttggcaagtcaacaggtaatgctttcataccttacataaatgatgcaaccaaaaaaaccctatataccatgtgagctttacgatcatgatccatttcaactgagtgatgtttacataaaattttaccacctatataataaaatgtctaggtgaagcggtagagttagcgactagtatagtaattcatcagcgtggcaattgatcaatcaaacagggccacaactactttcatatgtagtactccgatatattatttttaccacctatatattatttttcttaggtgagggaaatgcatagtggcaaaaacagaaaataaacatcgataggttatatttatttgggcaagttacctggaagtgagagctcttgatgcattgagcaatccgcctaaacaaaggtaccatacatttctggaattccgccgtgctgattgtctccaagatctcttcaatctcactcagaaacatcacctccttctgactatttgttattggccaatatcttagcaaaccaataattactgagctagcaagcttgggatccttttctatgaactgtgtcacac

SEQ ID NO: 75613 - DNA, 689 bp, Oryza sativa
aaattccaggagaaaaatcattgcatgcttccgtgtacaacagtgcatagcaggtagtacaacttgatcgctgatcacatgcagttagtgcatcacgtgtgcactacaatcattttttccactggggcagacgttggacgacaacctgcgaaaataaataataataataaaaccgtttaaatctcactgaaatcatggtgaataaatgcattttcgtgggccaaattttgggtgataagcatgagcgaaaagacccttcgttcttgtggtatacttgtagtcttgtactgatttattcacaaaaaaaaaagagacattttcataaggactcttttggagtagcataataatgagaatagttcaacgtgttaaggaacatgccttgccggaattttctttgtttccaacaatagtctgacaagcaagcctccatgactccggtttctggcatatagacaagaaatacaaatagcagtcaattggcagctgttttggtgtaatcagaaaagcatatagcaacagaaagttcagaaaacagggaagcccagaaacagcattgcccaactgaaaaaaacctgaaatggaatgcttggtaccttcttcagataccggttctcagggtttgttctttcattcaggagctccttgccatcaactatctgtgtcacattgacaattccaagctgtgg

SEQ ID NO: 75614 - DNA, 748 bp, Oryza sativa
tgtttatttgctaaataaggttttataaaatagttgagtaggaaaatatagtgaaagttaatcttaaataaaagaaaacaaactaaattgaaaattaaaagaatttaaaacttaaaaaataataaataagaattatttggtggaatattttataatttttgtatgaataatgatatgtcattattgtatgactgttgaaagagtttgtgattattttatcattattgtatgactgtcattattgtacgaatgattatttgtgtacgatttttttttcatttcatgtagatggatcggcaatggatgtacgctgactggcgatccaaagagtttactgacggcgtgcattattttttgagagtggccgaagctaacaagcagaagggttttatttgttgtccatgcaataagtgtaagaatcagaaggagtattctgcatccaggactattcatttccacttgtttgagtcggggttcatgccaagctataattgttggacatcccacggagagcaagaggttgaaatggaagaagatgaagtggaagacgacaatattccagactttgctcagtacgctagatttgaaggaaatcaaacgggcgaggaggacatagatgctgattataacgacgttgcggatgatcttggtcagatgttgcaggatgccaaggaggactgcgaaagtgaaaaaggggcccataaattggacaagatgttagaggatcacagaacgtcgttgtacccag

SEQ ID NO: 75615 - DNA, 1180 bp, Oryza sativa
aacgaacgcgaacgaacgcgaacgaaacgttaaagaaacgtgaacgaaacatgaatgaacgtgagcgaacgcgaacgaacgtgactgaaacgtgaacgaacgtgagtgttagtgaatgaacgcgaacgtaggtgaacgaacgcgatcgaacgctcaacgaacgcgaacgaatgtgaacgaacgcgaacgaaacgttaaagaaacgtgaacgaacgcgaacgaaacgtgaacgaacgtgaacgaacgcgaacgaacgtgactgaaacgtgaacgaacgtgagtgttagtgaacgaacatgaatgaacgtgaaagaaacgcaaacgaacgtgattgaaacgttaacgaacgtgaatgcacttgacaagtgtgagaacgaacgcgagcgaaatgtgtacgaacgagataattaaactattgttgaacttagcatatatatatgattatatatacttgaaaacgtgaaatacattatatgttcctttgtatttagactaatacattttttttgcatgttgcagagaagacgtcgtcgtcgtcgtccctcaagccgaagtggtagctagccctcgaacgaattcgcacaggcaagtgatgtagagatgtgattattagagatataatataagattgttagatttctaatataagattattagattattagagttagcatatgtgagtgttagagattattagattattagacctagcatatttgagtgttagagatagttagacatttaatataagattattagaggtttaatatacgaaacttaattagacttagcatatgtgagtgttagagatttaatataagattattagagatgtagtattcgaaacatatttgattgttaaagatttaatataagattattagagatgtaatattcgaaacttaattagacttagcatatatgattatctaccgtacaaatacacgacacttagacttagcatatttgagtgttagagatagttagagatttaatataagattattagaggtttaatatacgaaacttaattagacttagcatatgtgagtgttagagatttaatataagattattagagatgtaatattcgaaacatatttgattgttagagatttaatataagattattagagatgtaatattcgaaacttaattagacttagcatctatgattatc

SEQ ID NO: 75616 - DNA, 3749 bp, Oryza sativa
  unsure (1)..(3749): unsure at all n locations
gctaacgaagaagagaattcctgctaaggtgatgtggtatttccctataataccacggctaaggcgtttgttcaggaaaaaggggaatgctagaatgatgcgttggcacgctgaagaacgtcaacaggaccagatgctgagacaccccgcagatggttcgcagtggcgaaacatcgacagaaaatttaaagactttggaaaggacgcacgaaacatacggtttggtttaagtacggatggcatgaatccttttggagagatgagcaacggccatagcacttggcccgttacgatgtgtatctacaaccttcccccttggctatgcatgaagaggaagtacataatgataccgattattattcaaggccccaagcaacctggtaacgacatcgatgtgtttctaagacaactggtcaaagatcttaaactgttgtggaagaaggaaggtgtccccgtgtgggacgaggacaaacaggaggagtttaacctatgagcgctgctgttcgtaaccatcaacgattggcctacacttagcaacctatccgggcagtccaacaaggggtacaaggcttgcactcgctgtatggatgaaacagaaagtatgtatcttaagcactgtaggaaggttgtgtacataggtcatcgtcgattccttacagcaaaccactcggtacggaagaaaggcaagcactttgaacatacagcggaccaccgtacaaagcctaaacatcgcagcgggaaaacagtgtttgctatggttaaagatcttaaagtagtgtttggaaagggacctagcagccagcctatagagagcgaagatggtcacgcggcgatgtggaaaaaaaactccatattttgggagttaccctattgggaattcttggacgtacgccacgcaatcgacgtgatgcacctcactaagaacctttgcgtaaaccttcttggcttcctaagtgtatacggaaagtcgaaagatacactggaagcacgtaatgatctgaagcatatggaacaacacggcgaccttcacccggaaccaagggggnnagagccattacttgagtccagccaactacactcttagcaaggcagagaaggaaagtatgtttgaatgcttggagagcataaaggtaccgtctggatactccacgaatatcaagcgaataataagcacaaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcaccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccaatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgctacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttcttccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgattacaaggagggaacaatagtgaggagaaagtacgtgccgtaattatgctaattataattgactagaggatttttaaaagtttttaacatttaatttactagcattcctatgctaattataattgactagaggatttttaaaagttttaaatcacgcaagtggcaatttcatatgttaattagagtttttaacatttaatttactatcattcatatgctaattataattgactggagaattttaaaaagtattaaatttaatatattcttaaaactatcattcatatattagagtttttcacaatttaatttactatctttcatatgctacttatatatgactactcgaatttttaaaaggtttaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattataagtcatatatttgcttattacgatttatccacttaatttcttacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggactaaagatatctttagtcccggttgttgagaacaaccgggagtaaagattcgggggtatatatattcccggtgcgccctcgtcttcttcaccaacacttagacgttttcggccgatcgatctctctcggcctctctcctttgccgccactgcctagggcaaatccccgcaccgacgccgccgtatctcgccgtcgtctcgagctcgtcgtcctcgccgccgcctccgcctcctccgctgccgccgcatctctggggtgagagccgcagccgccagatctcccttcctgcatctcgatctctccgatctcgatctctctccgtcgcgccgcccgccacgagacgccgtgccacgacgacgacgcgccacgactacgacgcgccatgccgccgccttggccgccgcgcaacgccgccgccgcctgccaacgccacgcc

SEQ ID NO: 75617 - DNA, 2823 bp, Oryza sativa
gcatttatgcgttatacatctttttgtatcttggagaaaaaacggtgttgtcggagtagtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagtacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgtagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgctgagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaaaaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtgctatgctcacggtggaacgctcaacccagctgatggctcactggtcttgcgatcagatacgagaggctgcgcgacgactaacagatgcagtggaagcctcctctcaaggcacgttccgaccagacagagatagggacgagctgacactcgccctgcagactccagagcatccaggacgaacacgagggaaaggggtgattccttggaagattggtttcaaggaggacatccacacatacaggagtcggatgaggagcaagagagataccgaggcgaagattgcagacctagagttccgggtatcgagctacgagtcaacatgcaagaggaggtggcaaggaaggttgatgaacgcatggccgcacatcggtcccatgatccccagctgaccattcctcctgcaatggtgagcccgtcaggaaacagtagcagctgcgcctcaacggggcaggtaggatcacagagcatggacgccatgcaaacacaggacaaatcgcctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagtaggatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctctggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccaactccaccgcctgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccattaagctatcggactatgagcgaacgctgaagaaagcatcttctggaaagtcca

SEQ ID NO: 75618 - DNA, 26792 bp, Oryza sativa
  unsure (1)..(26792): unsure at all n locations
caccaccttcgcttccggaaccttccgcggcgccgggggagaggaccccctcgtctccaagctccggacccagctgggcgtcatccacccgctcccggcgccgcccgtcaaccgctccgtcctcggccttttcgccctcttcttcttcgtcggcgccgccttcgacaagctctggaccctgcgcaagcgccgccgcgccgagcgcgaggtcaaggtcaacggcacgtggccgcaggtgcccacctccagcttctccctcttcctcgaggagaaggacctgcagcgcaaggagtccgtcgagtgggtcaacatggtgctcggcaagctctggaaggtctaccgccctggcatcgagaactggatcgtcggcttgctccagcccgtcatcgacaacctccacaagcccgattacgtcaaccgcgtcgagatcaggcagttctacctcggcgaggagcccctctccgttaggaacgtcgagcgccgcacctcacgccgggccaacgacctccagtacgtcctcacttcttctactactctcttctttcttttccatacccaattcggttgggagctaccgttgcagcaagaaacatggaaatattcttcacattgcttgtcccaaacgttgttctagctagtactactactagtgcttgagaagcacataacacattggtaatcggtatggtaaccccactaccattgcactgctcatgtgaggaaattggaaagcaaagcatgatgacattggtcttaggaatatttgtcgccatttgcctgtaattcacataccaaaatggagtattactcttttttgggtatctatcataggattagcaccaccatgaaacaaaatactaggatgactattccagcagttcacttcttattactacagtctatgggtgggcatgtatctgttaccgtataaatatgttcattctagtttctgatttctactttcttggtcattgttgatgccctgattttttttaaaaagcaaacggcaacactgctgtctacattgttattgtatctatatcatgttttagtgttggccagcaaaaggcagcgagtaactcatcctgtatttcaggtaccaaattggcctccgttatactggtggtgcacgcatggcattggccctctccttaaagtttagtgccgtacctgtcgttgtgccagtctgggttcgagatttcgatatcgatggggaattgtgggttaaactaaggcttataccgacagaaccttgggtgggagctgtatcttgggcatttgtatcgctcccaaagattaaatttgagctgtctctgttccggcttttcaatcttatgggtatgacttgcttgtccaatcttattatttcctatgcaacctgtacttaaatttcatgcctttgtaaggttgattttctcgtgattccaaaagaaagcatggttggcaccttttaactcatatgattttctggaaacaaacatgcagcaccaactgacaatatgccctgtgaatcatgtaacacagcattgcaaatagcccatttctgcacatatctagagtataccgcgttccaattggtacggttaatgttttaacagtatttgtaacacacttgtactatagtatatacttgccaattaccgcagtccattattactctagtaccccctttatatattgcatttctgatatttcgtgtcccaaagatccaggggttttctgactgatatcttggaattgtaagtttgtaaccatgaatgtcttcttacaaatgaattggaagaaatgggagaaaaaaaattacgatcgtaggactttagtttttcaagcctacaatttcttagtttatgtatgcacaatggtgtcaatctgtttaatgttctgaaactggatatgttgtgtatttgtgctttgtttcctattcgtttgttcatgttgggtagttgtcagccttttatttcatttattttctgtttccgttatataaatttgtatgttataagtttgagcctttgctaatggtatattggtattttcaattttttgcatggatatggtgcttgtcttcaccagcaattcctgttctgtcaatgtaagtactatcatctcaaacatctacgcagaatcatggttagatgctactacatagatattgctcaatgagcagggactactaatgcattttaaagttgctttcttagtttctttttgtaatggcctaacctaccttcccactgtcacctttaccctctctgccgccttcttctcttgctttcttgttcactctagttctaggtggttaaatattcttatccccatgtgcttagctggtgataaaacatatgctattacttgtttaagctatcaatattagtttttgcttcttacttagcctagactctttattaaatacatgttggtagatccatgaagattctgttgaattagtagcaaccatatttaacaatctatataaaatgcaggtgcctgcattgttattgtttgtatcatgttttcggaaaaattctgcaactgtatcctaattcaacaccttaaggcttagcttttcatttaatgctgctctttaatagacaaaccttgttcaccctttggccggtggttctaataagtcacctgtgactctacctcctctaggtttctcacgaaacttctaacagaagatttgccacgtctctttgtgcggcccaagaagattgtccttgattttcagcagggaagatctatgggacctgttgcaggagatgttgcaagtgacgtaatccaaaatgttgcaagtggcatacttcaagatgttgcaagtgatgtaattcaagatgggaataaggacttcgttggagaactatcagtgacattagttgatgccaggaagcttagctttgtcttattcggtaaaaaagaactctttggtttccaaatggaaatatttagcgtatgtttattagtttggaaattgcacccagcatcttgttagaagaatatcataaatatttagcttctattgagtttatctgctcagaaaaaacaaatcaaatcattaaataattttaccacttgggcaagctggagatgaaataaaaaattagttcgcctatccttacagacatctgtgtcactttgatagaatatttaggtataattttttttgtcacttgcagggaagactgatccatatgttgtcatgattcttggtgatcaagaaataaagagcaagaagaatagtcaaacaactgtaattgggcaaccaggcgaaccaatctggaatcaagtaaagctctgagacagttatactttaagctcatgggcattttgatggaacctttttcttgtatactatcatgctcataagcacttgacatcaaacaggactttcatatgctagttgcaaaccctcgcaaacagaagttgtgcattcaagtaaaggattcagttggtctaaccgatgtcactattggcactggagaggtagggtttcatcttttgcaaagtttgtttcaattgaaagttttccttagtatcctctctaagctgatgtatgtgatattacttggaaatttgtagtttagtgtactgttttacagcagtttgctaggtcaagcaaacatactatatcagtgatgagtgaagtgtattttgtttgtatttttgggtgtcctttgttgaagtggaacgtgtttctgagtatattctatttgccaggttgagttaggatcacttaaagacacagtacctacagacaaaattgtaactttatatggaggatggggcttacttgggaaacggtcaaaaggggaagtactccttcgcctcacatacaaagcatatgtcgaggacgaggaagatgaaggggtaaaaaatgagtttgctgcgggctatgtttcagacgaggatgtgctagattatgtccaagacagtacaagtaagcaaagtgacatggatggtaaagagagagagaccttcatggatctgctggccgcgctgcttgtcagcgaggaatttcaaggcattgtgtcgtcgtctgaacccggaagcttgagagatagtgagcaggctgctaaatccagagatggtgaaaatgctgcagcagctgctgatacagggactgtatccaatagctccacaggtaaccaactgttgaattcactatgctggttacctgcatagtattgttggttggcttgtgtttagatttccattactacatcaccttgattgattttctgattttgtttgtgattcagatactgctctagtgtggcttgctgccataacaagtgtgatggtgctggtctcatccaaccttggtggttcaggctatttcaacccttgaagagttgatgcatgaagaatctgatctgactggagtatttggacgatccatctgtctgaatctgatcatccgcagctagtagcagaggtcgttttgttttgattttttttaactttatttttgccgacaagtgtatattccattcccatgtatctaatgttgcagaggaatcaaagaatggcttggcttttggcggctgtctctcctccctttttctatttcatacgattgacatgatgtagcatatcctttttgtgcaaccatccacgcacatgatttaatttgtgtgaatgggaaatttggagttgcgttcatctctcctcttggaattggatcaaagattgcaccattcattcatcaatagatagcagattagcagaagacatgatttcgtttgttttttttcctaaacaaaattaagggagcaagtgcaggcatgctgaatttcgtttctttttgtaaaactgatcggttaccgacaaaattcaaagaaattccatcaaaacctatcgaattccatcgaatcatcgctcgactttggttatcagtctttttttgagaactggttatcacttatcagtctgtgcccgtcgagaagaaggtcccagatgaaacgggtttgggcacactgactgactggcgggccccacgtgtcagcaacgccaaaggtcaggagagaaatggcgggaatgaatggagccatttcccgcgcgttccacaacctcccaccttttggttttcccaatctcccgcgcgcttgctcttcctgggctttttagtctactcgatctaactccaaatcccattaaccccgccgccgccgccgccgccgccaccaccgcgagacgcgagaggagagtgaaagaaagattcagagagagagagagagtaagcatgatgtccttcagccagcccgacgccttctcgccgtcgcagttcacctcctcccagaatgccgccgccgactctaccaccccttccaaggtagtaatctccattccattctcatccgtgtgtgtcttggtttcgagaaacaagggggataaaatcatctttcttttcttttgattttgtagagccggggcgcatcgagcaccatgccgctcaccgtgaagcagatctctgaagcgcagcaatctggcatcaccggggagaagggcgctcccttcgtcgtcgacggcgtcgagacagccaacgtatgctgcaacacaacacggaaaatgccccccccctccctgctttaatttcctcttagcttgttgatttgggtgtttccttgttgctttttcaggttaggcttgtgggattggtcagtggcaagacggagcggaacaccgatgtgtccttcacgatcgacgatggcaccggccgcctcgatttcatcagatggtgagcccatttcgccgattcaatcgcttctgtatcttcctagtcaatactatttctgcttcaactgccatcactggttgtttactactacttgtagttcagcttgctcgttctagacttccaaacaattcaaggccgggaattcggaaaatgttttttcaatcctgaatgctaattactactagtataaacattctactacaaacggtgtcttttggtttctagaagcattggttgagcatcagcacatatctggtctgtcttttcgtattcaaggcaatgatataagtagtactcctacatctttagttctgaaattaggttaattactacaacatcctgttgttcttttgccaatggcttcagcagatttacatggttatttatctccatccattttacagggtcaatgatggtgctgattctgctgaaaccgctgctgttcagtacgtaccagtcatagctcccatttatgcttctatatatgcacttcatcatcttttatttttgaggattgttagcatctttctccttgaggatcatcaccttttctcataactctattttttttcctaattaaaggaatggaatgtatgtttctgtcattggtagcctcaaggggcttcaggagaggaagcgtgctactgctttcgctatcaggtacgtaacattcatatattctgctggtgcaaatatgcaataagacatgcaactaattttctcttattttgttcatttcaggcctgtaactgattataatgaggtcacactgcatttcattcagtgcgtgcgaatgcatttagagaacaccaaatcacaggtatgctgctgtgatgtacaattgttctatacaaatactctcgtgatagcaatctcgtgttcattagttagaaggttcatgagtttgaacaaaaaaagaactaatgcttaccttcaacactgtagattggtagccctgcaaaaacatattctgccatgggatcctcatcttccaatggcttcagtgaaatgaccactccgacctctgtgaaatccaacccggtaagttgtatttacagttattgcattgatcaaacaatcaaactcctgtgctgccgtgatttattccctcatccttacaggcaccagtgctcagtgtaacaaatggatcaaaaactgatttgaacacagaagtgctgaatgttttccgcgaaccagcaaacgtgtaagttgcacatccgtcttccttgtcatctaggaaaaagaaatgcttgtcctgttaaagacttaaagtcaattactcaggaatgaattccgaatgcatgtctctgtttcttttgcctttttttatctgcttagaaataccagctcccgtgaaaacctgatgctccatcaatatctacttttcctagattttccaattaaacacaagtagaattggctaggattgctagctaggagaaatggagagtatttgtctgttaatattgtcgtgttggctgaagaagcggcctaccgattgtattaagatttgaggatctggtgactgctgttttgctcatcttgtttgaccaacgaataaactgacagcgagagcgagcatggtgtgcacattgatgaaatcgtgaagcgcttcaggctaccggaggccaagatcaagtctgtatttcactccttcgctcacacacacacacgcaacagcgagacattaattcgacgaaaaattatggctgctggttgatgcttacctcgctctctgttaatttatgcagggtagctattgattacctcgctgacattgggcacatatactcaacaatcgacgagtctcactacaagtcagcgttcaatgaataaaggggattgaagcctcagttacttactagtatgtatcctctagcctcgaagctggctgcagctgaaactgaagaacaatcgagatgcttcatgtttgcttgtcatactaaccagtgtgcgtttgttttgctccatccagtgaaattacatgtaaccgtatctgtattacgagtagcacatatcgagtgacaaaacatataatatatgtatgtttgttgttttgcagcatcagcattatttggactgtaacatgcttgattgatctctttggatgcagttaatttcattgtgatattaactcacgcatcatcgatcgatcgtgtgttttttggtagctagatggtccaatcacaataatctgggaattaatgatttgatgatgagattcatatatgggattgaatggatggatggatcacattcacatggagctaactaacacatgcattgccatggttggatggtgagctggccgcacggggcaacaatacaaatgtgctgtgtactatgcttaggtagcactgatctatcatccgttggtgatctggaaataattaaagcagcgaattattaaggaaacaatatggacgagtccactagtgtaaagcggaaaaagacaaggttaatttagctggccaggcgacccacctacaaaatatcagggggatacttacacatgccatttgtttttagtgcccgaagtttaggctactaattgatcccaatagtatatctaggttctaaactaattaggcacatggtattaatagttgtgttatatatgctaacggatttttatgcacaatttaacataatgttagaaaaaaaagtttttggtataactcttagctactagtatgattttggaatatatcaatacaattgtatttgtattttgtgctacactaaatcttaaaagtagaaatgttggattaattgatgttgcaaattaattgatggtgcaaatcttagctcctgtttttcaagatccaattgcaatttttatgtagtgataaacaatgcgtctcacacagcaactgtcccctttcatccactctcccacttccctcctaataatataaaaaattctcttgcatttacccgaacaacccaaacactactccttccgttccaaaataagccaatgttgtactaggagggaacaaagggagtagttatttctctagtctcttcacccatcccaaatctcactccttctagcaaccccccccccccccctcttctcctctcgtaaaagaactctcaaccctccaagcatatagggcataataaatttattttggtaatatgtttagccagaaattggttctatctctctcagaaaaaaaataaattgctcttccacctctctatgtagaaaatttatcctggtaatttacttttgaaagttggtcatgtaggctctcctttccctccttatgaaaaaaattatcgttacccctctcaacattaaattattttgatcagattaatctttttcttaataataagtgaatttcattcaaataatgaaaatattaattcttttacagcagaaggagagagagagagagagagagggggagtggatgaggactgagggcacagaaaggagagggagtaggagacggaggggagcctagcgatcgatagaccaatgtttggttaaagaggagagttttttttttcacaccaggagaggaggggagggggaggagagcggagagagagagagagagagaggggggaggttattttgtgaggtagtcttagcgcactatttaacttaaatagcctacattttaagaattgagtttgatatataattcttcgcttctattttcattaaaaaattgtagtttttaatatagaccatgtgccttttttttaatataaacatgacatctcatattcaaactctgttaataatgtgtaggtgtagatatgcacatatacgtgtggttcacttctattaagtaggtaagaatatgatagtggcgacgattgggacattgatccatatcatatattatatggctctgttcggctgcacttaatttcactgttgtgcagccaacataaatagtattgtgttgtgtctgcagctgaagtagctgtatcggccagccgaacaggcccatagtagtaagtaggtaagatgtatgatcattcctacatgcatagccattcagatagacactaactaagctactagctagcaagcttagctaatgcaaacactgtagatgcttaatcactcaacagagatatgtaattagaataaaaccgattgatgtctatcaatacataataaattaatttttgagggctccacggtaatcgatcgatcgatatatcggtggatgcataaatatgatagtacacgcatgtctcgaatcctgcctgcctcagcctggttggttggtgatatacacacgtgaaaagtgtcaataagttaaagctatataggtacatgcagctcttgatagtactcttgatcgatccatccatcatcgatagatatcactaagccggctacccctcgatcaatccgaccggttggtacggttggtccatcgtttaatttgctttaatttgctccaccacttaacatgggtgttttttttataccntcgcgggcgcccacacatgcatgttcccagagaccccagtgacatatttcatgttttttctaaagttttatttgaaatttcatattggtgggcccacagggatttattccctatatccgcggtgattttttttttatgtccccggggtttaattagttggccccccccaattttattgtttggctcccggtggcaagctatttcctatatgcatattaattgaggggttcatcaccccccgatgtcggtatatatatacagctagcacgcaatttgccattaatttccaagatgaattatatatatatatatatatatatatatatatatatatatatatatatatatatatatatatatatatatatatatatatatatatatgttaccggctcgatcggcgatcagaattcagaaatcgatcacaacataattaatattctgtacgtaccatagatggaatagacgtcgtataaataatccagaaattaaaatctgatttatatatcatgattaattgatcatgtatattagtagtattttttttctaaaagaatatgtatgtacgtacggatcgatcaaaagtatatgggtccaattacgtctgtccaccatctctttcttcagtgcatcgatcgattgatcagcttcctctggctctatatataccacccctctttctcctcttcttcgcatcgtctctctctctctcacacacacacaaattaaattgcgagcaaaaaagaaagattgcggccatgctctccacaggctttcttgaactgtgaactcgtgtgtgcatgctcctcatatattgttctagatcccatgcatgatgcatatcgatcgatctgatctgaattaggtcatcgatgcgcatctggatccccatcttgttgatagttcaagaaagtccttggaaaacatggtgccctcgatcttaattatatcttacttatatatctacctagctatatctcctgcctgctctaattcttggatcgatcgcgatggagattaattgatctgtacatcgatccatgcatatcagatactgctcacccggccgccatctgcgtgcaattcgatctagcaggtaaaattactgcttggatttttattgaattattctttctgctaattggaatattctatctgcaataaaagatatcttgaaataattcgatcggccaggctaatttcagtactctttaatttgatcagatctgcaagtttatgcaccctttttaatgtatggttagtactcaatttttggataacaatcgatatgatagtactccatgcatgcatgcagatctccatatgctaatctgatcttatcatttgcacttggtattctattcatgagtcatattatatatgtatagctaactgttatatctactccattttttttttttgctttatggtcttgtacatatatactgcaatatagttcgtgcttcattgacccggtaggtctctcacatatatatataattttgaaattattccctgagtctaatttacctaatttccttggtttatatgttcctatttggttttcttctgaattcatctatgttttgatcttagatccttttttccagtagtagatagattatatgtgttgtgatcggttttcccaaaactgtttgtacgttcgctatataaagatcaaaaaaagtaagtggcgtttttttactgtttatactttataccatatatttttatttgaaagttgtacgcagcagtagttttcatatgaatggattatgcatggtgtgctagaccgctagtattattgttcccagttgcgttgtgaacaaatggtactgttgcattatatattatatttagataatggaaatggtttactttggcagtatattatatgtatatatatatatatatgcagagttagccatcaaattcagtactggtacaattcaaggcaagatatatatgtttcaccaaattaagaagaaaaggcaatctctgtacatcaatataactggtgaattaagttaaaggcttgggttttaattattagcccctttatatatataaaaagaagttaaagtctaccactacatacttacatagtattacctagtacatgagaaattaagaaactgaatgcatggtgaatcctaattaattctgataggcggccggtgatagcaagccttttttacagtagtattgtttgaactttgatctgtgagctgcattgcatggtggaccagtgtttgactgttcatctcttctcttttgcttgcatgcatgtagctgggaaatgaaagctaagaaagatagcgtgcacgagcgtgcagaatggcagcatatgtatgcattattcagtactgctagatgaacagaatctagaaaaagatgaactgaacagcagcagcagcagcagatcgaaggatggatggatggacggatggagcaagctaagctaagctttcgttttgtcgatccatccgtccatcggtgtcgacctagctagaaaggctgacctgtcgcgtcgtccatccaagatcgatccaaccagcaaccaggcatcagacaggctctttcttgtccagctgctgctgctgctagtacacatactacactgtctctgctgcatgcatgcatgctgctcacctcatctgattgagagttcagaattgttgagagcaagcaagaaattgagaaacggccaggacagattggattgatcttaattggcatatatgctgctcgatcgatactgtctgtcagttctcagttcgtcgatcgatcaagtctatatttggatatctgaatctctgcaaatgccaactcgaccactaagcaattcatcaatggacatgatcatagtaatgtcgatcgacgtgcagtgtcactcattgttgggagcacggtcaaaacctccagttcatatcatatcatatgaaatcgatctcaagctcaagcagtttcgatagatgcaaaattgaagatggaagtataaataactgctactgtatatacatatggagggcaggaaggcaggcaggagattgatgaagtgacgcgagcctgccttgaattgtgctagtttctctttctctctgcgcgtgtgcttgctgcccctagctagctagcgaagcgtgtgctttcactgtgcattgcatatgataggaggtagtactccactactccatggtgaactggtggttgcattgctaaccacagccatagagctactgagctagctgcgaataatttcattcatgtttgccgatcgatcgagctgcagcaatgatctttccctgcagcaatgatcacgttgcatgcttacttgtttctcttcttttaacttttttcccctctcctttctttcatccatagtttttacgttaatatgcagatgcaggcagcacaccttcttcttgctccaccggctaccagcacctaagtaattagtgtgttcatgcgcctctgattatatatgtacatatatatatactccaatatatgtggtagcatggatatatatacaattcatgtcttttgtatgtactaattaatgtgtattgtcatgtgcaataatggaaaatgatgatgtaaaagttgagacgactgaactataaataaaaatatatatgaaagatggcattattacatatgcaggccgtatttgagtgctactgatcaattacttcctgatagtgtggtgaatttcaagatatatattgtctccgaatcgatcgaagcatggtattatatattctactcgtgacgtgatatacttacttaatttgatttgtttaattacgccttatcacgcatgcagctcgatcgtaatcgaaccatgcatccatcaatatatactactccagtatatttaaaaaagtcaacggcttcaaacattttgggacggatggagtatatacagtggtgaggctagctgtagataaagctggcaacctgtactctttacatcctaaatagttaaagcgaatcaggaactgatcatatgcaagatttaacccgcacatccactattccgatctccatgccatctactacgaatgaattgccataaaaaagatttaccaatcttttctttccttttcacatatagtagacataattcagctcagctgccaaacaaagtattgaagttatttgtgtaaatgacctcacaaatttggtatagattgctattagctagtagtatacaatacacatgcgggtggcaatgtaatccatcttccttatctaaaatatgatacaaaaatgtgtaagcagcgacatagatcttcagggatcaatcagttgatatggagtagtagtagcttgctgctgctgggacattcagatattgatgaatgcaggttttgtcatggcagtgaggcagacagcagagagcaataaaaggcactagtaactacattcgtctcaggagtcaggatacatgaacttttaaggttaaacacggctattagttgagaggagaaatgttggagaatttaaatggtgaaagattatgattagttgagaagagagtacatgtgaaaaagttgttatattttaagataaattataaatgctaagttattattatattttgagtcgaagaaattctaggtgggcaagcaatatacttatgatgattaggcaggattgatctggattggatgtggggatcagagggagagcatgcaccagcaccacactctctgcagctttttaggtgcagggtggctttcattcagtcatcaggagtagcagcttctgccgggcttggaaaaggaattgtggaaaagatttgcacataaagtgaaagtgaaatgggatgtacattagggcatttacaatccaaaaatggtcttgtgagggagtatgtcacgtactaggttaagccatagtcaagaatactctcttcttaatacatagtagtagctttaatgagctccaaaataagcaaccgcgacgaagctaatgcttgcacaatataattgtttcgataatagttccgcacgcacaaaggctctgcattttatgccgtaatataattgtttggataataactctcgtgcctttttcaggacaagtacatgcccatgaggccactctgacatatctgttgtgttggcgtttcagttttttagtttgtcgggctgtggtttctgccagtctaattctaattcgacagcctcctgtcgttgcaagctaaaactacttgtactttaattttatttctcccaatcttaatgaaatttggtcgccgattccttcggccgacccggcaaaaaaaaaaaactctgacatatctgatgtagaatcgcgagaccattcgctatgtcaccgcccttagaggtgttattgttttttttttcctttaattttttccaagctcttttcttattatgtagtagtatatatactactactgtaatatggagtactattctgtggagctcattgctgcagatagaaagatagatctttcatgggtgctcattgctgcagtgacctgtgaattgtactagctaatactagtactgtactgagtgacagtgtgtgtgagtggggtgtgtcaaccgaaggaaggaaccgagccataaaggaaagcgaacaaacaactttagtttaggcggccttttggttttgtttgtttgtttgctgcaccgctgtctgcagtttgccctagacaaccaaacaaatgcttccccatccgatccatctacctatatgattgtgagtaccagtacatagtagttagtgatcatcatcatgatgatgatcatgcattattgtcattatcatcatcaccatcatcgtctttgtgtccaaaataaaaatatctgtcagcacatatactgagtacatgtgctgtattttcagaatttcagaccaacattctgagttctgactgctgcatatatgtccatatatgtagtattttggagacaaacaaacaaaatttactaccgcggcgctcatctatcaacatgtacaagagcccgtgctctgctgtgccttatcaattctcctccgaattgacatactaatattaccgccgctgatgctggttctgacatattgttatctgctaaattctctaatgatgttatacataataatgctgaattctataatgatgtatttcatcactcatgttaatcagatgtttgcggtccttttatttggcatccacaattgttccttcttcctcttgctttgctcagctcaattgtttttagccaaaaacccagaagttgatgttggcatcacatcgcacgcatggaaatgaagaataaaattcgagaactcaaaacaattcaaatgtgtagattgattttattatccacttaaatcgactgcagtataaaattaaaggggatagaatgatctttctctatgctagataatctccctcactctagttattcaacacgggttaatgtttttatatgtttgatgaatccaccaatccgatgaaaaggatttgattgtgccatctattcaaccgtatccagttaaatctaatctggcgcacgaacaattaggattactatcgaagtgaagatataacacgaaataactactgataaatttctattttgcagcagattcccagcataatctcatttatactggaaatataatgtaccgtaaaagtcttctaaaattcaggctgcaaggaaactagtatttgtatataacccatatctgaatccaacaaaagggccatcaatcccatccgtttcgttgggggtacaacaaccttgaaaaagcagacatggaacatcatgtgctacagctgaaaccatggaccagattacatgtctgaatccacttaacacaagtcaaacagacagacagacagctagttagttgttcaagccaaaaggaaaagtatcaagccattaactgattagcattagcagcctacctacatcgatcatgctattgctaccacattttgacatgcacaagattcctccccttcctccaaaatgcatgaacgattttagcccactcatcaccacaaaagatgatcagagagggagccggacgcagcaaatcaagtcatcacttgttgcagctagtgttttcttgggcgaccacgcccccttcgaggcttctccgccgcttctttcgacctgatccaccaatcacgcaacatacaatggtcagaacgtataaacttcacagctgttatgtttacagtggaatgaatgctcacccttctgaggaaggaggatccagaaagtttagaacttcattcagagcatggaaagccatcttcttgatctgtaaaacgcacaaatcaaattcaagtcagtcaccacatcaaacaccagaaatttcaactgacaccaagctaacctctagcttatcttctttagccctgtgggaagatggaagtcgtctaaattccttggtcagcctaacacactcaccaacattctcgggggaaacaaagtccagtgcaaccttgatgcaggactgcagagttcagttcaaaattagcttcattttttttcatttttcagcccccatatacctcatgcaaatatcaggaggaagggaaaatattagtatctccatttacagtaattcagtcacaccttcaaattcctgacttggtgaggacatccggcaggaatcaaaactgcttcgccaagcttttgttcaaaggtccaaggttcaacacctgcaacaggaaatccacatataaaaacaggcatggtcatgaaacaatgtgattgcagagaactcaagatctaatgctaacatgtttactaaccatattcttccttcagctttcttttatgctccgcagttaaatagaaagcttgatcatgaattggatgaataacctgcacagttaacataattgatgatactcaacatagctcttggtcagcaaaacacaggtaatatgtattgttatcagttgcaacagcatagagaggcagacatacctgtttcactggattgcagtggatgtgccgaaattctggcgcatgcttcctaaggaagtcttgtaatttctcagagtcctctcttcggaaaatatcccacaaagcaccaccactttcctggtgctctgatacccctgaacctgtcttcggaggacgacctttagctttcttttgacatctctgagctccaatacgtgcatcatcagaattattggtctcatggttatggtttggacactgagctacatcactatgtaccacagattcataggacaatgcttcatccctggcatcacctccagcatcatcaggtggtgaagcgtttatatccaaacctgcattgtgcaagcaataaactcaacaaaacttaaaagtgggctaaaagattcatttcataccaaaagtatattttctccaccaaccattagacttgtctttcaaggtatgaacattttctttgctgcatgaggcctttggtgcttcaccaacagctttgttccccaattcaactgggcatgctgatggcttgagttcactgcctgattctatcatcccatatatttccatgtcatcttgcattttcatctttttctgcgtgtttttaatctgaacagcatcataagtctcacagggcacttccgctgtgtgtgttaagatgtttacctgataaaaaagatacctttcacaattaatcactgccaagacaaacaaataaagcacaagaaacaacaagatagaaaacatgatctatttgaatgtctgcagatgaggtacgtatacagcaaccagcaagtcaattttattcgcttatcagaatgaaagaaatgagcacaattcatacaaaacaacaaaacatcattataataatagagacatactgcatcagacatgtcacagtgaagtttggttacagagtcacccctgcccaactcttcagaaaatccataggcaatgtaagtttttggcccaagatctggcttcaggacaccaccaggaagcttcactgcaagatttagcggaccatatcgtggatcagtatactccggaaatggcaatgcactgataaattcagcaccatggcgaggcaatcgctgatcaaatgagctagaagggggccagtcctttagcttaagcatctcaggccagtaggtcctgggatgagttctgccccttgtatatcccataaaaaacatgtgtatgttaatttccacctggaaaatcagatatgaatgtagtaagcgccagaaagttcaactgtagatgaagaaagataggtttctctcatttcaaacagaaacacataacaaacattatttaatagggaagctcaattcactaatggatcaacaaaattagttaaactggtcaattatttaatcattatgtgtattactttcttctggaaaggcaacacatgcacacattatttcattgtcgcatttgaaaataagcatcatctcatgtatttctgccaaaagataaaatcaagattatgccaggtatgtaaaaagagtatgaactgtggtaaagtacaataaaccaaacccgagaaaaagagtactatcacataaacacattagagatcctcacctcacaccagtcgaggcaatctactgccctcacagcaaactgctcatcttctgccttccctttggttcgttctcgtactgcccgccacataaccatcggctcccagctaagaccagaagttagcttaagagtgtctgaaacaacaactggttcgccctttgcccaatgcatctgaaagtgcaacaggtcagcgtcctggatatcagtggccaccggacagtataagtagttatcactcgagtcctccctatttgcagcctgacgtaatttcttgctgtcacttcttatcttgcctgagtgatcaaaacaagggcacagctcacttgttctacctagttcttttgcaaatgtttcactccagaagaccttctcagatctatcttctaattcagggagcaacttctctggaaacaagcatttcagatctagagatgaaaaactgcagtcttccttttcctttcgtgggcaaggtatgctaccattactgtttgctttccaaagtaacagagccttcttttggttttcgtcagaagccatgcctttgtttgactcactgttttgggtgtcgctgcgacacttcaaagagtccctttggttctcaccatctgacagaatcttaccaaaagcataatccttgtctctttcttcaggatccaaaatttccacctcttctcctccagggatctcacctttgcgaagctcctggcagcaggtcaagcacaagtcatagaaacagtgcttgcagcttctatgaaaatcaactatagaagtgctgcatctattgctgcagttgacaacaaaattggatcagatgctttctggtattatatcatagcataaagtgaacaaggaaagaacttaaccaatagacacgctcatctagatcacacacagcttgttccacctttatttgatcaactgaaacacctgtaaacaaaacaagatgagcattcatagccataccagcttccagtctgtgtgctagagaaccataccttgtatcttagcctctaattccttctctgccatctgctcctgtcgcagttctatcagccaaggacgcaacaagcgtaacacatgacaggcataacgaatctgattttctttagaaatttcctttcttggaggctgcttcacaatgaatggaatgaactattcagtaagaatactagaaagtgtcatttattaactttaaaaagaaatatgtcctgaagaaatggaaatgctgtaaagaaaagatgagatggaaatgcaaacctcttcgacacctctcattcgcaggcatgccttgcaattacaattcttgcgacaataagggcattttgcagcaaattcattttcaggcaaatcaggatacctgtccagttgaattatacaacacatgggatcaccttaaaaggttactagaggtatagtgcataaaaacatatgtaccaaggcaaacataagatgaaacaagaataataccataaaaaatgtaagcagaaaaaatgggtgttatgggactatgggtaagatgaaagcaaaatgtacatttaagcctataggaaaacagtaggctgggagtccaactagtagactagaagtttgaggaaacttggcacaccattgattaatgcatggcacacaaaagcgcttattgttgcaagtcttgcaccagaccactctccctttgtcatttctctggcattggtgacacattaaggcgttttcacctgtcaacattttcttccctttctacataattgaaacaacgaaaagttagcacacccatcaaaacagttatacaattttttttaaaaaaaaaacttatacaaagaaacgtgtagtttatgaccccattattttctgccgctcctgtgtctcctctcttacgcttcttttcagtcttcgaaaccttatcattgactaacatcttgccttttactgcatttgcgttatgctgtcgaggaaagaaagtcatgggttatttcggtatcaatatcaaagagctggggttatgtttcactttgtaaagaacacaaaagtgcaccttccaagcaagtacatgaaacctctgaaattttcatgctttgaatgacaataacatgcttaaattaagcatgtagttagttacatcgaatcataacaggtattcagacattatctaaaaagacaagaattcaagcaagcacttgcactgtcataaaaaatctatgcaaaaccagcttgcatagaatcttgaaacttcttctaaaaaaaaataatcttgaaactgaccaagttcaggagaaacataatggtgggtttatcattaagcaataaataaagcgactaaaattgacggtgaaactgcgatcttactagggagacttgataattaggcccccacaaaacaaaattaatttaaagaagagatttggcttggtcgatgaatcgcaggtagcttgagaaggtatcaggtactcgttcacaaggtagcaggtcgagtaggaaacgttcaaaagtaacgatgcaggcaaatatatagtgaactgcgtacatgtcacaaaccaaaccgttcccaaataacttgtaaaaggaacgttgagtagtttaccctgtgggttttgatgttctcttgatccactttcttttttctgggtcctctcttcttccctgcatcacgtcttttgggcttgttgagaggctcgagaagttgatcagttttctcgacatcctattggcaaaacagcaattggtcagtataactttataagttctccctcaaagagtaccaaaatccatactagatagatactccatccgtttcatattacaagtcgtttgacttttttcctagttaagtttgttcgagtttttgactaagtttatagaaaaatgtagagtactatttcaacacaaaataaacatattattaaaatatattcaatgtagatttagtgaaactaatttgacattttagatgttgttaaattgtactataaacttgatcaaacttaatcaagtttgactagggaaaaaagtgaaactaattatagtatgaaacggatggagtagataaaagcacaaacactgaaacagcaacggatagcattttggagaaagaaccgaaaaaccgtaactttctttgacgtaaataaatttaaagatatttgtagcaatcgggcgaaatgagatgagaaagcaatggtggaagaatctaggggaaaaaatcaagatgttttgggatataaagggatcggattcgaaggaataattccgtactagtatatcctataccagtactagtatttttttaatcagattcagattcgatacagaggatacacggttgctggaatggaatggaagatactcgagcggaaactgaacagacaaaacaaaatgtatattgattgattgaacacactgcgtctgcaatggctgcttgattagcaacaagaacaagctgtttgatcaacacatatgacaggacagagggggggagagagagagattccctacctcatcatcgtctggcgcgttgaaggcgttgggcggcggcttcctttccctgagcgccccgggcctcgtcgcaacaccgcgcccttcttcctccggcctcatcgccggcgggcggaaagcccggtcgccgttccggcgcctccccttggcgcccgatcccctctgcttaccactcttccgcttcgcctcctcgccggatccgtcgatcgccgccgcctccacctcctccgccgccatggcggtgcggcgatggtattgatattggggcaaaacgagagagagagagtggcggctgcggcgtaggctctcaagtgtcctccttttattacccgcgcttccaatattccaaccacagttacaaaaaggtcctccaagtttttcctttttttcgttttgctttcacaacatttgaatgcatgcccgtgctttacattgcatatccaattttccaaataatactaataccgtgcaaatgcaactggttacttatatataaatatgatggtcattaagcttcaagttttcactagtgttttccttaggaagctcttacgcacaaacacaagaagaaacgttcagggatctttcgactaactccgtgaggtggtgagcgtttttttttcttacgcacaaacacatagtatatgtacgatgttttgctaacgtatggattttcccgcgcaattttgagcgggacacaaggttttaaatgtatgaattgattgaatatacaataatagcttttgtttcgaaatatacgtagtccatattttgtatataactatatcagtcgatatctcgacggttacaatctaaatccaccgttattatttgaataggttacatttttaatatagagtatgatgattagataacagatagtaataaattttcccgcgtaaaattggtacgtgcttttttatattatattttaaggagtggattgcataatagagtactccgcgtctagaccatagccatcattctctcttttaacacctaaaaaaagcatttgttcaatgtacagttaattcaccttatttaaaatgtacagtcgtttaagcttgatcttttccctctaaaaaaatgtatatctcttgcttctgtttacgtgcattttgtattttttttacagtaacatcaatcatcaatatatatacacgtaatatggtacacacgcatagtgaaaatatttcatcttgttttgtctgattattaaaaatgctgtaaaccatggtgattatttatcacggaggggacatgtaaatgagtaactagcgaagatatactgtgtacacaatggaagcaagcaatagaaggagtttgtgatctatgtgttttgaatgtgtgattttatggctgggtttgtagagattggtcgaagcaacacctctctctctctcttatactatggccgagtttagttttaaactttttcttcaaacttctaacttttccattatgttaaaactttcttacacactaacttataatttttccgttccatcgttctaattccaatcaaactttcaattttggcgtgaactaaacacatccacgtacaaactttcaatttttccgtcacatcgttccaatttcaacaaaacttccaattttgatgtgaactaaacacaccctatgaatggaatcgggtgaagggaagggtgtgttttagttcaagctaaaattggaagtttgtttaaaattggaatgatgtgacggaaaagttggaagtttatgtgtgtagaaaagttttgatgtaatgaaaaagttggaagtttttttttttaaaaaatatggaactaaattcggccgaagtgtactcaatcatagaaacaagaaaatgtggggggaccttgtgtaaaaaaacaggtactagtagtatgtcatgtcctcctcgagacgcgcacaggcaggcaggcaaaacaggcggccgcaccccgttcacttccttctttctggctgctgcagccgtaccaacgcacacacgcaccgcacctcctccagcgcgcgggcaccggactagtaggaggagtagccttcgaattttgaaatttgaaccctcaaccatttggagggaagctggaaaggaaaggaatccatcccatccacgagtcaattcaaggtttgaccacactctttccgttcccctcccaaaggcgtattttccctcgatacgtctcctttcttccccaccaccaccagaccagagacagggggagagatggtgtggctgcagtacaccgccacccgctcccagcgcgccgccaccgcctgcttcttcctcaccggcgtcgccctcatcctcgccgccgcccgcctctcctacgccaacatcgagccccagcgcgccaaggccgccgaccgacgccgtgtcctcgaggacttcatccgccgcaagcgcaaccacgccctggacctggaggatccccctcctaaaccctagctccacctgcctcctccttcttccttcatcccaggttccccgtcagattcctcactctgctgctctaatctaatcttgtaccatgtggattggatgcaactccacctagacctagcaaggaataaatagcatagggatttctattttacttactcactcactgctgtatgcatcactcttttgcctaaattacatcaataatattaatatatcgattggtttattcattcagtggtgattattcctgcaattcacttcttacgtccatcaaacgtttgttactcttactaacttttattttcattaatttcttccgcgaatgccgtctctaattcttgcaatccaacctttcctactcacaattacaacagcatgcgaatgaatctcgatcaagggatcctaccactgttttctacttcatgtactattcattccattttttgttttccccctttaatttctttacctctccttcagccttgtcaattgcaattcaggtattgccaatctaatggacaaaattacccccaaggagtttgtcataaccacatctacttcttttaactccactaaacccattgggacacctctgggtttgctaccaatgctactcatcatgctgcctatatgtgatatctcatcactgctaatcaacaactgaactgacaagattatctgcctacatatgtcaagaattactgcaacttgataagaatatttttgtacaactaggaacccttatgcctgtataatctccacctatgctactgatttccctcactgctgtatgactcactacatttcctaaatgtcatcataatacattatttgattcatcggctgtttcccaattcacatgcatcgcacattttcgattgggctatcttcttttgttttcgtacttgatagaaccatgctcctgttttcagtcttacaatctgcgtatctctcctccacctgtcagtttattttgcaaatctcacaatctgcgtatccctcctccagctgtcagttttttttcaatgcaaccattttttccaaaggataggaaacaaataatcaagagaacctacttttgtcttctattctttctg

SEQ ID NO: 75619 - DNA, 183443 bp, Oryza sativa
gggacaaaatcgtttgtacgatggcatttaaaggatctttgtccggatgaatggttaggatcctttcactactggaaaaagtgtttttccaggcgggccaatcaccatttcactggcgggcaagcggtcctcctgcaactcaacgattgtaaaaatagttgatttttgcaggcgtgtaattggttcgcctgtgaaaatagcttccagcgctaaaaaaaggcacccaccgccgtttccggcagtagattcccgttcccaatccagttcccacacatttcccatccaatccagtgaatccaaattcaacaaagaagtcaccagttcatccaaaattcagtttcacacacaccagccatatttcagtttcacaagaatcaattcaagcaaagaaagcaaacaaaatcacatgtaaaatcattcctaaaatcactttatacatatagctcatccatcttcatcagcaaaaactcccacatcgccgggagggagggagaggccgggagccatcgtctgccgccgctgcctcacggccgcgccccgccgtcgtccgccgccgccgccaccgcacggccacactccgctgtcatccgcgccgccggccaccgtcctccccccaccccctccggccagatctgggagggaggggccgggagccgtgccgcctcaaccctcctcgccggccgccgccgccaccgcccgtcgccgctgccgccaggagcacgcgccgccaccgccgcctctggccggcggccaggagaggtgaggggaggagaggggccgatgagagaggagaggtgtggaggggaggccgggaggagaagtgttgagggagagagagaaatgagtggtggggagggggtgggaggaggagataaggagttaagattttttttagtacgatttttgcaggcggaccacataagggtcacctgcgaaaatccggttaagtggtccgcctgcgaaaataaagcggacaatgaacttcaccccgatttatatttttgtaggcggttatttggttccaaaggtcatgtccgcctgcgaaaaaagacctcgcgtcgggaaaaatgccttttctagtaatgtttatacttatgaagagagatagtatttcattaacttttaatttatagcctatgtagctaataaattgttaatattagcgtgatcttttattaaccgagcaatagaacatagaaagaaagaaacgttgtagtcataacttgggaaacaacttcagtgacatggccacttgatgagttttgagagcggttttcactgacgtggctcattgacttagtcaaccatgtaaggacgtggtagtccaatcacaaaataaaagtgaatccatatgtaagtgactagaaaaaaataaaaaagataaatgaggcccacttgttatactcattatctctctttttcctccttcctccctctccctatccctctctcccttcactattcccctgtcggaagtggcgagggagggagtggtggcaggggctcagggcgatggtagtagtaaccggcaccagagaggggctgtgtgatggcttgccgttggtgccagagagggggctgggggaatgtcgtgccactggtgttggagagggggttcggggactatgggaatggcgtgccaccaatgtcaaggagggggctgggggactagcggctcttcgcctgcctccatagcttcaccaagttcgactccaccctcgcctcctaccttgatggcttctccaagctcgagctcccattgctgagtgcggcgccaccactccccttttcacttagtcctccctgttgctgtcccatcccgcctcctcgctgcccacccctccttcacctccccgcagggatcttgtccttcatatctctcccaggtttcgccaaccgccgccgccgccaacgaggttgttgccgcctccagttcctcttccaccggacaccaaacccctccccctcctccgtcgccggtgatgccaagctaagtggcaaggccgctggttctagactttgagtggttccaagcatgaagaagttaggggaaaggaagagggctgataagtgggctccatattttttatattttttcctagtcacttatatatgggccattttctattttgtgattagattgccatgtcaacgaaaaacactatgaaaaccgctaagggagttaaattatatcggtttaatagttagggtgaagacatccgatattatggtttagggatacaaatcaaattggacatatatttgaggggggtcataatggacttactctatgggaaaggcaattttgaagaggaaggatgcggccaactttaggccttgtccagcaggcctcaattccggcccattccctgttgatggacctgaattaaagcagggccttgagagaaaaaataataatttgtccaagaaataattttactctgatccttagtgcaattcacgaggggaaagaagaatagcattgcaactaagtaaggaataagttcactctgtgaccctaaaagtgattgaaatctaatccgtgaccctaaaccgcaaaacaagatatctcgacccccaactcttaaaaccggtgcaatttgactctctcgcggttttggagggcggttttgctgacgtaacgcctaagtggcggtgttgacagggtcttccttacacgtggcgttgacgtggcgcttgcgtggcatcagaattaaaaatatatatatatatatggcccatttatcattcacataaaggatgacatgtgggacccactgacatgtggggcccacatgtcatcctctcacctccccttcttcctcgtccccctccctctctcccttctctttttctctcccccaaactctcttcaccagagcggcagtggggacggcaacggcgtagaggggaactggcggtcgggagtggcggtggcgtccggctcagttgttgtcgcccgccaccatgaccgatgaatctggatgacgacggttgtagtggtgggcgtagcgcgcggggccgtggcgggaggaagtgagctcatcgaagccgttgccgtccgtgtccatggcggcatgaaggtgtggatctcgtcctcggcagccgggcgaagaacgagcgagcgaaggagcgcaactgcggcggcgactgctgctgcgatgacgacgtagacaataggggtgaggcggcgcagtggtagtggtggtgggtgtagctcctggggccgcacgggaggaggcaagctcgtcgaagccattgtcatcagcgtccatggcggcatgagggcgtgggtctcgtcctcggtggccagtaggactgcaagaggacgagcggcaggaggactgcaggaggagagacggcggaatgggggcggcgtgcccactccgcctcctctccaggcccgcgcccgctgcccacacgctccccctcggggcacgctgctcccacggccagcctctctcttcccccacccatggccgctgccgactcccaccgccacagccgccgctcctcaccgcccaaccgccgctgtccccactgccgctccggtggtgaagagagtttggggagagaaagagagaagggagagagggagggggatgaggaaggggaggtgagaggatgacatgtggaccccacatgtcatcctttatgtgaatgataaatgggccctatatattttttaattctaatatcacgcaagcaccatgtgtaaggaagaccctgtcaacaccaccacgtaggtgccacgtcagcaaaaccgccgagggagacaaattacaccggttttaagagttagggggttcacggattagatttcgatcacttttgagagtcacaaagtgaacttattccactaagtaagcatctctgcttttattgggtaaaaatgacacgacgcattgcatcagaaactgatcatgaacaaccatcataagaaactcaaatttgactcctattacaccgaatcaactcaatgtggaaaactcaaaagtaagtgctattacaccctaccaaacttcaaatcggtcaaaagaatcgacgacgacaagcaccatcaggtgctctagtatgtatgcagtacacgtatacgtatatgtatgggtacacaaaaaaaattaaaaatgaaaacccctctaatggcagctaacgctcgcgccaagatttgaataaaaattttattgcttaattcgatcgatcgtcttcctcctcggtgggctcgtgctcgatcagcggtagcagcggtaggccggggtgtacatgcagctctcggcgtacttgacgaggtcgtcggggcgcgggaggcggctggcgaggccgagctcgtacgccttggcggcgaccttggcggcgatgtgtgcggagatcttgcggatgttggtgaagggcgggaagatgagccccctggcgaagttgtcctcgctcacctgctccgccagcgcctccgacgccgccagcagcatgtcgtcgtggacgcggatggcgcccgagatcaccacgcccagcccgaaccccgggaagatgtaggcgttgttcgattgccccggcacgtacgtcttcccctcgtactccaccgcgtcgaacgggctcccgctcgcgaacaccgcacttccctgcacaaacatttcgattcagatcgccattgacgatttcgattcagctctattgatctctcaccttggtccaggtgtatgcctcctccgcggtgcattccgagtgcgacgtcgggttggagagcgcgaagatgacaggtttctgcatttgatttcatgttagtgcacttgatcatcatcatcaagaagaggagcgcacatatgcagccaccatgatgtgtgcattggttacctcgttgaaggcggccatggcctcgacgacctcctgggtgaatgtcttgccgacgccggaagtgccgatgagcacggtcggcttgatggactgcacggcctccagcagcgtcttcaccggctcgtgctcgtgcgcgaatggctgcttgaagtgctgcagcgactccttcctcgactccacgatcagccccctcgagtccaccagccacaccttcttccggcaatcattgatcggaatctccgtctacacgaataacacacaatcaaatcacactccatattgttgtttatcatattcagtgaaagtgagtgaggcaatattcagagtttgcagtgtgttttcattcagttacctgctttgacatctcgagggcaatgagctctgcgatgccagttccagcctcaccggcgccaaggaacaggtaagtgtgatctgcaagagttccaccgaccaccttgagcgccgcaatcagacctgcgaggaccactgatgctgttccctgccatccatcgttgtagaccaaattcatcacattagtatttttgtggctactgattcagacaaattatatgggcgtgaaaccagaagaggttcacaaaagtttcgctttcttgtacctgaatgtcgtcgttgaagacaaggtggctcttgctgtactttgcaagcaagtcaaaagcattgtggttggcaaagtcttcaaactgtggaaaggaaatttgatgttattcagtcatctcctgaatcctgataaaggtaaaaacagagtgtgcacatgtaacttaattaattcttctatgcagactgacctgaacgagcactttctcgccgtagttttgcttaactgcggtcataaactcctcaagaagctcgtggtattcctgataaccatgataacagagataagataaaaaagaaattctatggtaaaaagagttttctgtttcaccaattaattgcaggtgaactacgtgtgcagaaactgtggcttacctctccggtagcacggcgttgcttgagtccaatgtagaattcgtcgttgagcagtgactcattgttggtaccaacatcaattgtgattggaaggcactgcatcatacatatattcacatttatagtcagcaaagcaaatccatcaacagactaaaaatactttgatcatttcatgaagacaagaacactcacagctgatgggcgaactcctccaagggcagtgtacagagacagtttgccgacaggaatacccattccctgacatagtaacagcagcacatatcagcaaatgcttccaggtaaacatacatcatcacatctaaattctttcgacacattcatgacagcaaaatcagggcaggaaatgggggaaaaatgcactacctgacaaccaagatctccaaggccaagaatgcgctcgccgtcggtgacgacgatcacctggatgctcctctccggccagttcttgagcacctcaaggatcttccccctgaatccaccaaacaaacaaacacagattcctgtcaggctgcaaattcctaatcaacctcaccatcatcagaaggaaagcagaatcctagcaacaaaaaccgcacttgtccttgaggctgatgtacaggccctgtggccgcctgtagatgctgccgtacttctggcaggcctccccgaccgtcggcgtgtacaccaccggcagcagctcctccacgttgtcgatcaggagcttgtagaacagcctctcattcctctcctgaaaaagaaaagcacaaaaaaaccaagaaacatgacagtgttcagtaatccacagttctagtgaaagggcatgtaggtgttgagttcaaatctccataggaacaaatttcatgttgggttatctaagggctaagttctctgtttggtaagctaagtttctaatttaaaaaggctgcatgtatccgattgaatgtagagctcgagtaaaaatacccttctcaaaaaaaaaaaaagaagtaatccacagttcttgctgcatgaacattatcaatgcatttgatttgagtgggtgatcaaacttttggtggtggtggtggtggtgtttgtgattgtacctggaggtccatcatggcgatgtagcgctggagggggacggtgtagttgcggaggttgtgcatgagcttcttctcctggagctcctgcgagacgatggatggcgggaggaggccgcggaggtagtgcgcgtcgcgctccgcctccgagaaggccaaacccttgttgtgccgcgggtctctcagcagcgtgtacccgctgcatcacatcacatcacagcgcaagaaattcgaattcaaattcaaattttttgttatggccaccgaacgatcggttgcgattcggaaagactcaattctcaaattaatgtagattttcatggatttgatgcaatgaacgacacgaatcagtttttttttaggccggacaagcttgtaactgaagcgagtcaggaaaccggcggagtaaaacaaacggaaactttatggtgggtgtagagaaagttgggaacaaaaacggaaggaaataaaaagcagaggcttgagatagaacaagggattgatggatgccgaattcgaagaagaagacgaactcgaaggagatgatgtctctaacctggcgacggagaaggaccatggggtgatgagctgatcctcggtggccctgtcctcgccgtacgtgtcctccacgccgccgccggccatctcttccgatcctcttctcttctcttctcctcaaaattcaaaaaccaaacgatcgaacgaaacgatcgatcctcttctcctcagaaataaaaaggaaacgatcgatctgctcttgtcctgttataggaagaaatatttgcgtggatgggatgcggcgaggaggagaggagacggggtatttatagagagaaggtgggggcccgcgtgtgaaagggaggaaacgtcgggtcggaggagtcgcgcgggtggtggcatttaattcgtaggacgggtggttttcccatggagcgaaaggggggaaggtggtgggaaacgggaggggattgaatagtgggaaagcggaggtaggtgacggaagacgagtcgtcgtcgtggcggccgtcgccggcgagcggcgaaccggcggcgggggtatgtgcgtctgttgtttttgcgatgggcgggcaagtgcacgggtgggtaccggtggatggtgcaatggtgggggtgattggttttgcacctggttttcgggcttacccgtttgcctgtggctccgtacctggaacggtgcgaccccaccatttcccttttctattttttattgcttattataaaagtgaaataaaattgtatgtgtagtagcagcattggtagaaaaacaataaaaagagtgtagctggtttaggttttcatttagtggaagtgtggaactaacccatccgattataaggctgtgtttgaaagataggggattgagaaaagtgggaagatacgtaaaacgaggtgagccattagcacatgattaattgagtattaactattttaaactttaaaaatgaattaatatgattttttaaagcaacttttatatagaaaatttttgcaaaaaacgcaccgttaagtagtttaggaagcgtgcgcgcgaaaaacgaaacaaacaaactccctttgttctccaaacgaacgcagcctaagttagatttgatggcgtatttttcttatggatgtagtacttatcaatgttgataacccgtgataatttcgtcaattttaaaatatgcttatctaatcatatctactcataaaaattaaatgtgtgtttatagagataattatacacgtgttgtggacatctatcctttatatagtgtttctatccatcataaacaattaaagatataagtatatttgaaactttaaataaactgcaccgggtccttcgcagctggcttttacgtgcctgcattttgagtactacggcctgtttagattacaccataaattttttcatcatcgaacatttgaacacctgtataaagcattaaatatatgcttaaaaaataactagttgcacagattgcgactaatttgcgagacgaatcttttaatcctaattgctccataatttgacaatatggtgctacagtaaacatttactaatgatggattaattatgcttaataaatttgtttcacggcttactgacggatgctgtaattagtttttttactaatacccgaacaccctatgctacaccttatataatatccgatgtgacacgctaaaactttactccctgcatctaaacaacccctttatcgcacgtaggtttggttcaggtggtgtttggatccagagacttaactttagtccctacatttagacactaatttagagtattaaatatagactacttacaaaattaattatataaatgaaaactaattcgtgagacaaattttttaagcctaattaatccataattagagaatgtttaccgtagcatcacataggctaatcatggattaattaggctcaatagattcatctcgcaaattagtacaagattatggatgggttttattaatagtctacgtttaatatttataattagtatccaaacattcgatgtgataggggcttaaaagtgttagtccgtctaaagtcggtctgttttcgcgggagcacatgggccgaccagccacgtcagcataccctgcctgcatacgaggaatgtcgtcaaaggatcggcgatgtacggacagttcatcatgaaaaaaaaaaaacgaaattcaaaggaagaggaagagaagtccctccaaacaagttttaaaaataaattataagcacgggatctcgaaattaaaacaaacataccacttgtcaatgtatctcgaccgtataacatgccattgattcttcgtccattcgcgggacgccggctaaggcctgtttatttctctatttttttttaaaaaacatcacatcgaatctttgaatacacaaatggagcattaaatatatattaaaaaaactaattgcataattagagggaaaatcgtgaaacaaatcttttgagcttaattagtccataattagccataagtactacagtaatccacatgtgctaatgacggattaattaggctcaaaagattcgtctcgcggttttcagacgagttatgaaattagtttttttattcgtatctaaaaattccatccaacgtccgattaaatatatgatgtgacactcaaaaaatttcttttcacgaactaaccatgccctagctcaccgtcctggcaaccagtcaagtttcagagtttttactattttagggcatattcaggtttcacactagaattcaacttcaacgttgacttttcaatggtccacagggtacctggcagctactattagccccaggcatggtcaaactacaaacccaattcgatcagacttgtttactcgtatcttttctccaaaagtgcaaggctttgagaccaaaatgcctttgttcgttcgccgcatctccggagtcgttgcttacttttaattgtctgttatacatggtggtcactgaaaacgtgtatagtacaccaaccaacagattattacggactcttggtcagtgtatactagggttgaaaacggtatggaaactttctggattccggatctattttcgaaaacagaatttatcggtcgaaattttttcggaaatttttggaaacggaaacagattcggaaatattttctcggaaacacaatcgaaaatgataatggcagtttccgtcggaactcggaatcggtcggaaactttacggaaattttctcggaatttctagaaatcacaaaataccttgaattctttttttaaagcactgaatagttaataccatggtgtttggctgttatttttttaaaaaatatttattttgcaaatttaaaattacataagaatatttttttctgtattgggatttatcaatatcattactaatttattccatagattgtgttttatgatgtattattgatacttaacaattgaacttatatgattgtgttttatgataaattgttgaccattgagacttgagaattgggtttatcagtttaaggggtttttttttattccgataaattttcgttaccgtattcgtgccggttcgttttcgctccgttttcggtttcgataatattcgattccgttttcgtatccggggtttccgattccgatttcgattccgaaaaaaatatgaaaacgaaaacgataaaaataatttccgtccgtttccgtaccgttttcactcctagtgtatacaaggactgaacactgcaaacgtggaaggaagaaccgaagaagtggtagccagcatatctatggctgagttggattgttggaggtggagactaatccctcgtgcatgtaaaactaaacggttcattagttcatattaattatttcttaaaaaagattaatataatgttttaaacaattattctataaaaagaatttgcaaaaaatatactgttagcagtttgggaaatgtgggcatgaaaaagtataatacggggttgggaacccatctccccgcacggaaaacagagcagtccattagcacgtgattaattaattattaccttttttttttcaaaaaatggatcaatttgattttttaaacaactttcgtatataaatattttacaaaaaatacaccgtttagtagtttgaaaaacgtgcgcgcagaatacgagaacccctcatccgcacacaggggtacaactagcagtatagtaatgctcaatctgaaaacagatgtttattggatggattgtggcattatagaggtaaattaaatattttaataaataaagttaacatatcacttaaaacaaaaaaaaagtagtctaaataatgtagttgacaaatgtttttttataaaatgtattttttcaaacataaagtaagagtaatctgttttaataaccatggtaaacattatttacctaagcacaatatagactctaattcaagaatacataatgtaggaaaagtcaatttatgatttagttacgtatgaactcattcttactacgagttgtgtaaacggtcacgacaaaattcaatatgccctactacgtcaacttcacaaacctgtaatgctataaaatcaatctacatgtcccacaatgttgtttctttgttatagatcgaattttcactttaaattggtggatgcatggctactccctccgcttcatatttattagaaggaaaaagtacgaattaccccccgaactatcgcggtcgtccgaattacccctgaacggtcatgataatggctatgtctcggtcatgatgatggcttggtcaggatggcgacaaggactggttcattttctctctttttcattttatttttctccaggagagccaacccgtggaccatttgtgctgaaataacatgtggatcacctgttgatagttgcattggagccacatcgaggatcccagattaatcttccattctctctcttaagcaatatgcatgcttagttcattgtgatgtctaattttatggatatctgaaatcccaatttgcatgtccattgtccaagatacatgaacaaagctagagtttttcatgaatgatttatgcaacatatatcatgtaggtaggttgtgtttagtttttcttttcttggctcatatggttatgtctaggtaaccttattgattctctggttggtaatttatataagatcattttacctgtgtacaaatgagtgtgctttcagtactaatatgaattgttgccatgggttcatattgagcctattgcgccacccaatttggtaagaagacagaaggtggaggtcaacagggctgagcgtcccttgctttaggtcttgctgtccatttaagcgagttgcagcccatcatacttttcttttgcatgtgttatatatgctaaattgctaatttctacgttgtattatttattcttaattgcagatgtctccactactcaggatgcatatggctacggtatgaaattcccagttccttcgttgtctacagtatgaagttcaagctgattaatgcatatgcttgtgtttctccaaatagtgtcgtttagtgtcatatattatttctccctctgttgttttagtttgacatgaaatgcatttgtgatatatttcttcttattctttgtatatgtaatagtatgcagacaaattgagcaggtcttcttttcatgctcttctgaagaggttaagtgtttcgatgtgatctctgcaaattattgattctatgatgaggttacgtaaatatgaagtataatactatctagattccaattacactgtggagtatagtaaatgttctgattgcttttgtaggccatagtatatatattatattacatgctttttgccccttatttggttcccttccttcccggaaggctcctgtgagttgcttctttctagagttcaattaccatgttggcgctttatcttcaacaccatggacgaatttactatgccatgtcctaagaaggttatgcatgacaagaaggtatcttcaagtttatgaagataacacttttaaggtaatgccaattgttaaacatagacaacgtaagtaatctattttgtttccatttacttcaggtgccactcacaaattgttcaattataatgggggaattaggttttcttattgttattgggatcaatcagatatgtgttttctatagtttgctcatggctgtgtacactagcaaatttagattgtaaaattaatggacccatatttccagctacacttctagcctacatccttttagtattatgtgtcactccaggtttggtaagtgttcaaacctacctataatatcaatgtgaataaaaaatggaatatttcaacaggaagcatgcacttgctgaccatgggtccaaatccaacatttcatccttgaactgttcatttgaaagttaatgcaactttctattctggattagccttttgcctgaaccaatggttttaaacaatctggtgggattcagttggtctatgagttacttctatagtattgttgaggctaaaaattgactctgagttctggtgagttccaggttaatctatgttgtaaagattcaaagttggcatcccatatcacgtatcactgagatattatatttagtttggcgaaactatttcaatgattattatatgttgtcacatattgattgcacttttgtgcaaatggctgaaatgattctatattttttaatttcttcgtgattcatgctatatcattgcttcagaatttatgttgcacttcttgcaagatatctgaagtttatctcaaagttgataagttttgtactaattccaatattatgtttgtttctcttagggctagagaatatatatgcattttgtacttcaaagaaacctgggtagagtggcccatttatctgttgtctttccaaattgccattgtgtcaagaaagagaaacggacagtggtttggacatctctatatggtttagatatctcagcaatgttgtatcaaagtattgtgtttcttatatcttgggttatttgtttacttacatgttgtaaatgttaccttacggtaccaatagtttcgatagaatctctgtatcttatttcgttatcttttaatgtccacatgcagcgtagcgcgtgcctattgctagtttatttaatcgtaggcaaacgtgggtgggtgcatgcaactccgtcataaaaaaataacataaaatccaatttccgctggtggtgtgggtgttagggcaagtgatatggtagatgtgactaccccatctaaatttatccacatcattcactcataaattaagaggtaacctatacaatatgtcacctctagtaaacaaatatcaatgtctcttatactctcacacccctcttgaagtatggagtattatagcacttgcccttagagcaggtttaatagatcctaatcagccggcgctagcacactatgcgtcagccaaatctgacgtggaggagtgagaagggaagaaaaaggatggagcgggcattccatctatcgcccggctaaagcgcaacacacgagaaaaagctgttttcttccaaccagaagcgagaagatgaggtgtacatgtgaatattaaatatctaaatcttcaatagagataaacaaacagctaacctaacagctatcctattatattagtgatggctataggtgacatgatattagagtcggcagctggctatattattatacgttggtgtcggtttcctcctcgagcgccgcgtcgggttagcacctgacctgacctgactccggtagcggccgccaccacaccacaccacacccacccccacgtctttgaccgcgacgctgactggctcggcccagtcgcgcgcatgccgcaccctcactgcgcgtgggccaggttggtcggtgggtggcccacgttgcagtgaaggtaagagactctagttggtgggtgggtgggtgggtgggtgggtgcggtgcggtgcgggagatagtttaagccggtcaggtcatgacctgccccgggtcgcacctgggcggtcaaagcgcacgcgtttttctatttcttggacatgcggcgtgcgggtgccactgctcccttttccatagacacaagtcagacgatacgatagctgttcatcgccatcaaaattaattaagtgctgtgagcaagttttatgctgtgttttacactaattttttaacgtacagtcccttgcttattttatgtgcatgttttctgtactactaattaaatggtatttgttttttaaataaattataaaaaaattacttggaaaattatattaatttaaatttttaaatatttctaagctaatatttaataaatcatacggtaatccactgttccgtttcaggtgtaaggagaaaagttttcgaacacatcctaactgtaattaacacagccttaacctttgttaaatcaaaagttactacttctatttttcggttacttaattatattgattaattaacaatgcataacaaacaactccaacgatagttgttactgctagtgttgtgccaccaaaattttcacaaaatattatcgtatacaataagggctcttcatattatgagcaatgtttttctgatgggatagtgcttacattgcacccaattgttggtatctagattccagaacctgatagttcgaactgatagcaaacatttgttgatgcgtggaagcaaagggacaatcaacaccagaagtttgctgctagtcgatctcacattcccgtcgggagtgttctattcggttcggttgaatggtatatatggaatactaagagcaagttcaatagtatagcccactactagctccaattcatctatagccaattcatacaatagttacttactatactattaatatatggtctcacatgtcatacacacattgcgtcttggagtccgtactgtaactagctacagatctgtagcccgctgctcttctctctcatcttttatctcattaaaatatgtttatagttggctaatagtctgctattgtacctgctctactagatgattagaatacaaataaaagctaaaaatagatttaaaatactttacgaagcttagcataaataaatgggggatttagggacttgtcgattgcccaagatttattgtaagacgtattggtttattaacgacttaaaaagtaatttatgtgtaaaatttatccgtacttctttaaaaagcattactgccatcctaacatggtttttacaaaataacccttaatatttttctgatataatggaataaaatctatgacatattataatgctagctcaattctacccagcattccagcaaacaaaaattccaaacttaaattttttgtgtagtttaaccattgccaaacagtaccactcacatagtagttgttagggttgtattttgggtggtcccagtggcagtttctttattgacctaacggcagtcggtcacgcttaccgacggtcggtccggtgttaactttttcttgggtctgtggtttggtgttgtcggtgtgtgtgggtggtgcttattccttttgttttcctagttacgatgttccattgttgtaatcttataattttttctgctcattcaatataaacttcacactgtctggtgcgagtcggtaaaaaaaaatagtagttgtagggtgattaattaaagctcctaatctcttggagagaaatggtacatgtccctttcaagtatctgaattgctggtgacggcagagtgacaggtgcatcagtgcatcagtgatgttaactcgaggctgctaatactatcaatgcaaacctaaataattagggaccagtaattagttaagttaggtttacgctacctactactccagtagcttctgaaacgtacaccagcaagcaatgaattgaatgcatgcgtagccatccgatcgatgtatcatgtatccgacgcttcacggccacacaagagcgtgtgtggttcctgatgctgccggtacgcttggactatgtttttttttttagaaaaacatccctatgaacgcagagattgacgaagtcaccacaggcgtctcgctgtcgacgggtacgtcgcctaccactgaaagaataattagccgtaaatacgagcacccgtgtgggctggttccactacaaggaacctaaccagttgagctatactcactttgcacgtttgggctatgttaactcctgcaattaaattcattcaatccgacgtgagaacgacgcgcagctgctcgatcgattggcctaatccgatgtcgtggacaatatgctatccaaactaaaaagacgtgaatattagggaagatctaatattaaataattaaaaaaagatgaggctttaaactttagagcgtatagcccaccaccttgtgacgatctcaccaccttataaagctagccaaaagacccataggcgtttctcatgttatccaaaatctagtgatcaccggttaattatcggcttctctctaattataactgcgaaggattaagaatatgtgggacgatttgagaagaaaaaaaatccttaagcgcgataattaattagagaacctagctagcccaagctttaagcgcccgatatataaaatttttttatatatggagcgcccgattaaccggtgatttttaaagatcgcaccgttgaagagcctgggaattaagcgcgcatatttattcaattattttagaaaagaacataccctggtattccctctgttttttttatgacgttggttagttcaaccacatatatttagggaagttggtagcatacgtttagttgatctgcgtgtagtataatactgttgggttaaagcaagtttaatataatatagaaaagaactattagctattaacatatatagtattagattaatatgtataacagattagcttcaagactgtctttaattttttttactcctctctcttttaatctcacctatacatttaatgtattttatcgagtatgtgaagaactagctctcacatgaaaggcggcacttattttttttaattctctcatatttatatatactccctccgtctctaaatatttgatgttgttgacttttctaaatatgtttaacagttcgtcttattaaaaaaaacttttgtgaaatatataaaactatatgtatacataaaaatatatttaacaatgaatcaaatgataggaaaagaattaataattacttaattttttaaaataagacgaacagtaaaacatgtttagaagggccaactacgtcaaatattatttaggaacggagtgattaggcctggtttagttcccaactttttcttcaaatttttaacttttccatcatattaaaactttcatacacacataaacttctaacttttccatcacatcattccaatttcaaccaaacttataattttaacgtgaactaaatacacccttagtttattttattgctcatagcaactttacgtgcatctggaccaaccgatcatgcgacgggattctatctatgtaaatggacatatcacatgtctttggttgtacttgcgttgctttagtattaaatcgatcgatctgtgtaccgccggcggtgagcggcctcgttccggtggacgccgacaacttttccggtgagcgcacgcaaaaaaggcacggctttttccggcgggcggcactgctggttgttggtgtacgctcgatatatactttggatccaacagttttcagctgccgattgtatactactagaaagaagcagcagggtacgtacactgccggtgctgatgctgaggtatctatgtgcgctgccgggttgtgtgtgtctgttatgtttaggtggacaagaaggaattagtgcggtattttgaaagaattttacgggaatttgaactgattttaagaaaatcatgtgaagttccgtagtacgatcggaaggagattagaacaaggaacaagtccatgtttccaaaattccgattttggtttaaattttttttttcaagattgaagaatgcatagttggcgctttggaccgtggagcaggcagggcggccaaattgtacggtgtccgtttcgtaatttcattcccttgcggaataagttcacataccgttctttaactttacatcgagtctgtctaagttccctactatctaataccagaaatcttcacctctaaactatacaaaaccatgcaatttcggtctcatggcagtatgatccatggtttcgctgacatggcattctagttagcaaaataaaaaataaacagttatgggacccacatgtaagtgagaatagaaaaattataaggcccgcatatcttctttttctcttttcttttcctcttttctcttctcttcatcggcggcagagagggaggaggtggccgccacacctgatgacgacgatgcacacgtgagcggcaggcaagcgcggcagccaccggccgaccaaccgcgtggtgaagttgtcaaagcgagcggcctctcgagcgaaaggatccgttggcgtacgagagctggtggtgcatgtcatcgatggctgcggcggagtgcgaggacgagtcgccggagtcggctatggtggcgagtggcgacgttggcagtggtccaaccgttgggcacagtggcgtggagcatgcacaagagcggctcatactggttcaacagcagccggccggcatcctctccccctctccagcgggacggtctaggctggcggcggcgagcggagaagctcgttggcgatggcctcctcgagccagccctcggcagcgccaagcaagctcgccggccgaaaatggtgttccccctcctccaccaccgctccgcctgccgcacccccgccactcccccctctcccgccggcacgatgtgtggaatgggcgggagatggaggaggggaaaggcggccggctactgctgctgctgccgcgctcgatcacccgcagcggcgccgagaacgacgccctcaacctcctcgatgtgcaccatggaagaaatatagaaaagagaagaaagaaaggctgacatgtgggtcccatatttttttaaaaaaaatgctgactaggataccacgtcagcgaaactatgtatctatactgttgtagtgctgtggaatctaaattgcactgttttgtatagtttaggggtgaagatttttagaattgggatttagggatgtcaaacaaactcgtcgtcaagttgagggacggcgggtgtgaacttattcctttccttgcttgcatctcatgggccgaaacctacaaagtccaaattatgaccctccttttctctatctatctctctctctctctctccttttccacggttcccgctgcatggaatcaattggtgacccaatattacaattttacaagttattttgagaaaataagatggtgaaaaatgaagttatttttgggattttttttctaaaaaaaatacgtacatgaaatgtctcattctattcatgcatggagccaggttgtgtcagaatcagggttcaaagtttcagactgaaactgagatttctctaagttttgagtctacatgaacatccccttctcccagatacgaaatgaatttggccatttttttaattcttttttcatttttatgagtttggtaaaattgttccaattttttgaaaattcaaaaatatttcgaaaccaaaattaccaaaatcttagcactatcggtacaatcttctaccctataattcaccaacaacagtcctacattctacatacttcacacttcattgatcggtcaggattgtttcactcaaatccaacgtcccatatcactcccacttctcctctcgcactatctccacaagatggtgtgaacttgtacttggatatgtttttgttgttgttcatgtgcaggcgttgcttgaggccacggagagtattgaccgtgatgaatctcatgcgcagtttcaatgcgcagtttcaagatgcaaaatttgatcaaattccaaagagaagtaaaaggtgactctaatactgattgtaggatcatatttagaagggtaagtgacctatttatataagtgggggctatcattttttggatgcttttgggatgagaaagttatccaatcgatcttgagtagccactggacgtggctgtgatactaattgtataatcgtaaatgacatttcatcctaaaagttatccaacgagataaggaccccacttatatattaggtcccttgtcttttcacaatcaatatgggactatttgatataattatcttcatttcaatgtccattattttaactttgtttcgatgtgttggtgtccataccttggagcaacacaagagtggaagaggcatcacttgcatgtttggccacgatagttcattcacattcacatttctcttgctcatactctattctatccatcacactctattctgtccatttattagtgttgatgatgttgatggatcttaatttgatcaggttaccgaggtgagcagatagaactaccctcctcttaaggccattcccaactcatgacactggatatagtttccataaactccacatcaccaagaaactagtactaaacaccactcttctaatgcaaacaccactattccatacttaaatttaatgctacttatctcacatgatgtcttggatattgtgtagaaaccatgtcttatgtaagacatggtttctttctctttccttatttattcacttgccacatcacttttcatcctatgtggcagcttatttaatgcaatgggcaccatcctagtcattgggttgggaatggcctaattattatgcactttgtgttgtttaatatttaacacggttaacttttagacgtaagtttgactattgatattattaaaaaaaaatcatataattataatatattttgttatgaattgttttatcatcataagtatatttgcataaatttttgaataaaacaaatgatctaaaaatcaatggtgttgatcattagaaagggggcaaagtattttcctttcaataatttattacagtcccttttatcgatctgttggatctgttgttttctaacatttcactctttttctttgtgtgttagtacatattgcatcaccctaactatttttgagcgttacactagtttagagtgatgtttcacgctgctagtgatgtttcacgctgctaaaaatgttacaccaaacatttaataaaacatttcattgttatattgtttaaagtaatgtttcactttttctccactaacatcaggtatataatgaaatattttgaccatgtaaaaaatatttgaccatccaataaaatgactgaggctagatgtccaatccatatctttgtcatgtactattttctgtgttttttcgattacatggcagacatattcttttcaagtgttgcacatagtttacagtgatgtttcacgctactagaaatgttgcaacaaacattcagtgaaatatttgatgccattgacttttttaaatatatttgactgttcgtcttatttaaaaaatttaagtaattattatttttcctatcatttgattcattgttaaatatacttttacgtatacatagttttacatatttcacacaagtttttaaataaaacgaacggtcaaacatgtttaaaacaattcaacggtgtcaaatatttagagacgaagggagtatattgtttaaattaatgtttcactacatcatgcatccaatgaaatattttgaccatataataaaatatttgaccgtccaataaaatgacttagattagatgcccaatccatatctatccactctactattttctctcttttttttgtcattacaagacagacacgcatacgtacacaactgtatacgcaacatcatactccaccctcataaacgtgcccctaaatcatgttgtaagagacagaaaccaacggcacataactaatctcactaaatatcttttgaaagctcacatgcatgtgtataatatttgtgaatgctagaattttgaaccctggtgggtggagtcatacatccacgacttcaccaccacaccggtggtgttttccgcctactattttcctatttggctagcatgcattaataaattgtttttgccaaaactgtaatgaactttattgtttgctactgaataatgtcatttcacagcggacaatcaatcagagatgtcgaaagaagcaaagtagtaggaaccaaaacaccaactataaataactagatgtctttctagcttggagcggccacaaccatggaatgtgaagactttcgttgcctttttcgtacttgtgtaagtgtggctctaattttactggttaactagtacttcttccgtttcatattataagtcatttaatttttttcctaattactcaaatgacttataatataaaatggagggagtattatattagtcaagtttgcctagaaaataagacaaattaagtttgacgaccttggcacaccaaccaaacggatattgaattccagcattttaaccaatttattgtaaagtatttggattgttgcaacatgtgaaggcaaatccgaagggaatactagttctgaaggcaacacttccattaattttctatgtacaatgtacacattacaggggaggggaacatacatgcatggtgcctagtaatagaagtggcctgctccaatcatttccacggtaagtctatctttgttttgaacaacgatatgtgccgttgaaacgttctcccccagacattttgctccccgcattggggtttaaacactgatattttcatgctgtacatagcatgcaaataacttagttgctgttattattatagcacttcctccgtttcacaatgtaagtcattttaatattttccacattcatattgatgctaatgaatctaaatagatatatatgtctagattcattagcatcaatatgaatgtgaaaaatgctagaataacttgcattgtgaaacggagggagtataaggtaataatattcttaataagagcgacttgatatcaatcctgtcctagtaatcatcaaatcctattataacaactctttaactttcacacactttctaacagttcaaaattaacccaaaatgaatagtcacaagggattcttttggttcaattttcttttttcagtgtgcggtacacgcatacgcgcacacataccactgtacacacaacactacactcacaccctcacgagtcacgaatgtgtcccgtaacatatgcaaaactattaaaaatagaagtccaaatcacaaggtcaccaactaacatgatagtaaaatgccacaagtgtcacatttatactgaaatatggtactacttatgtcccctacaggttagccatatcctggttataagctaatgctgaaaaaaaatcactttctatgaaaacactttaaaattaagtttaaaaatttaaatgttgtatcaaccttttttttatctttgatttgagacgctctccattatccttttgtccttcgcgtcgccgttcgtttggaaatggttggtacctgcatctatctgtacagaattgatggagaaaaggaggacactgtaaataattgtggtgatctgatctccattaacgtcctctcaacataatttccatgtagaacttgcaaaagcatctatgtaccttgttgattgttatccctttttggttcacatcacccacccaaaattttctccaggaacccttttttcatcctgaaatgacctccacttgcgttttctgttttccaacagtcactcgcaaaatttcgcagcacgcttagatgtaacacctgtcggttgtgtttttccctttattttgtcatacgaattaaaatgccttagttgtaaaaagtagatgaaccggtgttgaaactgtttttaattatgaaaactagcggatttcccctttcgcggagctagattttaattgatatacaactcgtggcttcatatcatatatttaaaaatagatttcaatttaatacacaacttttattttctgttttcaatcgagtctacgccgttataatttggatgcactatgatcaaagtttttattttctttcctctgattaatgtgttgtaatttctaggactagaaagagatagtgatgactgatgaccccttgcctcttttgatagtaacataaataatgtgctgctcccccggccgtttcacgttttatattattattcgttttgatttttaaaaatcaaatttcttcaaaatttgataagtttataaaaaatagcaatatttatatcacctaattagttttattaaatctaacattaaatatattttgatattttgatagtttctttgttttatgttaaaagtattattatattttttttctataaatttgatagagctataaaagtttgacttaaaagaaattcaaagtaattaataatatgaaatggaggtaatacctatcagacatttatgtttttgttacagggaagaattaagttgaatagataattatgcgcaccatagttcatgtcaacctcatgaatcttaacaaggaaaaaacagtgagccatccaatggccataagaggtttctctcaacaattattgtcaacaagtacatataaaccatccgcatcctggcccccaggagaaccaaatgctaccacatctagaaaaacacatgaccaaacttgtttagaaatgctctgcgtggctcacgactacaacaacaggtctgtttggggggagcttaagattttgagatagagctgattggtagccagcttctgagaatctaaaaaaactgggttttccagcttctgtcttttagtttattttctggattctacaattacagcttctaggaatctggatataaagctggactgtttgggggagcttctgattttgggagaaacggctatagctagaagctccccgaaacaggcccaacatctacagcccatcctgttgctgcaaggacctcgccaagccatcatcaatcaataatccaaggcatccatttgctcatccaatggtcgagggaaaaaaacaaaatataacttagagataaaaaaatacaaatatttttttaaaaaataaactttgcttatgcatcatggcacagtacagaacatcaaaattcatcggctggctgccaacatcctccatccgattggctgtctgtcctagcatagggcctgtttggggagtttctagcagctgcagcttctcctagaatctgtagttaccagaagttcccccaaacagttcagttttttatccagattctgagaatatatagttgtagaatctggaaaatgtactagaagccagaaactgggtttccagcttctccagattctcagctgttagcttttcagcggctgcttttaagaatattaagctcccttaaacaggtccataaactggtaacgaaatcaccttatctccattttgcttaattttaaggaggatggatgatggcgccaggtttaggggcttgtcggatggcggcaagtccagtcacgagccaaccacgattcggccacgggggagccgggcccacctgacagcgacaggaatataccacgcgtgttgctcccccgttggctgcagggagcacgcctgcgcggtgggccccggagcacagcggcgctgacgtgtctccggctgtggagcgcgtacggcgcgggcccaccccaaggtcggatcagcttggctgcgttcggaacttcggatctccatttgcagcttgtttggaaaggcgaggaggggattggtaagttaagagccaaaattaatggtgagattaagatagaaatttgatttttaatcttaatatcttgtttggtagagaatgtggtatttgacagaaagtttagttggagattaggtcattaatgaaaatgaatggttgagatttgtttaggtaaaggaagaatttcctcccaattaccacacccctactcagatattgaaaatgagggagttcattactcaaaacagttaatagactcatccctctaaactcctaatcccttctaaaaactctccccaaccaaacaggccgttgggtttagctaatgtctcattactcgtgagtactgatgggatacgcgtaggctacgatagcataaatcaaaattttctatcgcgtgaaccaggaaccatgcaagtattagatcatagatcgttaccattcgacgtgctgcgcagcggaaaaagacgctgagaagtcaaaggaactctcgcgaagtagcgcgcgtcaatgtagacgaagtagtcgatcgcaccggctcgaccttctcctcctcgtgcgttctcctcgccgtactcccacgtcgatcagcaccgcaaaccagcgacacctctaccggtatccacacgtacagggacggaacaccacgcacatatgtgctagcacccgtgcgcggctagggttttgctcggggagggaagtgacggctagggtttctcacgtgatgcaatgcctccgccggtcacacccctcacgaatatataggatccatcactcgggcttccaaggcccgtagaactcttattcagatccctatccgaagtaagctcatattggatctccatccaatccccttattacggtccattaagcgtgcgaccctataggttcatatatactcggctgtaacccaaaaactcattttcggtccacgcgtcaacagcggcccctagcagaacgtattgacccaccgggcatacataaagatcatatcggctgaacctctagtgtatacttgtatgaacccctttgcctcacgatatcgattaagctcaaggctagatatgtgccatcctctattagctcaatcattcactcgaacctgttgatagattatataacttgtgattgactcctcaatcacctttggcatggccatgtacttccataatctacaacatcgaggggcccagagatatctctccataggaggggcaaattctatcttaattattcatatcccactacatatttcatagcatacccgaaaactacttttataactaaccaattatggagtagcatttagcagtccctaagtaagctactacatatgttgggaaccatgataatctcaggtctaaggattcaacaccaatactaaatgagatcactgacactacaaaataattgagctattgccaccaaattattacaacaaaaaataattcgtagcaatatattgtactattgcaatgataacttttctgtggcaaataattatattttattgcaatgatctacaatcgttgttttatttagtacttttgttgtaatagaaaatgagatatcgccacaaaaagtcgtactgttgtaaaaacatgttctctcaccacaattttaatttttgtggcaatttacatagtacatgtacttttcactattttttgttgccacaatcaacaaattcgttgcaataaaaaaattgtcgtctcataatttaatttatttttttatatggacatggattgagacaaattttatatggaaattatagctctcgacgagatctacaattttataggtgataaatttttcatttgaaatcttttagatattcaaatctatgattcaaatcttagttaggtaggcttaaatggaatgatatgtattttccaacagaattgatgtgtaggtgagttggtaaaggagagcacgcgtggaggataggtcttgggttcgaatcctagccaagacacgatatcaaaaaaaataaatagacaaatagataggatgatagattaatatttaaacttttaatttagtatgtaaaactactattaggtatgtggtatccataaccctgacagtagcccccgacttcgatacaaatgaacgaattcatattctcaaccgcgtgcagaccttggagtaactgttatcgagctcatgtgaccgttctcggtgagttcagagataacgttagacttcccttatcagtctcaagcgggcacctatagtgtttgtctgagtcaatctccgacgtcaaccaagaaattacagagcatacgactaagtctcccgtcttgctgtaatcgagaatttgaattgaagtcaagaaattttatctcggcgcgtacaccatctcttcattccgtattccttgtcgagatccaccaaccgttctcgagtgaccgagaaggcgcagagcctgcgacgaagccttgtcaacatttgttgtactcgccttagtcgatcttggtgtagaaccatagagacatggcccaccacataccatgtcctatacgaaaacaacctgcggatatagaaagagttccggataaggaaagacaaccagagttctgcatgaaaacgacaaggactactcggattgtatccatattggtttccctagttctacttggacaaggggacatctatgggtacaaataaaaggccccctaggaatagaattttcctgaaatcaatactcagaaaagaatcctatcttactataaagttatcccccactaactccttaagcttaacatgcaaagatgccacatcatcatccactaacaatcatcacatttaaacatcatgcaaacatgctatatctttatagtttttataatttaagagcttttcgaatacaaacatgttaaattatcatctaacataattcacataatgtttcaatgcatatttttattatattttatgatatcctatatagttcatcctcacttaattagtgcttaaatgattaatctatggtccaaattatctttctccttttttcctataattaagtcatatcacatcaattgtttttagcctttagatgattaatctatggtaccaactagtatctctctacttttcttcttccataaagttatatcaccttactttttacgtttgaatcaccattctacatactatttaaatttaaattatcataaaccacattaatttacttaatctgatgttatctagctatcttacacgttatttttttattgttatcatactaaattcccgcagcaatgcgtggggtttcacctagtattagatagaaatagcccccgagcgaatgctcaaagggtaacatgttataatatgtatggaaaactgaaaatgaattaaatttacagaccaatgttttatatatgagcatctactcttttaccgacttcgatcagtcagtttgttgaatcatacactctccctagctcctagccttgtcgtcggagaatcgttcttggatgataaggctcttggaccctttacctgccttggttgaaaaagcactgatcctagcccccagccatgaagttggaaaactcaatttccgattacacggcttggttaatacgcacggcgagaactcttacatgatcaggtcttacatggtcgtttgtctctacatgatccgacaaggccttatccgctctgggcgtccccagccgaagttcccttaggttcctcagaggccttgtcaggacggcgtaaagggacatgaggataggtttcaactctaggtgtcgtcgtggtaagggatctctgggtaaaacacttggcgatattatgtacctgatatcaactttgttggagtagaggtaatgagagaatcgctacgccactggtcgaaaaccagttgtagccccaactcgaccacttgaagcaaaggtagtgggagaatcgctacaccactggtcgaggaccaggtagtagtcgtaactcgaccacttaaagtgaaaatagcgggagaatcgttacacctctggtcgaggaccaggtagtagccgtaactcgaccagttaaagtggaaatagtgggagaatcgctacacctctggtcaaggaccaggtagtagtcgtaactcgaccacttgaagtagaaatagtgggagaatcgctacacctctggtcgaggaccaggtagtagtcttaactcgaccacgagaagtaaagccactgggagtattgctacactactggtcgaaaaccaggtgtagccttaactcgaccactagaagtagaggtgcgagagatcgctacgtcctactggtttgagaaccaggagtaggagcctcttaatcacctataggggtgctaaatttggtttgttacatgtgcatctcatgtagccagcatgactcatatacccaacttatagcatatccggatgtccgctcgcaatcatgtcgggtgatcaagccgacaacgttcacgagaatttattcgttaacaaccttttctcgaatagcccagccttggtcggcgctatgagataggtcgtcggtcttcgttggtaggttgggtgcgacaactccgtatttgtcgagaacgttctcgataatggggtgtgcttgaccacaacctactcaagtgctcaattgtttctgaaaaatattttctagaaggcaagatatatagcagagaatatcgagtatgtactcaaaaaactgcatagatcttctagtattatcaggacataacgagcagatgtaaatatcagggattatgtaaatcgtaaacaagcatgatttatactgaagaaaatagaacgagcccccagcgttaaaccgtagtcaatttaacatccgaaacactcacacaatagatattgtataaaaaaacatgctctaggtgaccataataaattatagatctgacgacgatggttctgatcttgtcggggcacgtactctggtcatgtcggatctccctggttcgaagtcgtcgagtagcttgttgttggagaatccgtctcttaaacccatctcgtcgaaactttgaagcaccaaaagatcccctacctggcgcaccactgtcgatgtttgatgtcgcgattccggtatttgtatggtatggggatcgttggtactatgatatatgcgagattgaggtaaaagagatggaggcgaggatttttatacaggttcgagcccctgaattgtcaggttataaccctacatcatgttggccgaagccggtattgctcttattcaccataatcacaccagtacaatatttggggtagcctatctaactgttgtcgacatggcggtctgaagttctaactcgtagtcgacaacatggtagtcttcctcttcgagtttgtgctcggcgagatcagagacagcgctagatccctacggccggcctctgtaggtaccggatagggtcgatctaggcatatctctgatgtcgatatccggcggcttgtcttgacgtatgttggcttgtatgttgtggcttctgttgttccgtgtcctctatggtgggtgtgtcccctctcctcctagggggccttgtatttatacccataggtgtccccttgtccaagtagaactagggaaaccaatatggatacaatccgagtagtccttgtcgtttccatgtagaactctggttgtctttccttatccggaacttcttctatatccgcaggttgtttccgtataggacaaggtatgtggtgggtcctgccgagatttagtcaactactattagttatgtggtatctataaccctgacacatactttttttttacgttggcccacacttcgtagacataggtaatttatttttgtgacaaggaaaaactactactccctccattccataatatttttttttcatccatcccaaactaatacaaaacaaaaatactacaacatccatactttatcaaattccaatataactattccccccttatctactttcaatattaagtaaacttattttaagaaaaataaaatgagttaaaaataaacatattatgaaaccgatggagtaacaagtaaccaacagtcgaacacttcaattcttcctttcttagggcatttacagtgtgtcactctcgtatgaggagcctcagtgtgtcacgtaggctagagctacgagtcctaaatttgaattcttcacactacaagtggctctgcgagtggctttaattttgtatttcagcccctagtaccttttgtttcagttctcatattttctttaatttgtggagatccaaaatttacacttaacacccttaaatccagaaaagaatataaaatcccccatttcccctctttcccttatcctcacgcccactacctctcttcccctcaatccggcgccgcgagcggtgcctctcctccccttccctggccgatgccctcgagcggcgcctctcctcctcttccctggccgacgcctctcctccccttccccggccggcgccagtccccactccccacgtcggcggcggcggtgtccatggagtggcctcgcgcggcgggcgcggatcaagcctagcacggccggtgagctcccagcggcgcggattgaggcgggcctcatcggcgggaaaggaccgaggctaggcgcgaccggcgagctagctgagaccggcctccccaacgcctccgccggcttttccttcccctccccatcgccgctgccttaccctccccctccggcgacgaccacgaggcaggcattggagcttcgacgacgactagatcgggggcgccagcgtgcctcggctgtcctgtcctcgttgcgagcgtcctctgctgggagcctctagatcaaggcggcggagaagagggagacggcgacgaggtggatggcgagcagcgaggatggcgacgagccccgcggtggcgcagagctgagtgtcgcgatcttcttggcagcgcggagaggaggatgacggctagctccttgccacaggctacgacgggcttcctctccgaccgctgatgagctcccttccctccatctcccttctccctctctctgtttccaggcgacgtgggcaaagacgatgcgaagcgaagccacgccctccacaacgcatctccttccttctctccccacactgccaaccctcgaacatgccgaagaacagagtgaccatctttggtcatgcggtcctcaattttgtgggcccacctgcaaacgtggcatcgaattgcatatgaacaccgacgtggatagttcaggctgaacgacagcgggatgcactgtgaacgcccttacctctgcatgaggcagagagagagggagtggatgtgtggtcaacaggaggtagaactcatgatgctctctttcttccctttcaacctctgggaaaggagcaccggcttctgcagcatctagtaggtataattactgtcttactggaaggctgcaaaagaagaggttttggacatttgggtcctggtcaagtttagactttgcgaaacctgacaaaacaaacagacctcttactctgtactgtactggagtacgtatgccaccgcccaactactgcatccctgcgactgcgaacagcaggacgaagaatgcaatcatttctagcgaggcaggcgtctttctgtccgctcaggagagaacacgaggaacaaatacatgctcttcctcctcacagaagtttgaatttctccctgttttcttcttcatccaaagtgttctctgtctgtggccgtattaggtccacagccaattttttttaaaattatatggatacatacttaaagtattaaacatagactaataacaaaataaattatagattccgcatataaactgtgagacgaatttattaagcttaattaatccatcattaccaaatgtttactgtagcaccacattgtttgaaagttcacattgaagtttggaagtttgattgaaattagtacgatatgatatgatagaaaagttgtgtgtatgaaaggtttgatgtgatagaaagttggaagtttggaaaaaaactttggaactaaacatggcctaaatcatgacataattgggctcaaaagattcgtctcgcaatttacatgcaaactgtgcaattggttttttttcgtccacatttaatgctctatgcatgtgtccaaacatttgatgtgacgaaatttttggaagtttgaaggggaactaaacgcagcctgtggtcatctatgaaaaaaaatagataaggctactctgaggataaaatgatctggatttggctgcgggagctatcggagacgacgaagagagatgatgctagggtacttgcttgacggggttcacaaatttgtcgaaatgggttcaaatcttgtgaaattcgaccctctcgacatgggccagaattagatatgccttcagaatttcaaacggtttcaaaaggttcaaatttggattgggaatttactaaaaggtcacttttttcgctatcacggttggggttaaaaaaaaagctaaacaaccaaagagtaatgaagaaaaaattggaaaagaattaaatatgggcctcacggttgaaaccactccttttaccacttcactgtcaagtgcatatcggaaagttaaattacactgttatattggttctaactaaatcttctaagaaagatatcacgtgattatattttctataaaaaaaaggaattatatgttgcagtccattcatctcttttgttgcttatttgagtgtttcactctttttcattgggatgttgcacatgatgtacaagacattttcttggacatagaagggtcgtgatgttgcaatcaattttttttcaatattgcatctgattaaaataattttcaccaagtgatggaacatttttttattgagcaatgaaatatctaaaaccttttttgctcaaacaaatttactaagcggtaaatatctgaaaacatttttcatatataaggtgaaacaccatttgggttttgactgggatcggacgtttgatccttagtcgctctcttattcagggccaaatgtgtgcatacatcttcgaacaatcctagccctcaaaagtgatagtcgattgacaattgaaatactccctccgtcccaaaataagtgcagttgtggatttccgtgtccagcgtttgaccatccgtcttatttgattttttttatataattagtatctttgttgtaattagatgataaaacatgaataatattttatgcatgacttatttttattattttttaataaaatttcaaataaaacggatggtcaagcgttgaacacataaactcacaaccacacttaaaatgggacaaatggaattttttaagaaaactttcagacatcttgttaaatctgggtggggcgcattttccttaaatgaatacttctatccattctccagcaaatgcagcacccaccacagtagacgtcacttggcctcaaagtgatgtccagttcaggcagctactagcaaggttaatttcagacaattcatcacgtttgataaactgtacaaggtagtagtagtagtatatatcatcatcatgatccatgttatccatgtcttgattcaatgcttgttcttgacagtcaccagtcaccacttaccactacacacactaaccgcccatgagcaatgcctgatgattccataaaaaagtcaagagcaaccaaataagcatgcagccaagccatacatacatccactattgcccatgcaacttttttgctagagatttgcatgacatcacaatgcatcttccccatatggacatctattattatatatttccatctattactaattcccccgtttcaagatgtatgacgtcgttgatttttcacataatatttatcaatttgttttattcaaaaatttagtataaatatgtaaagagtgtaaaagtataagttaaggttatattttatttgatgataaaacaagtcataatgaaataaaaaatatttatataagtttttttttaataagatgaataatcaaatgttatgtgaaaagtcaacgacgctatatatttttaaatggatggagtaatttagttgcatatctataggtatagcaagatgcaggcatgttttccctgaggttggagacagattaattaaataaactaacaaagtgacatacatacatgtaaagttgtcatgctagtgctgagcttatcttatcccatccaagcttgcatttttattaattagtgttaaaccctacttgcatatatgcgtgcgtgcttccctctcaaatgtcactagatgactctctctcaacgcaatcctggttctggcgacaagtcctcttcacagccttctctgcttagatatgaaacgagctttttaactctatatagtacacatatataaatcaacaacttatctatagcaagtaggtcggtccaaatttatggatttaagctcctcctctgcatgctctgaagaatataatctcttttttttccattttgcactaagagtataaacacatttttataagctcctcattttttttttgccaaagtcatatctcacaaatgcaaaatcgagtttttttttcctaatgtactctaggatgaatgtgagtcctctattactcttgatctaacagaatactacaagattttctggattaaaattgaaattgaaaatgtgtagcgttaaggaaaattcacatgttcaatagatgacagtggaaattactctaattgaagtctcaaataaagcatttttaaatagctctgtagatgaaaggtatttgttgttttaaacggaaccgtaggagaagaaaattatatttcaattaagcggaaataaaaacccaaatggggttacatgaaaaagaaaagcatctcctcaaatagaagagactcgcaaaacacctcaagaaaaagaatcgtggcctttacagcatacggaacaactaaacaacccttaaccctagctaaactaacaactaaataactacggaacccaatgtaaggatcaacatcaaacttgtcgtaaagagtacaacacaacagctccaactttgcaaacatgtgtcattgttgctgagcttgccacctaacgacacaacagctttgactctacagtgatcgtgtcatcgttgccagaggcattgtcaaaacgaataaacaccaccgatttcccaccatggacataagcctaagccaacaagtgccacttcctatacatggttagcaccagcacccttagaaagagagaataatatgttatcattgccaagcttcaacacaccctcaacaacaaagcaactccgactccacctagcagaaacaaactaagaaagctggttctacaccataaacaagaatggaacaaagatggcaaaggcttcaccaaacatcccaggcttgtagagctttagagtcgatgcaggggtccacgaacgaccttcgctataagggtaagcttctccaaagcagtgtccccacggaggacatgatgtgaaacacgaccaccactcgtccagaagccgaaacaaggttttcacctgaagatggtagggatggggaaatgttataacaacgcctccaagaacggtaataacgcctcaggtgtcaccatcgtcaagctggcccaatggcctgacaaggctttcgccaacagttccccattcaacaccatgaaaccaacccgtacaacgacgcttgctagaacaccgcaccatcccttcagcaaccaagcccaggccatcaccccatgctcaggcgtgctcacacaagactgctatcccacagtgggtttcccaaccaaaaagccacaaatattaatttcctctcctacccctgccggcaacgcgtctctctgctccctctctcttgtcgccgctctctctgctctctccctctctctcagcaaagcggacggcgagccacgcgggtcgcggcggcggacggccctgccccaccccgctgccggcatcgaagcggcggcatcgacggggcacggggcgagatctgggtgcgcgtcgccacccctctccctttgcccgtcgccaacctccccgccgccgcccgtcgcaccgttgccgtcgccgtggtgtccagatctggtcggccgcgccgtcgccgtcgtgggtggatctgggcgcggatccggggctagatccgcgccgcatcgagacggacgtggcgccggcggagatcagggaggacgacgactcttccacctcgccggtgtcggatccgctctttccccctctcttccccgccgccgctcgtcgccgtccacctcgtcggcgcggcctccagctcctccaccacctcgagctctagccaagggtgttacgggaaatacgggtgtggggaacagtgtccacaagctacggtgtgctcaacgcggctcctcgcttcgtttctctgtcaaaagtcatcgaggggcacgtccccctggagaaaacacgcgcctctccaggggcacacggcacggacgggcaaagtaacggcggtaagcaggtacacgggttgagggtactcattaaacatggcttcagaaagacaacggctccctagtgcagtgctgctcccgccagtaatgttgttgctcctctgtctctccagagtccagaccctactcctacttcaaggacctgaacttccttttcactgtatcgtagcgccgtgccaacatagctatactcgatagcaagacagaaaattcgtctgtacacttgaaaaattgttcatgagagagagagagacgagagcttgctgtgcaagaatcttgaacaaatcgctgaattcaggagtactaggagtagtacagtactagagtggtagagaagagagagagagagagagagctgggttggagtggagaccaggaatggaggaagtagaaaggtgtcagtgctgctgctttgcctgcaaaatccccttccttccaaagctccccccctgcccttttcggtctctgcctgccctgcttcttgcccaccaccacctgtgtcctcttcctctcctctccttgcattgcagccttctccttgcttcactgcctccctcacctcctatatatccttcccccttgcctcctccacccacccacacttcacacttcttgtttgatcaatcacagagacagagagagagagatggcttggaatggcaggtttggagaggatggagaggaagagaggagccttgagctcagccttgccctccctggatacttctccagctcaggtcaccacctcccttgctctcttcttgattcatcttgccctcaaagtttcctgctttgtttgatcatatctgtgtgttttgtcctatgctttacatttctggtggattttcatttctcaggtttgcaggggaacacgagcactgctgctgatggagccaagggaaacgatgggttcaaggcaaggtgatgaaaattttctggttttttttttgggagcagtctgtttgctcgcaacaacatttttctgacgaatctgcagcaaaaagatgctaaaatttgcccctaaattctctgcgattcgcagcaggccggcggctccggtggtcgggtggccgccggtgcggtcgttccggcggaacctcgcctcgtcgtcgtcgtcgtcgaagccgccgcgtggaggccgagacgccgccgccgccgccacgggaggcaaggtggcccggttcgtcaaggtgaacatggacggcgtcccgatcggccggaaggtcgacctggcggcgcacggcggctacggcgagctctccgccgccgtcgaccgtctcttccgcggcctcctcgccggtaaaccccaccacctcgacattatatatcatcggagttttctatctcgagctttctcttgatggtgtttgctcgcttgcttgctcgcgttggcagctcaaagggacccaaccatggccaccgccgccgccgccgccgctgccggcgagagctgcacaggagaggaggaggcgatcgccgggctcctcgacggcggcagcggcgagtacacgctcgtctacgaggacgacgagggcgaccagatgctcgtcggcgacgtgccatggaagtgagtccgacacacacacacaccatgaatgaatctctcgtcttctccaaagctaatggcgacgaattcttgattgattgcagcatgttcatcgccgcggcgaggaggctgcgcgtgctcaggagctccgacctgaacgcctccacggtcagcgaaatttctggttttctgctcctttttcttgagaaatttgatcgattctgacccgtgatttttgttcttgatcttgtttttgcagatacgagcagggagcaggaagagggcagctgccgagtgatcttgatcttgtttttttcatcgccgggagcagagcaggaagcatatctgcatagtgattatgatagctctctgttttgtttttaatccttttctcttcgcgttcttggaagatttttgtgtacaaaaatgcgcaagaagcgtctttttttggggatcatgatgttgtcgactacgactaggacaagatgtaatcgagaatggaaattgttagtactattaattaggatcaagttcatctgttcttgcaagctactaatcctggacatgctgagtgatgtgtctttgtcagtgtcgccggttgatgttttatcttgcgattctcgtgaagcatctgcacatctttcgcaatcgtcgattcaggtttcggagagcaagaaacgcacgttgattttgggagtgtttgtagttattcgtccgagcggtcaggcctatgtgtgttcatctgagtttggctcggttcagacttcagagtagattcagtattcagttacacttggtttagaacggaaatggtttcaaatcttggttttttccgctaaacggtaatatcttttacaaaaattttatattaaaaaattgcttaaaaatcatattaatctatttttagtttttttagctaatacttaattaatcatgtactaacctactatattgtttttcgtgtgtaggaattaattcccaacacagcctaggatttcttctgagcttttagaagatggtgaaaagaacaaaatgaatatttttcagaaaaatgttttaactgctatcagctgaaagcctgaaactctcatgttatctccctctgaagttatctgtggtattgttcggttgttcgagaagatatcttcaaaattatactcctactcactatattttgttgtctaaatagtcctagagcaattataatattctggttttatttttaacgatgattgcttatctagagaagaataaatagccttttacggtccttgttagtactagtattaggctattgggaccacctatacatttgtcgacaaattttctcctaaaaatttgataaatgtaattataatacaatcgtagtgtaattacaatgtaacttaaatgtaattacagtgtaacttacatgtaactacagtgtaacttgtatataagtttcacgtaattttgaatcgttaaatctattacaagatttgttttggtgaggaagaaaaaaaaatcacagcacacacatatgtgtaaggatttgttcccacaacctccattttacccaaataacatattacagagatatttttgagagttacatacaagttacactatagttacatatagttacagtgtaattacatgaaagttacagtgtaattacattacgattgtactgtaattacatctgtcaaatttttgggagaaaatttgtcgacaaatatatagcaaaatcgttttcggtttgctgtaaaatttacaaaaataaaacagtttttcttaatgggccgaaaatacgtgggccaaaataggaaacgaagcggccgaaaaaaaacttgggctgtcgtacaccagcaatagcacgatgtcgaggcacacggtggagggacagccgccgatcgataggttatttaatttagaagaaatgggttgtatccattggttaaaattctgcaaaatttaaagctttaaatctgtaagaaaaataaataaatagatagtccctttaaagcttattacgtacccatcaaaatgtacgctacttgatcgtgtgtagtgtaggcgtaggaaaaagaaaaaaacccatcaaaataaaaaaaaaactccctactacaagttactttggcttctttttgtcaaatattttaagtttgactaagtttatagcaaaatatagtaatatttttaacacaaaataaacatattattaaaatatatttgatgttagatttaataacactatgttgatgtggtgcatgttgctagatttttctataaatctgatcaaacttgaaatgatttgactagaaaaaaagtcaaaattacttagggccagtttagattccacccaaaaattttacaccttgtcacatcgaacatttaaacacctgcattaactatcaaatataggctaaaaaataactaattgcacatattgcaactactttgcgagacgaatcttttaagcctaattgttccatgatttgataatgtggtgctacagttaaaaaaaatatgttaatgacagattaattaggcttaataaattcgtcttgcggtttaccgacggatactgtaattagtatttttattagtgcccgaacaccctatgcgacaccctatataatacccgatgtgatacgccgaaactttacaccctgaatctaaacaccttatgagatgtgactgagagagtaattataaataattaaaaaaatgcccagcacgaatattgcagcagccgtccctgtccttttttcctttcttctcccccaatccaactcctacttcgttgcgttcgttctaaacccgagcccgatttcagtgtgttttgagacttgggcccttatacaaaggcccgtagtacactaggcctccgactctcgccttccccttccttgttgcccccttacccaagttgatccgtcgccgagttcgcctgagccccaatctccgatcccccaccatcgccggcgccgccgccgctccaccctgccgcttttcctcccgccgccgcatcctcgccggtgagagcatcctcccgctcgttacatcttcctcacaccttttattttttttatttttctctctcgacgaatttgcgaacctagactggtagttcaaccctagcttctcctccctagatctggaagctacttttacctttgcccttttttgttgttgatcttggtagtaatggtggtgacaggtagtttgtcccccggagaaaatctccccactgattcttcgttgggattttagggttttgtggcggcgatttcctgtggttctcgatttgtttctgctcgctgtttcgcgagattagggagattgggaggtatagtgtgtgtcgtgtgtgtgtgtgtggggaggggttgtggcggcggtggattggttgcgagggggaagtgattcatgtgcgcgagatgttgatttgattttttttttgtttcgtcggtgacagcgcgggatggccggagcgacggatctccccccgaagggcgggttcagctacgacaattgcgcgaggaacgccatgcttgtggagaagggcttgaagatgcctgggttcctcaagaccgggactaccatcgtcggtttggtctttcaggtactcttttgttctgctaactggtactcttagtttttttttcttttttcttttgcgtgtgctggttaatttgtgtgcaatcaagggaatcataaaactttatggacataaggataatggatataactgaattgtgctgtaacattagttttctcagctttttttcccctcaactatagtttttagtatgtgcgcaccgcacgaatttatgcttctgtttatgtaaaattttttgaacctgaaagaataatggattaccagaggagatttctagtggcaacattggctattgcagttgctttcagcagggaagtagatggtgcttgttttaacctcctattgtatttttgctcctagtctcctagttgttaatactttgatggatgattttgttttccatgcttcgttccatctaattggcatccttttctgctcatcatgaataatttgctgagttaactttggtgtaactatgctttctacttaggatggtgttgttcttggggcagacacgagggccaccgagggtcctatagttgctgataagaactgcgagaaaattcattatatggcgccaaacatatattgctgtggagcaggaactgccgctgacactgaggctgtaacaggtattaattatggtatcctggtagcatgaagagaaaaaaatagttgtggactgtatactccaacccagttgtttcattagtttgcttctctgtcttataaaaaaaattgaaaaatacaacttgttttgtttcaactctagatatggtcagttcccagcttcaacttcaccgttatgcaactggtcgtgagtccagagttgtaacctctcttacattactgaagtcgcacctttttaggtgattgctctctgcctccctctctctcaaacattgcaaatgtttatgcgtcatcagctagactatcatacattgcaaacgttttaccttctttcttccttatgttttagctaccaaggtcatgtcagtgctgcccttgttcttggtggagtagatgttactgggccacacctgcacactgtgagtaactgagtatggttgtctgttaaaaatatctgttaagagaaattttgggtagttttgttaatcttttgaatcatataggtttatccacatggctccacggacactcttccttttgccacaatgggttctggatcccttgcggcaatgtcagtgtttgaatcgaagtacaaagaaggcctcacagtaagtgaaccagtgtaattttgttctttgttcaggctagcatttgctgattgctctatacctttttttatttacatatattgatactgcatatcttttcattatgttttatatcattctaattatttcttaaattctctagagggaggagggaatacaacttgttgctgaggcaattcgtggtggtatcttcaatgacttgggcagtggcagcaatgtggatgtttgcgtaatcaccaaggtacataaattattattattattattgcatggcattaacaggcaaactatggttgtggcaatttatttgtccgtgtatgctatctttctcacacatggttgcagttcttgatataatttcctgtgaactgaaattcccattcagttatctatgtccatttcgttctattcagttgctctagtcaataatctatgacactcgtttccttcggtttggttgctctatgcaataatttacggaaagtgcaatagtcttagataaatagatacctgcagtgccaaaaataaatccaaatatttctatgctataatcttcccgtcaggggtagaatatttgattgaaccaactttaaaatgctcttgttgcttgaaaagtggacgcgtgtttctatcttctgttttgctaacaaagtcctcctgttaacattaccaggggaagacagagtacttgagaaaccaccagttaccaaatccaaggacttacgttagttcgaaggggtacaacttcaccaaggggcagactggtcagtgtcttattaatgttacatcatattgatagaaatgcttcagcaatatgaactcattcgtgtttcttctctcgtctcgcagtggtgttgtccacaaagataacacaactgaagccgaaggtagaggtgacagagggtgatgcaatggaggagtgattttgtgtgcttacattcagacaagcagtcacgttgagaacatatgctttcatttcagtggaaatgcttgaacaaaaaaagatgactcttgttgtacttccttgggcttaatgcacatctttaagttgattttcgacacatttatggaggaccgatcttatatatttgctaaacggtggtgcttctattcatgatgttgcttcgtgtattcaaaggttcatttagcgcgaactgaatgactaccaatcttcctcgagtccgatcgctgagattatattcctagcagacttaagtttgtagctggagtctcagttgataagcctttttttttaaaaaaaaaattatcagtgctgacataaattacaatgtcttaaaattaaatccaaaattaagttttaaaattctaattttgaccgtggcttataagggcaacgatgggtgaaaagaatcatataattgatatttcaaaatttaaatccgttgatacaaacttttttttgtgatatgaaggaattattgatgtaagtactgaaccaaaaataaccgacaacaaagttcagaactactttatccggtacaacaaaagttcagaactattttctcctataataattcagagtagatactgcaaattgcaacaccaccaacacatttggcttcgatttcatttctgaaaattttgtttgtagagtccatcaggctccttcgaaacatacagaacttcaccacattctataaactataacaacagcactgagtcactaataaaagttggaactctgtctatggggaatcaattcaggtactgagaatgagcagctgcaatcagggcagctccaaggccagacccgtcgtttgcaagcttgacagccaccgacttcgacgcctcttctccgagcaactccgtcagcgtggtctccaggcactgccggaattcggtgtaatgttcatatagaccgccatcgatggcgatgaccgactttcgcttgtcgcctgggacgcctctgccgatcttcctgaggatccctacgatcccagcagcagccagccgggctgatcttcgggtgacgatgtcacagatttcgacaaccatcttccttgtttctaaggatgtgtctgtgatctgtggtaaaagtggacaatgccgtgtaatgtgttcattgtgcataaaatggatagagggaatacagttcaatgctggatttactgatgaagattaccttcaggttatctgcaagtttttcagccacaattctgagatcaggtgttccatcatgatgcatcacggaaatatcaggagtcctgaatataatgagagagaggataagccagcacatcttttttcaaagttgcttatctcattttggaaaattgcaaagccatatgttttgcgcctaataattattatggatcaatggtgaaactccaagtgatcctatagatattctcagcaaatcatgctttatttgcctagcttatagattaagattaccacacaactgagtttagcgagaaatatacctcagaataaagcgggttttgagcttggtctgatctagattgccaaaaattgaagactgcaaagatattttaagaagcactctccttacgatttcacctagatacattcctgaaatcaatttctcgaagatctgaaaaaaacaagtcatagtttttttagacaacaggtagcagttctatataatgtgggtaaaacttttgacatgtgaggagtatgcaatcttctagagaaacttgcctgctctccagggtttaagctctctttatctagtgcttcatcatattctgttattggaagacaggatgaggagaagttaccccattctgtattaataacctgaaattcagaaagtacagtgagaaagaaatccaaatacagatagtagatgattctatgcagtacatgccagttacttcggttgagaaatatctaatccttaccatgtttcctgattttggtaactcgccttccaacttagggatagcatttgccttctcaagatatgcggcgtttgagccagtgcctaagatcacaccgacgacaatatcttcgtcgtagtagctgcctgccgccaatgtcccaacagtgtcattgatctgaaacagtcaaaaaataatgtcaagcttatcataagaacaaatttcgctttgttcaaaaatgatatggaactgatcatttcagaactaaccaatgcggaaacgcgcatgtccagaccttgcttctccatggccatctgcaattcggccaccacatcttcacctacctgtcatattccaaagaagcactaatttcagaaaaagaaaccaatgacaaaattctgacagcatttcacataacaatgtgaaaaacagattcgctgtgacattgatgttgtgaatttgtttttttagataacaactgatgcagtgatgtgggaaaactgacaaatcaagagaattcttacagcatcatcaatagaaaacgccttggtccacttgataagagtcccagacgcaatcgatgtttgccgcacagggaaagagaaggtgaaccccagttccctttgcctgtcgttgaacacggcattatgtccttcatcagcgacgaacttggctaacgcggaagcgatgaagccaaacagctcctgagattggcatcacagcaacattacaaacatggtcatccaatgagactaaatgtgatgttttactatgatatatactagccaattcacccaaaaacttatgatactatatggaaacaagtgtggacatgctcactcaccgaggagttgccggacatgagatggggagggatcgagacctccctcgactcgcgcttcacgacccgtttctcctttccagcaagctgcacacgcaggactcggaagtttgttcccccaagatccagcgcgtagaacaagccctcttcggtcctacattatttagcacaacaaaaggttgttagtcatgctgatcacgaaaaatacagtaatacacacattgctgttctgcgattttgttgctttggcagatagctttgcttaagcccttttctgctattcacaaaaaaaaaaaaaacagaaaaggagaaatgcagtgataaacacattgttgttctgcatttatgtcattctggcagcaaacttgacaaaaagcctttttctgcaaactacagatttttttttaaaaaaaatggaaactttttttttacctttttatgcagaaatacagtaccgcacacattgctgttccactattctgttgttttagtaacgagaatagcaaaagatattttccgctaatcatacaaaaacgaaaagtctcagctggtgcatctacagaaatgcagtaacactacacgcattgatgctctgcagttatgctgtcttggcagcgagcttagcaagaaaacaatttcctgctaatcgcaacaaataaaagaaaacttttctgctgatcttaacaagaaaacttttctgcctttttttttttggcatcggcaagctgtaactagacacggttacacgctcgcacgctgacacgcaatgttgcacggggtcacacacgtgctgccgcagcaggtgacacgagtgcgagcaatttgacacgcgcatggacacgcaagagcgcggtaactttttcttttttttaaaaaaaaagagtaggtaaattatgttctagccttctagggattaatttaatttaatttaatctaatcccaatttgcttggccccgacacacgacgctgtgtcactggcagctcactgcaggtggcaacaagccaacgatagctcatgttaccaaccgacatgaaaccaaattgggagaaaaaacacctactaaaaatgtgattatcatgcaattaaccaccacctacttaaccaaaggagattaaaccagcttgcaaattaatcctgacaaaccaatttttattttcaatcagagtatccgaatcatctgtagctgctgatattaaagtgttcatggcatccaagaaccacacaattactaagaaatttccaagtaggagagagctaaaagaagaagtggatgatgaaacagtaattaaaaggaaacaagacctgtgattattagtgattataaatataattactagtagtaattagttacccattggggaggttgtcgacgtaggaaacgatcatcttgatcttgctgccgccctcctccgccaaccccgccgccatctcgccggccatcgccgccgccaccccatccagccgcgccgccggcgtcgcgcactcctcccgcagcgccgccaccacctgctccgccgccgccaccgccgccgccaccatggtctccgaccagcaaccaatcgatggatcgatcgaggagtgaggaagacgagaagatccaagaaatgcgagattggtggtcaagatcaaaggccggagctaaccaagatcgcgtacacaggtctctgggattaggaggaggaggagatgaggaatttatagcggtggcggaattgaaagggatttcgtgggaggaagaggagttcgaggcggaagaggaagaaggcggggttgggttgggtgggtgacgcggcgtcgcgtcagcttaaattcgaagggtttttttaaaagaaaataataataaatgactgaaattgggttgaaaaataaggggggcgttgcaaagagtgttgctttgaattcacctctgcccacgggaaacgtatgcttcggttgaccccctgggtttgactgcaattttgcgtttgcgttttttttttgggtgaaacttttcggttcacggaaacacaatttggcttgatttatttataaattttgatcaatggtttagttaacttaaaagttatgaaaaactatattaaaaagcacttttctgttatatagttatattgattttatagctattaaccagtaaaaaaagattttatagctattaatattataatttggaagaaaacaggcaacttaacttgttagattttttatgaattagacttgacacgagtgctcatatttacgatttgttattattctttcaatgacccctatgctcgtatttacgtctcagtgtcatgcaatgagatgtatatggtgagttaacgatgtgtgtgcgcgtgttcatacgaatattgtacgcgcatgtatgtgaatacttaaaaaaaattaaatcctagctgtgaaacctggatataaacatgtccaggtttgtagctaggatttttttttgacagagtagtatatatatgtatctaagaaaatattttatgatagattaatgattaaagtttaatcattaatagtttttagactaaactatgagtacgtgttataaaaaatcacatggcaggagcagtaaactagtgatacaaggcctatctgaaggtgatatctcatcctatgtcgtgatccctctacatctctttcactatctacttttgatgtaagctgcaacctttgacttatgagccacttcagtatacggcagaaatttaggcctcttatgatacgtatggatttttcatttcttattagtgattttttttatctttttccttacaaaattttatatgatctttatatgaaacaacaacaattgttgtcgtaaacaaatgcgcacgcagcctgtattattagtcatgcatgtgctacatcctttgtctcaaaataagtttgcatttatatatggatttaaagatggagggcgcaagtgatatggctaatattatacggttagaatacatttttttttgttaaaaacaattggaatacacagactacacaatataagttcataggtttttcctcctttttttgaaaagcaatacttgtgcggttggcagttgaacacacagtttatagtagtagttgcttggaatttattgtcttgatactcctatttgagaagtgtgtcttcaggttcagaccaaaagcttatagtcaaaaagatacgagtagtattccctacacacaaattttggagctactccatccgtcctaaaatatacttcatccgtttcataatataagactttctagcattatctatatttatttaggtgttaatgaatctagacatatatatgcgtttagattcattaacatctatatgtatgtgggcaatgctaaaaagtcttacattgtgaaacggagggagtaagtatttttagttatgaatctggataactgtgtgtccatcatagctaaaaattgctatattttaggacagaggtaggtggacagaagcaaagacttaaatttgatagcagcagcagccaggttagttgagtcaaaccaacaaactaatcagctactgttctaaaagactagaagaacaaaagagaattatctcaacatactcccaaaccaaaatcgttggacaatcctagtgtacggctctgcaaaaaaaaaaaatacaaagcaggtggctgcgagagaagaggccggtttcaaggaatttgacctggactcccctcgttctggactcggaatagccattagccaatagcagccgggtttggattagatattttaggtggataagggtttcatggcacctcactctgacgtgagaaaacactgccttttgcattgtcatgctatcaacatcctactaacaaatagtaagagaataaaaatttaagataggagagcgtgcatggcattgttattagtattatttaaagtagatgcagtgtttgagctctcgattttcagttttagatttctgttgtcttttgtaacttacgtcccttttggtcttttgggtcttatgcagtggcggaggcaagattttcatgaagccggggtaattctaattaaaactgttacccacatattacggttaaaaaaagtaaaactattttattgaaaacaatggactattagggcctgtttggtatagctctaactcctaaatttagctccaagagttgggtctggagtggagttgtggagctgcctaaacccagctccacaactctagttcattttgtgagagagctccacccagctccactcccagttttggtggagctgaaactgtttggctgagctccagctccaggaggggtagagctggagctggagctgtgccaaacagacccttagtaggcgcgatctcctgcatgcattgatgcttaggtgttttaattcacataactaattattgtggcctcaagtacatgcacaaacagactcaaccaaacgggcatgcatggaacaggaaaaatcaggcaccatcttgttatttgcgttctaaagtatgaaatccatatactctatgaagtgcctatattacactttatcagggttacagataagacataccctatatcctacgacttatgaaatataccgataaggtataccttcacgtatacggcttatttccgtatacgctgttggaaatttatctcaagttatgaaaaatatctctatgagttaatgaatagccggaatcctactcggaggggataaaatcttgggataaaatctttggttataccgtgccagtttacatatctctaagtctttcttggggtcaaggtattccacggtataaaaaggacccctagggagaggcaaagcgcatcgcatctcatcgccaacacatccaccaaagtttacgaagccggagtccacaaagccaactcgccgggagatctcgtcgagatcttcaactacgatctcgtcagtatcgcctgtttcggttactctctttgtaatctgttctcatcatcatcaatcccatataaactggactagggctattacctaataagaggcctgaaccagtataatccttgtcttttgtctgttttgatgtcgtactacgtagacccctgttccaacgtaccacgatactctattcatccggtccgcgagtatcactcgtcgacacactttgaccgggaagatagcaaattgttgcacaaaagtcactctatctcaatgggtcgtggatggggagcctaggcaactgcccgccctagtcgggcggtaaatccgccgctggtcttatgccttgaaccactaagagctaagcttaaggataaaggttgtgtactttaaattttcatttttattaccaatcacaagaattgtgaatatagattacggtaggttattgccatgttcggcaatggtgggctattcatctgccacgcgtacgccacgtaggataataccgctttggattaggtcaagagggctattcgtccggtatagacagttcagggtataaaatatctggttttgtggttaggggggtaatttatactattgtcatagttcgagaggtaattcgtacttttttccttcacaatataagcgcgaaaaacactactacaggatagattttcctggacgcccctcttttttgtttccatgcggttcgtaagtggaaccgcatggaaaaaaagtggacaggctccaggatgtcgcccgcacgggataacacattatcccgtgcgggcgggttaagccaaccgcacacccgcgtggtccaccgcatttaacctggccgcccacctccctctgcctgctctccctcgatctctcccactccactcctccctcccactctcctctcctctcctctctctctctctccctcagtgcacagcgcgcccctccctctctcccttagtgcatgacggcgggcgaagagggcggcggatccggcggcacccgccccatcccctccttccccttgcagaaccgggggaggcggcggcggatccggctgtgcgcggcggcgagcgaagggggcggcggcggatccggcggcggcgatgcacagcggcagcggcggcgtgcgccccctcccctccctccccgtgcagatacggcggagggaaggcttgggggggggggcggatccggccgcgtgcggcggagggcgaaaggggtggtggcgggcgagaggcgtggcggcaggcaaaggggacggcgacggatccggcggcgcccgccccctctccttcttccccttgtagatccgggggagggggcggcggatccggccggcgaagcgcggctctcctctcccttgcagatccggtggaggggagggggaggaccggcggagcagcggcatacgtcggcgaccggcaaccggatctatctctccctcctctctttgttatttgtgatttgttcatgtgagatgtgttcttgttgatatgagatgtgttgatgtgtgttcttgtgagatgtgagatgtgttcttctgagatggttcatttgcgccggcgacgggagcgagcggcggattcgtagccggcgaccacgagggcgacgacggcgggcctcggctaggcagcggcggactagggttagggttagggtttcttttttctttttttttctccgtgcgagcgcccgtacgcaaagattggttttcgcttgcgggtgcgccacccgcacgcgaaaatcgcgatttttccagacgactgggtgcgtgcgggccgcccacccgcacgcgaaaattggatagcccgcccggaaaaatcggtgtcgtagcagtgaaagaagcacagaggtcagcagcgaaagaaattaacgatgaaaagataataagaaagccaagtacaccatttgctttgatcgaattcggctccaacttttcttcgcgtttttgctctctattatacgtaggactagcagtaatcaaattgcaattgagatgatgcattaactaatcagttgtttcctcttcgccgacttgtgtacatcggaatcaggtctgtgggccggccacctgcatctccgtgtcggcccagtccaacaaaactgatcatgatcaattgtgcagccatgattcggtccaatcttatttcagaggccgagattgttagcccattcacaaaaattaggtaccaaaaatgtaattgtaaaatataggaaaaaatatatgaatacactgtttggataaacagcaggaattagagaagagattcaaagttaattttttatgggggtcggatctcatgctaacttttctacaaaacctccttgtcttgaccataggaatttcataggattgttcagtctcaatcttttgtttcaatgaatcgaataggaaatttatgattcaaatcgtacaaatttcatatgttttccctacaaatcggtgccctaggttttgttttttcacacggagagaagcataattcttatagttttctcgttgagatcagactaaactccgaaaatcctatatggcacataatccctccatccaaaaacagccaaattggagctatgtatgtggacattgggatgtcctgatacatagcgaagattttatttaatttattgtttttttaacgaagggaataagtgctggcagccagcgcacgcgcatgtgcatgttgggcctggtgggccacctttggaaacgacaagaatcaaaatcacgattagcgctaattactgattccgcattatctgttttccaataagcacggacaatccatgtgcttaatttgacgagcctcctgcggttttttttttctcaaactgttgttgcagttttttacccaaaaaaaaaaaagaaatctatacttagaatttgaatcttttaaccagaaattgtaaaactctacttaaattctgaaaatttcaacttaaactctgaaacttacaactcaatattccaaactttcatctcaaaattcaaaactttaaacttaaatttaaaaaattttcaactcaagttttgaaactttcatcctaaaattcaaaacttccatcgtaaaattaaaaaatttcaactcaaatgttaaaattacaactaaaaatctaaaatctttcaacaattttttaaaaccgtttaactaaatccgctcggtcgacctccgcccggtaaggctagtgagggggcagggaggctggcggcggcgacgacgtcgtcgaaaggaagggccttcgacggtgacggcgacggcttcatctccaccaccaagctcgcacgctctatggccgacatcaacaccgaccttttcgacctgtccctctccgcctgcgcgatggcctctccctttcccctgacatggcgctcccgctggccacccttctctctgtcgtccgcggctggtcgccggatgccatcaggggaagaagcaagaaaagacaaaaaaagaaaaaggaaaggaaaaggtgaaggatatagaggagaggggagtactgaggatgatatgtggagccacatggcccacttttttttattttttttattcttgtaactgattatgtgggcctcacagattttattattatttcgcattgaattgcctcgtaagtgtgacgtcaatgccatttggcaacgaagacctagtcaactgatccatgtatgcgccacatcagctaaaactagggtcaatactgccaagggacctcgtttgcattgttttgtaagttgagggatgtgttgtatccagttttctggactgagaatggaaaataagactagaggacaatggagggacctagagtgaacttattccaaaaaatcacaagaacagcggaaggtccagtcgaacaaaacaagccatggtttggcccaagcttatttcagaggctgaaattgttggcccaagcttattcagaggccgaaatcgttggcccattcctgtagataggagactttactccaaaatccctgcagcttcagtttttttagagagagacaaagtcgtacaactcgtacagttcctggttgagatcagaccaagcccaagtacccaactgcaaatcaaatccaaaacagattagctaaaaaaatatcaacaattcttttcttgacaaaaacaattacaatttacaaaggcaccgatcaatccccaacctcgcagatgtatttttgtatgtgagttgcatacaaattacattatattgtaactataacatgatacaattacatcataattatattatataatgatgatatttgaaagtgtttcactccagaactgactaaagttgtataggcagcctgtctaaactgaaagaaaaaaaaaggagcaacagaagagcaagggcggcatgagcgtggcatgtacagtatatatgcacgtgcctgcatgataatgcaacttgtcctgtctgcctcaggtcgtcatgattctttgggagctcgctcgctcgcacgcaaacatcggtggtagccttcattgtgtcgcgccgcccgcccgggcagagacaccatcgttagttcacaggcttcctttcttttcttttttttttaatttctcccagttctcttctctgttggcttcagcgatgagcttagatctactccgtccgtcccaaactaaacgcaaccataaattttcgtgtcaaactttaatagttaatcttatttaattttttatgattagtatttttattgttattagattataaaacataaattgtactttatgtgtgacttatttttttagtttttttttaaaaaataaataaaacgaattattaaagttggacacggaaacttatagttgagtagtaactactccctccatctacttttaatagttatatttctaaatatgaaaattctatttttataagcatatttcaatccaacaacatatcctcttaataactttctcggatttaatacatgactctccattattccacacatgattggctacatgggtatcgaaaaatgtaaatattaatgaatcgcttgtttacgaggaatgactagtagcatgtttaaattaatgataagtagaattacttatccttagtctgtatgtcaagatgaaatatgactatcaaaagtagatggaaagagtattatacaagttgcattgacttttttttatttaaacttatattttgattaaatttatagaaaaatttaacaacgcctttaatactaaaatgattttattaaatcttagatttgtcgacgtttgatgtcgcgattccggcatttgcatagtatggggatcgttggtactaggatatacgcgagactaaggtaaaagatggagacggggatttttatacaggttcgggtccctgaattgtgaggtaataaccctacatcctgttggccgaagccggtgttgctctttattcatctggatcacacaagtacaatatttggggtagcctatctaactgttaccgacatggcggtctgaattaaaggtctgactcgtagtcgataacagggtaatcttcctcctcgaatccgtgcccggcgagatcagaaacagcgctagatccctacggccggcctctgtaggtaccggatagggtcgatccaggtgtatctctgaagtcgatatccagcggcttgtcttggcatatgttggcttgtatgttgtggcttctgttgttccgtgtatgttgattgtcccctctcctcctagagggtcttgtatttatacccataggtatccccttgtccaaatagaactagggaaaccaatatggatataattcgagtagttcttgtcgttttcatgtacaactctggttgtctttccttatccggaactcttcctatatccgcaggttgtttccgtataggacatggtatgtgatgccgagatttagtcaactaaatcctatcgatgggtcatgccgagatttagttaactactattaggtatgtggtatccataaccctgacaatagcccccgacttcgatgcaaatgaacgaattcatattctcaaccgcgcgcagaccttggagtaactgttatcgtgctcacgtgaccgttctcggtgaattcaaagataacgtttgacttcctttttcagccttgtgcgggcatataaagggtttatctgagtcaatcttacacgaccagatcttacctttttcagaactcttacacgaccagatcttacatggtcttttgtctctacaggatccaacaaggccttatcggctctgcgcgtccccaaccgaagtccccttaggttcctcggaggccttgtcaagacggtgtaaacggacagtaggataggtttcaacgctaggtgtcatcatggtaagggatctctgggtaaaacacttggcgatattgtgtacctgatatcaacttcgttgaagtagaggtaatgggagaatcgctacaccgctggtcgagaaccagttagtagtcgtagctcgaccactagaagtggaaatagtgggagaatcgctacaccactggtcgagaaccaggtagtagtcataactcgaccactagaagtggaaatagtggatgaaatcgctacaccgctggttgaggaccagatagtagtctaaactcgaccacttgaattggaaatagtgggagaatcgctacacctctagtcaagaaccagttagtagtcgtaactcaaccactagaagtaaatttacgagagatcgctacgattgactggttgagaaccagtgaataggtgtctctcgatcatttggagtcgtggtacgaggaccgctacgctgccggtcgaagaccagtcatagctgttcctcaaccatctgaagtcatggtgcgaggaccgctgcattattgctgtagtcgtatctcgaccatctgaagttaaggtgcgagagattgctacgttttactagttcgagaaccagcgagcgagtagaattatctctcgaacaccaatggaagttgcggtgcgagagattgctacgtattggttcgaaaaccagcgagcaaatagagttatctctcggacaccaatggacgttgcgatgcgagagattgctacatactggttcgagaaccagcgagcgagtagagttatctctcggacactaatggacgttgcgatgcgagagattgctacgtactggttcgagaaccagcgagcgagtagagttatctctcggacaccaatggaagttgtgcggtgcgagagattgctacgtgctggatcgagaaccaacgagcgagtagagttatctctcggacaccaatggaagttgcggtaagagagatcgctacgtgctggttcgagaaccagcgagcgagtagagttatctctcgaacaccaatggaagttgcggtgcgagagattgctacgtgctggttcgagaaccagcgagattgctacgtgctggttcgagaaccagcgagcgagtagagttatctctcgaacaccaatggaggcgctagagttggtttattacatgtgcctctcatgtggccagcatgactcacacacccaacttgtagcatatccggatgtccgttcacaatcatgtcgggcgatcaagccgacaacgttcacgaggaattatctgttaacatccttttctcgaatagtccagccacggccagtgctatgagataggtcgtcggtcttcattggtaggttgggcgcgacgactctgcatttgtcgagatcattctcgataatgcggtgtactcgaccacaacctactcgagtgctcaattgttcctgaaaaatattttctagaaggcaagacatacagcagagaatatcgagtatgtactcaaaaaactgcatgggtcttctagtattatcaggatataatgagcagatgtaaatatcaggtattatgtaaactgtaaacaagcatgatttatacagaagaaaatagagcgagcccccaacgttagatttgtagtcgatttaacatcggggacactcgcgcaatagatattgtataaaagacatgctctagataaacgtaataaattattgatctgacaatgttgtatgatctgaataggtacaataaattcgtagataaaatattgcatacctttatagatatatgccagatgtatctacgaaattagtagattaatttaaaaatcgatctcactaattaccttctgtgcacctgtctgagtagcccagacatatcttaccaaagcaattgtacatatgcactgtgtggataaatgttgattggtccaaacatgcatgcacgtttttttggcttggatctgtctgttggtgtactctgtcgatgatagtagatgccgtgtccagcttggactcagcgggccgatgccttgcaccagctagctgtaggagttgatgccacgcgcggaacgatttgtttgcaccttaacctggctaggacagtgcgacgtttgatctcgattcaaatcgggcccgtgtccgaggacaccccattgggaataggaccgactcatattggatcaatctctcgtgctgtcgataccgttggtcttccaccgcgacgaagtcttgaaccttggtcgatctcgccagatcgaatataattgatgacgatgattccgatctcaacgggagacatacttcggtcgggttaaatctccccatagcagaagtcgtcgagtagcttgttgtcggagaatccatctcttgaacccatctcatcaaaatcctgaagtaccaaagtcccctacctggtgcgccactatcgatgtttgatgtcgcgattccggtatttgcatagtatggggattttttggtactaggatatacgtgagactgaggtaaaagatggagacggggatttttatacaggttcgggcccctgaattgtgaggtaataaccctacatcctgttagccgaagccggtgttgctctttatttatctggatcatacaagtataatatttggggtagcctatctaactgttgccgacatggcggtctaaattgaaggtctgactcgtagtcgataacagggtaatcttcctcctcgaatccgtgcccggtgagatcagaaacagcgctagatccctacggccggcctctgtaggtatcggatagggtcgatccaggcatatctctgaagtcgatatccggcggcttgtcttggcatatgttggcttgtatgttgtggcttctgttgttccgtgtatgttgattgtcccctctcctcctagggggtcttgtatttatacccataggtatcctcttgtccaaatagaactagggaaaccaatatggatacaatccgagtagttcttgtcgtttccatgtacagctctggttgtctttccttatccggaactcctcctatatccgcaggttgtttccgtataggacatgttatgtgatgggtcatgccgagatttagtcaactgctatttggtatgtggtagctataaccctgacaagattaaaaaaatttgttttgtattgaataatttgtcccacataaggcgacacatatcttaatttaattcgaaaaaaaaaactaatcatgctaactcctccgcttcaaaatgttgtttgagagtttgaggggccgtacttaacacggcgaaatggcggtggtgcccttgggcgccctgttttgaattggagagttgattaatctccaatgggctaatggatggggtccggtgggtcgcctgctcctgctccggcgcgccaaccggggaggggaataaaaacggaccatgacgtcacctgacgtcacccccgagaagattcctttttctctctcatcgctcgcctgtcatctgtatgagtatgcaggtacgggtacgtaagcttgctgtcgccgtacgtgtccacaaccaaacttcaaaaagattccgcccaggatccttctgtaaaagacgagttgctagctaggtgaccatttcttttttctatactcctattataatacggctacatgcgtatacggtagtggccacagcaaccagaaaacaacgaccagaaatatatggtagctaaaataaatcttactccgtatcaaattttaataacatcatcaagttttgataagatttctcatgtgtctatcagagtttggtaaaaagactaaataaatatatatacatttttataagtttatcaaaagaataaaagaataatatggtttaaaatgacatcgacggtttttcaccgtatcttgcggcacgtacgctccggccgccggccgaattaccgggcgtacctgtactactccaacttgtgggatcgccgtacatttggaatccggtggtccacccggcggcagacgcgcaacccgtgcaatcctgtggctgcgagcaccctacacgtacgtacgtacggatcaaactcactcaccccttgtaacaacgggtttaccgttcacttgcttgatactactacgactgcagcagcactagctactgaatatttgttggacgaccaaatcgcaccggtgttgcatcaacttaattaatgtgcaatctgcttagtacccctaccacctttcaaaacgccaattccaccgtaccaatttttacatggtacgtactacgcaccttagtatacgagcccaaggacgaaaggatgatagtatgatataccatgcctatgagaaactttcagggatcttccggctagcttcacaaggtggtgggatacatgatctgagttcgaagcctcacccctcctaattatttgatattatgtcattttctaatattctcgtcttttttataccatgcctatagtatatatttgagcccaagaatgaaacgatatatcatgcatatagtcttgttaagtaggcgctgattagaacgtcatgtagcagtgatagaaatagtactaagtatatgaggttatttacctatactactaaataaatgatcttcacagaacccctttctccaactcacatgcgggtcgttacaacgcctgcctacaatatactctatcccgagggagggtagatgggccacctgcaaaaagacatctttgcagacgggcctcttccgtctacgaaaaaacctcccttcacttgcctctcttttcacctacgaaaatacatttcacaggcggtatcttaccactacaagataattgagctattgccaccaaattattactataaaaaataattcgtagcaatatattgtactattgcaatgataatttttctgtggtaaataagtatattttattgcaacgacctacgatcgttgtttcattagtacttttgttgcagtagaaaatgagatatcgccacaaaaaatcgtactgttgtaaaaaacatgttctatcgccacaattttaattttcgtggcaatttacatagtccatggtacttttcactatttttttgttgccacaatcaacaaattcattgcaataaaaaaaattgtcgtctcataatgtaacttatttttttcatgtggacacggattgagacaaattttatatggaaactagaaagatagcccgcgcacatgcgcgggcaccttatataatgtgtgtgaattttattataaatatttatgtgtggctgactttttattaaaatatttttactatattctaaactaaaattaagcttatttagtgtgctttagatgctagttattttcttacaattacacttgcaacatataaattctaaaataaaattacttgagattatgcagttttgaaattatgagaaagcattatgtcaaaacaaagaaggtggttcctatgagaaaatttagggtattttgactccccagaaggattatctcgataccccaaaagaaatccaataatatcaatttttgtttgattttattttaagttatatacacacacacacacacacacacacacacacacacacacacacacacacacacacacacacacacacatatattgtaacagtcctcataaaatgttttttttctatttagaatgggttttaaatccagcaacatttttttagttttcaatttatttcaagccctattttttttcaaagttccattctatgaatcatccttgaaatgctttaatctttgcaatttagagtgaaaatataaatgcatttatggcatggggtaaaggtatatgttataaattttatctcatgaaatattgaagtagtggtcatagtattttttgtgaattatcactaaattgaagtgtcttataacaaataatactccctccattccataatataaagcacaactatttttttctgatgttccataattaatataaggcgtgcatgcatgcatgcaattaattagcacatcttatccattaaattattattttttaaaatcctccaccctcaagatctctaatctattgggtgtatgcattatatttattagggtgatacaaattaggaggtgataataatagtttcttggtatttgggttaagggtggttgtgccttatattttgtaacgaagggagtacatgtttctagattgttctacatcaggactcatgatttaaaatgttagcatgttttaccagaaaaataaaaaaaatggacatggcctttaattcttatatggaattgacttgatatatttctaaggccacctcaaggttgtatcattattaagattcctaggtgcaatccacatgcttattggtatgatcttcaaccgaccacacatttattttcaacttgttgtctataatgctagatgagtacatttatgattaaaaaaattatatatgtcacttaaaattctttttctctaatttattagtgacttcatagatcatatttgtaagttggatgctatgaacatcattattaagaacatttatttatttctgaaaaagattgttttaaaagtatcaaggtcaatttgtataagtacatcaccccgtatgcatgttaagagaaattaattaagtcggtagaaagtcactatatatctaacgggatataagtaatagatagaggtccatttgttttttttgcccatatagataattttaattttaattgttaaggagatagaaaacaaagagaaaataatggcaaggagagagggaggtttgggatgtttttctaaatgatcaatctaaccatctaaaataatgtattggatgtttaagtcaaaaccgatggtcggatgttttgttttcttgtcagaatttttaggattttatctgatctatgagagcaacgtaacatcttaagagtgtttataggtggacttttaacaccgcatgccgcaacggagtaagagagatgcaaggaggtttgggctttttttttaaaaaaaaaagatctaatgacccaaaataatgtgtcaatcgattgaaaataatatttccatagatttaaataaaaaccaatggttggattatttttttcaaaaattcaaagatttttctttgctttaagaatgccatataatagtttagaagcatctatgcgatgtttaatggatttgaatgtcgcataggggtggggagaggagagaggtttgggtttttctatttaaaaatactaacaatctaaaaaaagtattggagtacgtacatacttacgtgggaggacgagaggtggggttttacatgaggaggtaaaaacagtcacagaaattcccgatcgaccgagcgtcgtttctgtataaggggtactatttccgatcatacctttttggctatttttaaattttgttttttctaatttatttctgcattgtattaatgtcgacactgagaagtttaaatgataaatatggtcagttaccggccgatcgagcatcgtttctgaagagatgctaccgattccaaccgtttccgaccgttttcaccctggaggtgcgcctaatcaatctaatctaacggttgataatgttggaccaccgatttaattgaaagtcgagggatggatgttttgctttatctaatccaatggtgtaaaataatgggtccaccaatttaagtaaaatcgacgttgagattaaataatgccacatggcaatgtatccatcaatttaagtagaaatcgataatcgattacttctttttttttatgattttatagtatttctctaatttaatagcaccaagtagcggtttaaaagtgtttgttgtaagatgtataaagtgacagagggagagttagtagacctagtaggtgaaagtctatttgtggggcatttttgcctgtgaaaataattttggttttaattaatttttcataaagacaaagaaagaaacatatagaagtacgtaggtacattgcacattacgtacgcttgtttgtttgtagaggggagcttccagatgtgatttttactgccaaatagatctaacgatctaaaataatgggtccaccaatttaaatgaaaatcaatggtcggatttatttttttttattagaatgccacttggcgactcgatagcgtttataggaagtttaatggacttttagtatataatagattatagctctcgacgagatctacaattttgtaggtgataactttttcatttgaaatcttttagatattcaaatctatgattcaaatctcagttaggtaggctcaaatggaacgatatgcattttccaacagaattgatgcataggtgagttggtaaaagagagcacgtgtgaaggataggtcttaagttcgaatcctagccaagacacgatatcaaaaaaaataaacagataggatgatagattaatatttgaacttttaatttggtgcgcaaaactattgccacatatggagtggtggcaataatttttattacaacgatgtgaagtgttgcaatatgtctttttgccacatccattccgtggcaacatctaaatttattgctactaaataaaaatcgttgcaataacctattactacgctatttattaccacgactagcaacaattttaaaattgtggcaacatgtatctattgtcataattttagtattgatgccacgtttttttttcgtagcatcaaatgatttttctagtagtgtacctaagtacacttatattttgcactatgtgactattgcttctgtttttataaatatgatttctattttgcagacaaaacaaataatatcttcaatataatgttaagtttgaacccgtcacgttcaaagatgaacatgtacattcatgcatttgcaaaaaggtgaacctacccatcggacaaggtgggtcgatcgacccagctatagcccgtgtcacccccacaccccacatagacacctctagccctcctagcagcatatcctgtcaacccaccagcctgataagtcaacaactgcccatcatcaacgttagtcacgtactccctttgtcccaaaaagagacaactcctagcttcccaatgcataattaaaagagaggataaaggaccaaaacatccctcataaatagcaaattagtattgatggataggtagataaggggtattgaagaaataaaatttttcgatttgtagttgatttattttgggacaaagtttaaattacagaagttgatttattttgggacggaggtagtacgtctcacgtacatggaacgatcaacgtctttcaactccgattggcatcactgttggagttggatggttcgtcttgcaaccaacgccgatgttataccgccgttctgcctgttattttggtgtatggtgaatgttatggagtattgcttcatttttaaatgaaaggcaccatcttagattttttttcctttagttgattggttgtagtactatattttctaagttattataaaataaatatgcgatatatatttgattgccattatcgagttagtatatcttcactctgtttatattttaaagctgtgtactcctagctatagcactaaagaccgaacttagtatggactaattacagcgataaccatcggtaattgctactactccatgcagtacttggtttccatatttttgcatgcgtcggtcgttggaggcaagcaagcaagctgcagcgtcgtcagaggtagacgcatcgatgttgttcttccatgtccttcgaatcttcatgattgccgctctctgcttaattactgttctcttcacgcacaccgtccaaatcccatccatctatccatccgtccacacacctgcaagtttaaattcccatgcagttactacatgaacagtactgctgtcaagtttaattaatttcgcgccgctcctccttctgcctactccctccccggcaccgctcctccttctgcctactccctcccccggcaccactccgtcctcctccgcttgctccctcccccggcgccgctccctcccccagcgcccgttagtcctcctccgcccgctcatgcagctccttccctacacacgctcgctcgcccgcgccgctcctcattctgccgttcgccgctcacgcctgtgcctgctcgcttgcacgccgctccttccatccacaccgccggtcgccggttgtttgccgctcctgcttccaccgcccgccgttcgctgctccttcctcactaggagtagacgtggtgctaacatctccaaacgtcattcatcccatccccacccctatccattctaccaaacaaaaaactagcatcatctcattttataaaccaaacaagtatgtgagatcacccaatccctaaaatcagggatggtttcatcctatcccacatagtccccaaacaaaacacatgcttagttgtacgcaaaacgagaaagcttatgagcacatggtttataactatcataaactcaaaattttggtttttttgaaagaaactaattatatgtagaaaagttttttttaaaaaaataaacatagtttaacagtttagaaaacgtactaacagaaaatgagaaagttaccgctcagatcttagacttaactccatagactcatatgaaaggtcactcataaattatttttcacgaataagctgtttggtatataaatcagctctcggtcaaccgatgaggttgtactttggatacatgtgtgcgagtgcatctttcgtgtataacgtggccctgttcttcccctccccacacacatgaatgtgtgtgtatttaaacggcttttggggggtcacctttcgcaggtactataccccaagagctgaaaaaattgcaaggccggggcttagccatatctgctagcagaaacctgtaggctggatcatgtaccagctgcatttgatgcataccctatgctttagctaaggaggagtacgatcgattcatcaatatcgctcgatcggtgacgacgtcgtccctgcgacatcagatcgtactactgctacagtacagcttttgcctgttccaatcactaaccagcctgcctctctctctctctctgccatggatggctagctagctagatcgatctatcgatgcagagtgattagctagctagctagaattggtgaattgtggtgacgacgagatcgttagcaacagtggccacgagtcaagatgctgtatatatgtatggatgagtcatcagtgtgatgcatgatctcacatctcgtcactgatgatctccagcttgagcttgcgctgaggtgagctgagctacactgctgcttctttgaccttctccatcgatcgaatcccgtggtgataaactgttaactgaggtaattgtaactactgcagcttcgtctctctctctctctctctcacgaaagatgcgtgatgctgatgcatatgcggttttttggatgtactgtttggacggttgcatactgtgcccgttcaatgtcagcatctccatcttcatatgttgctgccccgcctcatctcgatcgccaacttctattgtttcgcttgtgcttatacttataagttaaaatttaaattttaaaatttagttttgaagttaattttaagattttttttatcatagtttatttcacaccattatttgcttttcagtagtttaataacatataaataaaagttatatttataggttagttttgagagcactgctcccgtccagcaaacggtacccccaggtaccggtacccctggtacgaaacttaatttgaccattgaattagagcggggcacgatcgggattgaacttaatctcgcgaggactcagtctcctgcccatgcgctgcatccgcatctgaagtctacgccgtgtcaccgccgcaatcctttcgccctactccgacgcggtgtccaagtgccgtcctcttccggcctctgatgcggtggtgtggcggctcgcctctcggctgcccctgtgcggtacggcagctcgtccttcgtccacggtcacaacttgtcccctcccctccatcctctatgcatctcggctggtggcacctacgcagtctccggcacaggatcacaacaccctgagtttctttacggaagatgtatgagagagatgaagtatttctttcctgctggacattgctttgctgctatattcattggaagaatctgctatgttgatgggagaggctgagtttgatttatgttgtgtgccaagttctggacctagttccttgtcttttgatatatgtaatgaacctacttgattttgctgaaagtatgaatgtaatagtagtaaaaaagtagatgttctgaaagtttgtagtttcttgctctgatgtgtaaactgttctttcgttgtagaccttaagcttactgtttcatcttaaacaaaattaacatcggcggtcattgagcaaattgtcaactatcttgaataaaagggacactattacaactagtgatcccataaataaacttctgaaattcttcgatctcttttctttgcttgcccaatttcttcttgcttgtgcgatccatggccaaaagcctttcagccatctcaatatctagcttcgttttttcttctttctgtcccctccttctaggtttgctaatgctcgcgatccaatgcataccacagcgatgcgattccctgaacaaaggcttgcgatggcgtcggtagacgagctgtcgaggccatattcgccgcgctgagctagtcgccatggtcacctcttcttgttggtgcattgaggtcatcatcatccaggggtagatcgactcccagaaatcggcggcggccggacctggaccggctacgggaagggcaagttgggaatgggcaggttggcgacggttggttgcagtgagggaggaagcgaagtccggcgagattggctgtgccgccgccagggacgacggaaggggatcgggaagagacagattaccgggtcagggacttgtaccgtctctatgaaaattgactaaccacgtaaaaatccaattctgcccttccactagttccatacacgcgaacaaagggggaggtaccctgcaccggattcctgtacctcgcggtaccgatgattgtgggtcgtttgatctggctgaatggacggttacgattgcagtaccgcgtggtaccaaaaattctgctggacagtaaaaaatctctttgatttgctaataagcagtatgaataaacatatgcataagcgaaaggctaggtgctactacttctactgtggaagtgctcatggaggggggccgaatggccgatcgatcgagaaagcattcatccattccattctctcgctctctcaaaagttgcaatcttttttttttctcctcttcttctttttctttttcgttttccagctcatctctgatggatcatctctctctccccgtgtggtaattccgatgtgatcgatgacgcgtgcatgcgtcggagtaggagtacagcctctgttgttctttttggtcttcttcttctacttcctcccaaaaatgcgttgtgagcgagaaaaagagaagcttttttttggtgtgcgtgagtgtgcaactctcaatatttgttgcccgaaatctttcgagtttgcgtctttttgggcttacactgtcccttttttatcgctgcgtccaatcctaatccactatttatgcctaattaattactccgtctgttcttgaatatgacaacttaacttaagtagtggattgaaccttacgtggtactgtactatatatctagacatacattatatctagatatattgtaccaggtaatatctcatatagtactaggatgttatattctctggtactctctaccggtagtacagtaggaatggtctgaattgttcgttattaagggtaaattataaatttactaatataatgattacggaatactttattatttatgttttttttgtctaaatcaatttatggtcatccattttattggcatcactcatattttatcgaaaagaaaaataaaagagaaagaagatttagtcactaataaatgacgattataccttacacctattttttttacaataatgctccctcaaaatttctataaccactaactgaaatggtaatataaatagatctaaaccactagataaaaaagataaactgttcatattgctttctatcagtagcctgggattgggacggaggaagcgaagagagagaaagagagaggtggttttgttttgtttgtccggtaatggctgccgcattggtggtggtggcctcctctcctcttcttttatttcgaacgcgacgccacccacgcgcctccccctcccccctgcggtttccctctcttattcaaaacctgtctcgattctcactcactctcactcactcggactcctcacccgctagctaccccggagcgcgccgcgccaccgctcgacagcggcgagatgggcaaggcggcgcggtggttccgcaacatgtggggaggagggaggaaggagcagaagggcgaggcgccggcgagtggggggaagaggtggagcttcgggaagtcgtcgagggactcggcggaggccgcggcggctgctgctgcggcggcggcggaggcttccgggggcaatgcggcgatcgccagggcggccgaggcggcgtggctcaggtcggtgtacgccgacacggagcgggagcagagcaagcacgccatcgccgtcgccgcggccaccgcggcggcggctgatgccgccgtggcggccgctcaggccgccgtcgccgtcgtgcggcttactagcaagggccgctcggctcccgtcctcgccgccaccgtcgccggcgacacgcgcagccttgccgccgccgccgtcagaatccagacggcattcagaggcttcctggtaagcaacgggtgctcgtcttcttgctctggtttcgtcgtcgtcgtcgtcgccattgtcgttaatcatggcgtgtgttcgtgcaggcgaagaaggcgctgcgagcgctcaaggcgctggtgaagctgcaggcgctggtgcgcggctacctcgttcgccggcaggccgccgccacgctgcagagcatgcaggcgctcgtccgcgcccaggccactgtccgcgcccaccgcagtggcgccggcgccgccgccaatctcccgcacctccaccacgctcccttctggccccgccgctcgctggtacgccgctggctaaatctcgccgacgacatcgccatgtatatgttcgatgttgacgttgtgtgttggcgatggatgcagcaggagaggtgcgccggcgacgacacgaggagcgagcacggtgtggcggcgtacagccggcggctgtcggcgagcatcgagtcgtcgtcgtacgggtacgaccggagccccaagatcgtggaggtggacaccgggaggcccaagtcgcggtcgtcgtcgtcgcggcgggcgagctccccgctgctgctcgacgccgctgggtgcgcgagcggcggcgaggactggtgcgccaactccatgtcgtcgccgctcccgtgctacctccccggcggcgcgccgccgccccgcatcgccgtcccgacgtcgcgccacttccccgactacgactggtgcgcgctggagaaggcccggccggcgacggcgcagagcacgccgcggtacgcgcacgcgccgccgacgccgaccaagagcgtgtgcggcggcggcggcggcggcggcatccactcgtcgccgctcaactgcccgaactacatgtccaacacgcagtcgttcgaggcgaaggtgcgttcgcagagcgcgccgaagcagcggccggagaccggcggcgccggcgccggcggcggccggaagcgggtgccgctgagcgaggtggtggtggtggagtccagggcgagcttgagcggcgtgggcatgcagcgctcgtgcaaccgggtgcaggaggcgttcaacttcaagacggccgtcgtcggccgcctcgaccgctcgtcggagtccggcgagaacgaccgccacgcgttcttgcagaggaggtggtgataacgtcatccgagcaatccatgggaatgaatgagtgagacgacgaggagagctttttgagttggtaattagaaataagaatgcgttttaatgtgttcttgggagctctctcgtttttatttttcatttttgtttcttttttttttgcttttaatttgtgatcaatcatgtgggtttctgttcttttctgaactgtttttcatcctctttttttgtgtgtgttaatgggtgccaaactagtgtgtatgaggaaaatttgattcatactacacttggatgtaaattcttgctagctattctctctgtcccaaaatgaaacctagctgttgtcttgttatttggatggttcttaaatgttttatcattttttaaaattaagatattacaaatacttgaattatgtgaaactattaaagaaaaactaaagctccgggtaaatttgttgaataaaaagcacaatttagattagtctcggattcatgaagtcatgatcctgttctccgacactgggacagtagcatgggaagtgggaccaattatgaatgattttgtgtgcttgttttggttagcttccaggctttcttgacatccaaatctaggatatgtagtactactactaatcactttgttgtggaaaaaaatataggagtatattagttatatgatttcgacaaaactgagggagaaactaatcagtgtatatgataaatgtgctctataggaaaatgcaataatcgagacaagaatggatacatgggttttatataacctggtttattcgaagtgttctataatgggctttattcataagtagtaaaaattaaatctagaccgtctttttcttctaatatatattgtaatgtatatgtaccactatctcaattactgataatagaatatttttctattgatagtataactcataaatcaatatttttctgctggtaataacagtagaatctaagtaacattagtagagaccacatctactcagtttatttaatgttctacaacttatgaagttattagggacggtcatagcacaactcatcgagattttttcatggattgagggagtttgaggtaatggtttgaaggagaccaagacaagtttgcatataacgtggtaacaagattgttttgcccttgggcaggggcagcgggggcgataattatatacacaacaagtaagacggtgatatgagtatattagagtcacgcctgtgatggaaccagaatcttattcctaagcctagtgctaaattagtattatttatataattttatcttcatgttctaatttttagaattttaaagtacaattttaatagatatttcaggtcgggagtgggattgcacaaccctactcctatatctgcctctaagtcacaccatttggcagatacatctagggcatgtttggctgtcgttcccgcggcagcgctgctgctgcagcgcttgtgttgtgcggttgcagttttgctgctgctagctatcgtgcagctgcaaaaaataccagccgaacatgcccttaaacctttgaattttctctaattgagaacactcagattagttttgaatttaaaattttattcccacatggaccattcctttcattatttagcaaccatttaaatagctctatctgcttgtgattctttcaattctctagcaagaaccaatagcctattagtttcgcttgtacttatacatacaagcaaaaatttaaattttaaccttaattttgaagttaatttggtgactttttcattgtagtttatcttcaaacatttgctttcaaatcactaaggacatatgtatataaaacttttacctataaattatatttggtagctaataagtaataagccacactgataagtagtataatataagggaaacaatggggttgcaggttttgttttggtctggaattacatttaaggctagttttgaatagcaaaatcgaacatagataattaaatttccacagttttggtctggaattatgtttattatgtgcaaataggagtttttatttgggggagggggagggtcttagtacagtatgtttgaacaagaattacaaaaggccgaaccttttcagaaatttcctgttgtctctctttgccaaagctttctgaccttttttgtgtcacgtgtgctttatatcaaaaactattttgaaccaaagaacaagctttgagtactaagctggaaaaaggaaatgaaatgtcggtaatgggaaatttggatcagtaccaaaattaatgattattctttattccacggtttggtttgtcctaccgttcactcctcctggattaatatgattttcttgattaacttctacataaaaattttttacacaaaacacatatttagtagttggagaaacgtgttcatggataatgaggaattagctattccaaatagctacttactctctccgtcccaaaaagaaaaaaaaagaataatctagatgagaatttaacactacctaggacaataaatttgtacaacctcttatccatatttattatcctgagtggtatcaaatcatcacctatcttgccttcttttttttagatggagagagtagaactcagcctaagatgatggtacgtgatatggtacggcaggagtattaaccttgcaccatgagttgttgaatttttatcaaagtagagaacactgagattagttttgaatttaaaatttttataaccgtacatggaccattccttcattatttagcaatcattcaaattagccccacctgcttgtgattctccaagttctgtaccgagaggtataaagcaagacttcatttggccagtcctcgactgtgattgtggtgcatggaagcaggttttgctgcttgctgttgctgcagccgcagccgagcatcccctctgttcttttagcgaaatgtaacataacaccagctagaagattaattacttttcttttttgatttgaaatgtttattatctgcaaataggagagatcactccgtttttcccttttttgcgaggaaacatctcagtacttttcaacaagaataaaaaaggttgatgttttttctttttttttattggcgtttgagccgcggaaaatttttaaattttatacttaattttaagttgatattgaggtttctattatagtttatttttcagacttagctttattgctatcaataaattacttttaattacttcatgaagttttccacggctcatcaaccatagaccagatgatgagaggctgtcagaaatttccttgtgcacgtctttcactttgccaaagctttctgaccttttcgttccacgtgtgcttcatatcaacaactcttttgaatgaaagaacaaagctttttgggttttatagaagctattactaattgggtagagattgcggtaacgaattaacgatcactacaaacaataaacctatcatgcagctcgtaggctgttattaaccgggtagaaaaatcgaattgaatcctacatgatctactagcattctagctagctaacacacttgtattattaagtacttgcatatactatatagctagattgggcctcttttcataaggtaattagagtatagagattgtgatatgattagaacaaatactaatgagcatagcagctcgtagctatgggcgctgttataaattggaccgcataatcgaattgaatcctagccatatgatctaccaatagcatttttttagagaaaacactaatagcattctagcttgcacaggctgcacagtactctacttatcatttggaattctttctgtagatcctactactatagggtaccatgcatgtagatatttgacctcctcctttagatgagctaccaaagctaatggcatactctctccgtccaaaaaaaaacaaaccctggttttcgtgtctaacgtttgaccgtctgtcttatttaaaaaaattatgaaaaaatattaaaaagataagtcacgcataaagtattaatcatgttttatcatctaacaacaatgaaaatactaattataaaaaatttcatataagacggacagtcaaacgttggcacggaaacccagggtttgccttttttttttgggacgaagggagtgcagtatatatgggcctaccaaaaacactccaagctttgtgcaaagcgagaggctcccatcggatggcctattcagtcaaagaaaaggccaaaatttaaattttcaaatttaattttgacattgattttgagatattttcaacgtaatttctttttcagcattgacttttaagtcaccgagaacacatatattaaagttttacctacaaatttatttttattctctaataagccgttttgacttattacgaaaaaagccaaataatgaggcccaaagactgcacctccatcttttgttagcttagcctagctagtccagctaaaaaagacaatgtatactccatatatcacggtttgttttgaattcagcttgatttgatttgatttgatctcaatagaacatttgagattcgtgcttggatcggagggagaggggaggaggaggatgaggagcggaccacagagacacaaaaactgtgcgcggcgtgacagagagggagtagggagcgctcgtgacgacgcgtggggcatatcagtgtgcatctctctgtcgctcggtcggactccccactgccaacccggacccacctgctccctctcctccaaagcttatccgatctctctttacagaagcgctcccattggcccaatgcccatcgtataatcctaacaataatattatacttatacttcctttatattaagtttatttttagctcatttattttatctcataataattttattttagattaaccattgcattcgattttaaaaataggaatttgattgtattggctgtagataaagttatggatagttgcattggatttgatagattatggacattctagtctttttgttttttattggtatgtgcggaatgagtgaaaaatgaacttattctgagataggggagtactacttttttcttttgcgattagacgggaaacacatatgcacatacaccactgcacaagtaacatcatacacacatccatgcaaatgcattatttaatacatgctctaaaagagatggaaacccacctacatgtgcctaatattaattcgtgggaattataattttaattctggtgggtggaatcatgcactcatgactgctcccccataccactggtgttttcccaaaatctcacactattttattccctcgttaccaaaataagttcattcaaaatacattgatttttaagcagaatttaattttatcttaaaaataggttgaatttcatttctcagtgtatgcatcaagaaattttatttccgatgccccttacttatcaactgtcaatattgttaatgagagtccccctctctgttaacatcttttttagatactagcaggggtgatttcattttaaaacaagggaagcattttaaaattagataaataaattattccgaataaaaataaatttatgattatgaaaatacaaagaccaaacatatgtaatcttagagactatatcaatatccaaaaaactattttaaaaaataatgaagcgagaaattattcacaataaacttataaaaaaataagggtcttaaaaatggataggggtttgttccatatcgacggatttaaattgcctttctagtgcaatttattgatttttttttgttgaaaacatagtgattcaaattcataattgccttattttttttcccaaaggaatgagttgttttgtttgtttgctagtagggctgtatcttttgctcccagcttgttaagttactgcttgtgatcgatttgtcatgtttccggcaactagctccaactcctgactcgggtttgttaagtgggcctaatatgttttcgtttggttgtggggtggtattcaattttcaagcctcctgaggttaattgtagtaaatagttatcgaaaaggattttttttttgccaactcttcaactatatatatatatttttatcaaaacacagtgaggggtccccacggttttgataaaaaaaatagaactaaaataatatacaaaatttggcagatgccaggaaagaaaagaaaagtcaatccatgactcaaatctggctttaaatttcttctccaaaaagaatcaaaaggctgaatttcctgaaaaatcttaaatcacaccgtaaagtcttaaaaaacagaggacgaagataacatcatgcaaaatcgtgatgctggtgctatgttgtcaatatcacacactttcattttctagctatgtatgacacatagccagaaatgcctatataatgtcgtacttagccagaatgcttatatttcaaaatggaaggagtacttatactaatataggagtatatactgacaaatttaactgcaaaagataaaaacaattattaatacatttgcatacatgcaatttaggccccattcgcttcattgtttggaagttacaacttcctcatttttcattagcgcacgtctcaaattgtttaacagagtgttttttttaaaaaaaaaacaaccttgtatatgatagtagaagtttcttttctaaaaaatcaattaaacttgtttttcaagtttatagtaattaatattataattaattatgtgctaatgatttgtcttgttttacatgtcaccaggcccggccctgaggaggtcgagctgtgccaccgcactatgccctcgaagtcgagcggcccaaccccatatatgtatgctatggatataggagcccataggccataggaacttagatttagaaagcccgggagaggaagatatacaacttatttgataagaatgtttttttatgtattacatttgttagaaacatcattatattatcagagttgtattaaagagcctatctttctagcttcgctccgggccactaaattgacaggatcggacctgcatgtcacaaagttaccacaacgaatggccgaaaataactcagcttaggtcgtgttctatagtcccctctcccaattttcacttccttgtttttcgtgcgcacattttccgaaccattaaatggtgtatttttttataaaaaatataggaaaattgcttttaaaattatgttaatctaatttttaaagttttctaaactaatgcttaattatttatgcgctaatgagttatcccctttcctatgcaggggaaaagttcccaatcagcatatcccaacacagccttagtagtagtactccagtttaaaacatggcaaggaaggggttgctttgatactggcacacaaatcatttcatgttccaaatttgaatgtgatgctatccagatccatatgcaccccatccatacattataccaccacttgagcatgtgagatagtagaagttggcctgaacacagtcaggactcaggacccagggagagactctggccactgctgttgcctattgctgctaactgatctagcagcagcagtgaactgaaagtctgaaaatcaccctctattcaaccatccatgcatgttttgctctgtttgtgaggggctacttgctttcttttcagcaatgattaggttctgatttgatagatgaggaggggatagatacggtgatgctgatgctggtgtttgttccctggagtacattggggtagtactgccacatttttgttcttttctcaagattcttgtccttgagctctgttttcctttcaccttgttccaggccggtctctgcacctttccaatcactccgttctttgcatttgccacttgttggttttacatttgacatccttttcaaaggagggactttggagggtttttgaaggaatttgatctaaattcaacaaaaatcattaatacccctaaccttctgtcttagtacgtgttggttggatagagacagagtaacatgtcctaagggttattttcgtcggaaacaagacaatgtcaaaaccggtagagacaattgggcataactcatcgggggttgaacgaattgtgccatttgtagtatctaaacaaacctttgtgttagatcagtttttaagatatggacataaacttatacctcattagaaacacataatttcacaaaaattctaaatatagcttaacatgaatcgatacatctacaagaatcaaagaaaaaatcttgacatttgagatgagaccttataatagtttgcgatgaaacaagtcctaccagttggtcccatgcatgaaccatgggggaagaaaacatatggccaatttggttatcatcaaactttgttacaactggtgtattgtttggttagagaatgagcagtcccaccattttatctacggttaattatgagttatagagcttgtttgggggagcttctagctactgcagcttctctcaaaatcagaagctctcccaaacagtctagcttttggtccaaattctgagaagttgcagttgtagaatccagaaaatgaactagaagtcagaaactgtaaaactcaacttttccagatttttagaagctggctaccaaccacctgcttttcagaatcttaagctcccccaaacaggcccataatgcttattagcgaataaaaaataatttatgattacaatttttatatatgtattattagcgacaaaaagccaagctaaaaaaactactatgataaaaaaaatcaaataagttaactctaaaattaagacttaaaatttaattttgactacaactgataggctgaagagtaaatgatggagcatactctctatatcccataatataaggcatggtcaaaattggcacggtctccaaaactaatttttagcttaaaatttctcatatactataaggtttgtaacaacaaaattataaccatatgaaaataaatttaaatctcaatctattgatataatttttaacaaataaaattcatttcatattatactaaatggtggtcaaatgttttaagggttgaatcttgaaatacgtgcgcgccttatattatgggatggagggagtataaagtaataaaacatgttataccacaactgatgatatctaacctaatcacaaacctaacaaactatgatacgtctaatatttgatgcgtgtgataatatgtggcagataattaaaatcaaggacgctacaatgattcaaaacactcagcacactataaaaaagatcaaatcataattactcttagattatactccatccatctcatattataagggattttggatggatttaacacatcaatagcactgtaaatctggtcagagaaggtgtccaattttatagtactactccctctatcccaaaatatatggcacaaccacttttctatcgtcccatagtataaggcatgcatgcatgcatacatacattaattagcatctcttggtcctataaaattgatttgttttaaatcttatatcatcaaatctcccaatcacattgcttgtatgtatcaaggtgatccaaccaaaaagtcaattaaatgttttttctggtctttgtgtatgagtggttatgccttatattttgggatggagggagtagaatgtatcacatttatctaaaatccctaataatataggatagatggagtatttaattggttggcctgtattgtgaatggatgatggagcagttgggggtggcaatggcattgcttcgatcccagctagggcagcacatggaaagcgtttgaccggtcggcaaaatgcaggggctgcatatgcatgctggctcgtttcaattcaattcggcggctcaggtctcgagccccaactacacctcagatatcactagtgatgctctctgcttgtctagctaatgccaccatcatgcatatcttactcgcataataatatatataggaggaggagagtatctcagtgcttggggagatgggacaagaaaagagcaaatttcgccgaattcgaagcctgaccggaccagacaaggctttgctcgcttgtgttagccccacactgtctgcataggatttgtttatttgagcaattgtttaatccttcgttacaacaataaacctatgataacctgttctttgaagatattacaaccatcttagatgaaaaatatataaaactaaaaagaaaattaaggaaaacggaagagtagagagatggtattacaaatgaccgcagccacaatgctaactaattcccgcatgtccatacggatatggataagtacctgtcatcattttcattcctttgatagattagcaactgacatcactaaataagtcaacaattcgaactataaagtcgacgccatttattggattatcaataacctagctgattagtccttctagatcttgatcaaagatgtcactaataaagtagacatcgacaaagattcatagaagaaaaacaagctctacatatctaatagattcatagcactaaacacgttatttcagaaaatcctaaaaacttatgcttggttagaaaaagagatggaaccccttcccccttgccgttggtgagagggagaccagggatgcaacattgtctcgagagtcatggtgtcgacgagctgttcaatatgtgtaatttgtcgtggatttgggtgacttgttttgattttaaaatgatattggatcaatagtagaaattaggtgtatcaactacgggctttacattttggaataaaaagctattatgataacatagaaactccgtgatttttagaaacttcacaattcttattgaaatttgaacatgttttcgctaaaactaatcaatcttttgctaagtttaaacaaattattttttactcgagatatgtcagaatacactggtacaatattgtataggccatactattagcaatagtgcaatttaatcaaatagtggtaaaaatgaaaggtttggttaactagggttggcagtggcgcaagagatgggtggttcgacttgttcaatttgttatggattttgatgacttattttgattttaaaaagatattggattaatagaaaagtttaggtggatcagtattttactgtatttgtaatgaaaaaaaatattaggataacgccgaaactctgtgatgtttagaaacttcatttttattgaaatttgaacatgttttttttgccaaaactaataaaccttttgctaaatttaaacaaattagtatcttttttttttctcaaggtacacctattgggacccaaaaagtataactttgtgagccctacgatctatgtggaaaaataaaatccaagaaccagcttagtaagtgcctgaaggatctatgttcaaatttcaaaacagagtgagtaatttttagaaccgtgacttgaagatcaaaaactatcaagtgcaacaacaaccttctgggagagacatttgctccggaccaacaaaaaaaatatctcgaggtaccggtacctcacggtaccaaattgttttcaatcgttggatctaacaatgcttatcctgcctagcaagatccaacgatcagaaacgatttagtaccgtgaagtaccggtacctcgagatattttttgttagaccggagcaaatctctttggaagaatttgagccaagtgcccaaacatcattagcacattccaaccacaccaccagtaaaacccatatcatatcaattttagatttttttttaagataatagataaaatctggcatttgctttatcagaaactacactcacttataacatatatttatttcttaggtaaaaaaaaagtataacagtatcagtttcaaataactgcaataaccaatgggccctcacaaatgggaaggagtattttacaacccacaaacagacaaccactgatgcagaggaacgcatcataggatctctcatcatactagcgatctgtgatccgtatatatggccactgattttgtctggagaaaggcaggaatatgggtaactgttatccactgcagtgcctgtcctcagtgtcctggatacacatttacacatactccgttcataaatataaacatttctaaattatttaacacatattaagaataagtggaaagactttcgctcatctcttaaatcaaaatttaaagttttaacttattagattccctttctaagcacctaacaattactgataatgcttagattttcgcacattagaaccggtatcttagaaatacttatattgtgcacaaaatataaattacagatgtggctggctgcatccatcagccagcccagcccgattctgatgctgatcgattgatgaactgaaagctgatgatatcatcttatctcaccaacactcgcacgaggcctgcactgttctacacacagatgttgtgcagccgctagctgcttcttctggcagctagctaagccttcaaatttcaaaaagagacacatggaatcatgcttgcgtggattaaacattgttaagcctgcatctcagatgaacaattatgtacatgttgatcgaaagaaagttggaaaacaagaggaaggagccactgcaagaatgcaggaagaatccaagaatttccaaataataatcaatataatgggatagtatttgtttgtcgcattctctcatctcagaaattccatcctcatagcataggggtaccatattttggatgcctttttttttcctctctctctctctctctcttttcttttgccttaagccatcaaaattcaactgttcatgtcagaatttaactcacatctatggtcctaaaaattcaaaaaactttaccatattattaattgttcacctaagttaaattaaaggcacttcaattcttgtcgtaagtgtgtcatttctttacaactaatgtcacgtactactatagtacttaccacacagtactgcctgttcatacagaagtaattataaacacgatttgaaaatttttaatattgcagcgtgactgatatcatgttccaagttcttcctttgatgtatataggcgatatattaacacctaagtacacgtactttttaaatcttgttaactaagtctgacatggggttagttagttctgcactgtactttcaaaactttgggattctctcatgttttctactactgtatttcatagctactactagcttctaacagttaatatgatcatatagcactaatattttactgctactagatggttttaattattttgttcaaaaatttgtggtgctgcagctgtaacaaaccggcatgcatgacgaacgagatgctggctcttagtgttgtccttaaatttgagcaaattaagtagtaggtgaatcttccacgtagtacgacgccctgagattaacattggatcaggaagctaagcatttaatttactgtgtattattactatatcaggtgtgtacttggttttagtgaagagcagctagatgtacttcagagtgcctaatatgggtagtcttacaaattgagattatataataatatatataaaagaaaaatgttgtttgtgccctgtcactgttgtcgatgcttatgtcgccaaaagatgaggatttttactgtataatctactggtaagtatatatactactgacaagggcaatttaaaaaaatattaaaaaaaagtaccaatttaattaagtatatacggatttatggaatctcggcacgcaatgcacaataggtatacagaggcaattctaccgattttagttttatattgtaatatattcaaatgagagggcaaattaatctaaaccttttgatcatttatactggcagaatactgtaaaagttctcacaactgtttataccgaaccacgagttaaactacatttctgtttccagtgttcaatctctcttgtagttttttatcttttcaactttttgtttaaatataataaaactctaaaaacttgtttataaaagattttttttgccaaaccagctttatgtccttttattaagtacctgaatgatttgtaataattatttgagatacaaatgaattaattaaaaaaatataaagttgaaaaataaattaaaaattactccctccatgctgataatattagtcgttttgaacaagggtaaaatcaatctttaaaatctttgactataaataatttctaaaatatttgtcttaaaaatatgaaaaccatatgtgtagtttagtattaaaaattacttcaataaaatcatatatatttgttgatatttctaaatatattataatagaaatagttgtcaaagctacttttttggagaccgtgcccttgtccaaaacgacaagtattatcaatccagatggagtataagaaatttatatatataattttttgagtaaatatttcttaaaactacaaatattttgattaaactatcgcaaaactacatatttaagatgttacatcataaaactacatatttaatattgaaattatcacaaaattactaattctagagtttaaatcactggcactattgttatgttggagctacaaacgttgttgttttgcgataattggcactaaacctgtagattgggatacattttttactttatttttatttttttttacaaccatcctaaatttgtagtattgtgaaaatttccgcgctaaatgtatagtttgtgatgcaatatgttaaatctacaattttacaataatttcatataagtatctacagttttatgaattttacttaactttttagcaaatactccctccgtactcgtaaaggaaaccgtttaggacaatgtttaagtcaaaccttgggaacataaatcatgaataactctcaagttgttgtgtttgaaaatgtaaaaattatatgaatagatttgtcttgaaaaatgctttcataaaagtatacatatatcacttttcaataaatatttttatagaaacaagaaattaaagttgtgttttggagaccgtgtcgctgttcaaaatgacttcctttacgaacacggagggagtaaatgtttagaagtttgagaagtgtgcccgtaaataggatggttccgttcttttctctctctctccctctctcttttaaaaaagaaaagaacacaaaaagttaaactgcttggatgatagggtagtcttggaggatgacatgtcaaaacgatctaatccggaaataagttctgcagaatttgttttcaacatttatcaagttcagaaattataaaaaatcctcttgtactttaataaaatatttcatccacttagggtgtgcattagcatatgattaaaattaaatagtgggttaatatgatttttaaagaaactttcctatattttttttaaaaaaaacatcgttttatagtttgggcagctagcgcgtgagaaatgagagatttgatattgggaatataaacttaagaatacagccttagtagtataccaccacctttgttgacaggtggtaaatgggtaattggcaggtggtaagtgggttaaattagagttatgtatgacataccatctttgttagcagcaaatctgccatgtaagtactgcactaataatttactctctgttcgaatatgatggagatgaggattaggtaagaacatgtaaaacgagaaatccattattacgtgattaattaagttttaatatttgtaaacttaaaaataattctattcgatattttagaaaaaattctagaaagttttcttacaaaaacacattatttaacggtctgaaaaaaatggctaacacaaaccaagatagaatctactgtacatcattcaaccaacagccaaactttctcaaaggaaaaaaaaaaggaaaaatccggtatggaagcatatgtgcaaaatgtaccacgcatcacacaaggagcagagagacagcattgaagctcataacgacgagccgtacaagtacgaacggtgttgctttgcttgctgcactctgcaagatttatatttgctggcctggtctgatctctctgcaagatttcgtttttatggctcctggggtattaccactgtaggtttaaaacaagcaaagcatgggtcactctgctttcttgtggtccagcttcttctgtgactctgtgtgtgtgtgtgtgtaactactgtttctctagtccttctcggtttccttcaaattttggtccacagtccacacacacaaacaatactgttaaggccaaaaagaaaacattgggaaatgtaagggagagggtagagagaacataagggcaatgtggtcactccatgatactatttcatctatttgactatatgtgtttattttgtaatgacaagttttaaagtgatctctactgatagtgtaatcaatttaaatccattatattttcttatctaattcattatatctatttatacttacaaatttagctactagtactacctttttttctaataacagtaaaactcataaatcgatggtttatatcgtttctaagagtaataatactggtggtagaatattagtaataggccacggtctaaattaaagataagttagagtagaacttctgttcaattgttcttttttctctcttctactcttcttaaatactacgtttacagtctaaatttaacacaagttcagacggttttagcttgtaaatatatcgattttaaacagaagatcatgttcaagaaacatatctgacgcttccattcgttttttttttcttttgattaacaggagaacaaaatatcctataagtttacagagacatagtaatccagcagagagagtaattgctgaagcagcagcaccagttacactgaacaaaaagaagcaaaagattcaatgagatggagattgatcatgtagccgaattaatacttttttccatgagcaatgcttcaatcagagacatttgaaaggactcccaattgattagccatatctgcaggcataacaaactttacatattcttttttcccttctgaattgtagtacattacatgagtttcatcaaccaattgtaggcttgttcaaatttcactgtcatccccaagcttaacccgggtgcattggttatttattgttgttgcacaaaagaatgcttaatgcactgtgctgatttctctgtctgcctgttcaacatatctactcggagttaagagcctatttttcagtcaggaccatctctgtgagagagacagccagcacaaacaattgtctgaaatgtgaaagaaaatctgttcatccaggatgcgtttcagtggccttcacttctctgctcagctataactaccatggacaccaaatggttcaagaatttgccaatgtgcaaagctcaggataccatgaaagttattctaccaatggtcaaatgcgataagtttcgaacattgggaatatagaatatttggaacacaggaatccaatatgaatttcatggttctcgctcctgtagaattcatgtgaaataacgattcaaaaaagaaagaattcatgtgaaagttcttatttccaattgggctataatctcttcatctgaaaacaacatgggtagtcaccttgtttgacaactagtgccattgaacactttgtcaataaatcatgtgaaaatttgcactactattaatctgtacaatcgtacatggcacacacaatcatacactcctgaattctgacctgcacctcctgatcacatagtttggctgatgaacaggtgagaattaaacgggcaggcatacttcctgcaattcagtgtgaggaaatcaaagggaatgtgctgttggtgtacctgaaaaaggaaagataatatacagtatacaaactccacaatcattttttttctcagaagcatgtgagagagaaataccttgcaaaaatgtatcaggaaatgtcaggctctgaattcatcagttctctcttcctccattcctcccaacaagagaatttactgcaaaacaacatatggccactccctctcagttctcaaggcacactctatttatgaattccccttatctgaatcacaaatactagtggctgctcctgctcagttcctaccagaattcagattttgcgcacacaaccaaagcctgcattttcatgtgactttgtcatggcaggaagcaacatcataataagttgctgaaatgaagatgtagggaggatggtacagcgatgatggggtgcagcaggaattgaaagcctgggatcattttctgacgaagcctgcagtgaattgatcaagagcctgccttatgttgctatgcaggtagtagtagacatgcaaaacgttggtaaaatgactgcctaattaaatggtttgcaagatcgaaggagaaatttggaagacaaatttacttatggttgcattgcgagctctggattagcattgcagctatgaaaaccaaaagaaaaaaaaaactcccaaatctctccacaggtaggatgaaaatggaacaggtatttcctgcccggccgccagaccagagactcgtgggaaggatatgaaagagaaatggggtttgaatccaaatccacaaaaaatattgattaggatgtgaaaatagttgtattcgtccgtttatcccgtattatcaaacatatatgaaaatttattctgaatcaacctacaaacataatggtacaatggttaatcactattttataagctcacaagtaatattacataattttttccttgatgtatcttctttaaaactctaattgcctccctagacttaatatctatgaatcaaagatacaatagaaattcgttcccgaatctgactcagaggacaaaaaaatatgagataagataaaggatgagtgaaacgttatccgggactatccgtacctggttctaaatttaaaggaaaatataggttaatatacgagaatgtcgtgatccaatcgttcctgacctaattttaccaccacaggaagtcccacattctcctgtctgttcaaaatttccgctacttttctaaaatattgacttttcatttcccatgtcattcgaaatgcatcataatacatagagctaacttcatattggaagagattgatcatttgcatgtaccacttccctttttctccctttgtatacatggcataaggttttatggggaatatgtcacatacaaataatataatccccatttttatacttctgcaattttttttcttgtgatagaaaacccaatttttttaatgagttgagggagttggttttgttagcagagaagaagttgtaaattgggatttatcgggccccatatcagaggtaggcccaagcggggaggaaggaggcaagtggagaaggggaggaataggatacaaagaagtgaggggataaggtggaggaagtggagcccactaacatgtgggtcctactattttttaatcttcttatttgactgatatgtggacccacatattttgttttattttttaaattattaaattttgcttcatgtgtcttgtagatatagaccgagtcaaattagccacgtaagtgccacttcagctgaaatgatagttgaaaccgtcttgggatttattttgcattggttttgatagttgaggaacccgttttatctggttttccggttgaaggacgaaaatcagatttgttgagaaggtaagggacctcagatgaacttattccattgaaaagtcgaatggcaaaaaggtaaacaggcctgaatttgcagcccacaatccctggcccataccaaaccaggcccaaagaaaacgtgccggttgattccccaatatgggcctcaccggcccatcttggcaacagcccattttaccacaggtaggcccaagggtaagcccaacccagtggcgcccttctgctttcattcatagctaagcttccaacggcttcctttcttccctccctcccctcttggcgctctcctcttcgcttcccgccctcctctcctccaatcctcgccgcctcctccccgaaaccctagcggcgctcgacgaggcgggcggaatccggcggatgcgtggagcttcgcggctcgccgtggtggtggggagagaggagggggcgtcttccccggttgacggagtcgcgtccgacgaggcgggattccgggagggaggagagcgcagcacggcgcggcggcggagcgagagattcccgcgcgtgagaggagcgcggaggagggagcttcttcggttcttccccgtggagcgcgcgcggctggagcgagcgagcgaggcggcgtcggatcctctcgcgcacgcggtttcgctggggattggtaagttcgtgctcatcacaacgtttctgatgccattctgcacgcagatgtgctggattggggattcttatggcggcttgattgtgtgcgcgcgcgtgggttggggattctacacgcagatgctggattggggattcttatggcggcttgattgtgtgcatgtggggggtacattgcatattgattatgtgtgtcatcttctcgcggctaatggatttgcattctgcattctacacgcactagattgcgggtggtagactctgttcttatcgtgccttccgcggctaatcgatttggtgggagacaccactgtggcacgattgatgcaaacgaatgctaaatatttggattagttcatcctttatcaatcagctctgctcaattgattgttcaatatgtcttaaatgcttattgggtacttcgtaactccaatgaagttataactatgaaatgtttactgtaaatatcttgtattctgttattatggagtatttatcaaagtacattcaattatcccttctatttttttgcttctaacttatgcatgtgtcctctggagataatattatgtgtcctctatcaagttctaatgactttccttttgatattgtttgatgcagctttattgtgatcctatataagtggtcataaaaatggttgttccacattgctacatttaccttatattgcctcttctatggataacaaatgcatccgccgttaccatcttcaatgtgaattatatgcccatggaagacaaggtcaaaggccgcaaattatcagtagctgatatccacctaggtggaaatgtacttcaatctgggtgaggaactttacatgatctatgttctctctttctctctctctctatatatatatagatcaaccgtttgtgcacttactgaattctaactttggttgcaacaattcatttcaggaactattatgctgaactgatacttggtgagccaccaaaaaagttcattgtgttgattgacaccacatctaatcttctgtgggttaattctatatcttgtaaagattgccctacaaaaagtgcatccagagtaattatctactgctttatttttcttaacctaacaggtatttggaggtgactaaatattctgaaccaattacacttgtgtaggtcctgagtttctatgatctggagaattcacagactggacaacttttaccatgtagtgatgttttctgcaaacacctatccagctccacatctattccatgccaaaaagaccatccatgcattcactttgaaaagtatggcactgaaaatttgctccacggaaaaattgtccaagattttcttgtacttgaaattgtcatcaaccattacaaaacaagcaaagtcagaactaaagttcaatttggaagcatttctcaacacttgaaatccttatcctcaagctttacagttgatggtgtgatgggcttggggccatccaatacttctctggtgtaccagctggcaaagtcccaaaaatggaagaaaatgtttgctcactgccttgatggcaaaaggagtgggggcatatttgtgttaggccatattgtgggtccaaaagttagaaaaactcctctggatcaaacaaggtacttgacattgttgtttaatatgactgtggtgtagatgtattcttaattgcgaggtgatattgactatggagtatttgccaacgctgtagttctaggtaccgaactactttgctggaaataactgtaggagaaacttctctaagcctttcagctggaaatgttgagataaaaagtcaaaacatgacaatattggaaactggttctctgatttcttacctgccagagaaagtataccagtcgtttctagattctgtaagaaaattcactttcctctttcagcaccctttgctacattcattttacttgtcaatatttattgtcatttttctgtacagatattttctgatcttgaggatatcagtgtcataaacattggaggctattcatgtttccactatgaacgaaggtaaatatgtttatgattttagagattattttttcttcttcggaaaaaatggcatgtgctttctaagttcttaggaaacattaatggtctatccttttttttgccctacattaacatcatgttccatgagataagaatgtagtttgttctataggtaatctgttcaagtaattagatatattaaattttcttgctgatagtgatagattaactttttagcaatatatgaacatctttttgatacattttggtgttgattgcacaatcttcaccaataaattgttcaaagtcacagaataacctcctctctctcactggtctggggagtggcgacatgttttgacttaatggggctactagtcctctcagtttttcatcttgggaacaagcgtaccagtttagctagatccatcaaacaaccagataactaatcaacatgttgtttttgttagtattgatgctaggtttccagaggttgtatttcacttcaaggaactgcttactttgcgagtctaccctcatgaatatatgtttcacaatatggaggtatttcgtaaagaaactatgctgttgctcaaatatgcactgagaaaatattgtgatgtatattgtgttataaactgtttctctttaggagcactattactgtcttgggtttttgagttcagaacaaaggaatcatcgagagaaggacttgttcattctgggcggcaagttactaagcctgtactagaattgtactatttgatggtttgcatatttgacttggtggtaggtggtaactgcttcttgcgattataaacctgtggtgcaggaaatttgttcactgataaagttgttgtatatgacttggataatatgatggttggatggaccgaatttgattgtaagtcctgtcaacgttttagcttcattgactttcaaactgcaaccagtaaaatgttgttttataccaggttctttcgaatattgtgtgcactgtatctgttcaggtaaatccagtgtgcatgtgagagacgaaccgacaggaaaaatatatgaagttggatcgcacaggatgaactccgatgtgaagtgggatgatgaagacgtgtggagccatgatagagtgaagttggaaactgaacatacaactccagctgataacacgtctgagaaaacagaagttcacagtggactgctttcacgttcaagaaccaggttgcttgcgatgattggtgctctggtgtgttacgcgagacggtcaataaccaagctgtttgcgatgattggtgcgaccatttgttacgggattctcttggccacgttgttcctctgcaccaccttccgtcgatctaccagctggagaaatatgagtatgctgaaatggttgttggctctagttgtgggggagattttggttatcattgtagggttcatagttttgtagacaaagcacatagacattgtttcccacagatatacagttttgaagaaaaagttttacacgtagtggatgacacatacaactgcaaacagccagtttgtatagtaccgcacaaaacactgaaacagggggtagagaaagttaactgtacatatttccttcctgttaaaatttgaatgttccattgattgtaaaactgaaacgaggtttgaataatggttggattgagcctgctgcctgcagtgcaaaatcgtgttcagttttggttgtgaaattggtatctgtaacttgcaatgtttgccgtattcgagaagcttttgtttgtgtaagatcatctgatgctgttcgtcttgtgaataacaataaaatctttgatgatatcattgatatgtatatatacttagaaaaaatgccaaagcattacaacgggtaaatgatattttaattttattatcgttatatggtttagctagggtaaaattcactgtgtgaatttgcatgaatattttttaaagaaaatcatagactgtaattaggagtttgtatttcatctcaagttagcatgcgggtttttttaaaagagatttcttatatgactctttttgtattttcaaaaacaaacaagcttaaaattcaactcaaatagggatatgcatttccaaaagccgcagagaaattaaaaaccgactcaaacgaggtaccataatagtaatagagattactttacattacatcgttatgatctcttgttggctagagatgagaggatgaatgtaacaggactgcaaagaggacggaggaagcgggcgagttcatcaatggtgaatccgaatccgaatgcatcgtccgcgagcagcagcgttcccacgctatggaagagccaggcggcggaggcggcgccgagcgtcaagtagtggtgcacgccggcgacgccgcggcggtcggcgaggcgaagggtgacgacggcggccgtggtgctgagccagtagagcaggtttcccgccaagaagtagcgccaccacatcccctgcatcctcgccgcgtcggcctcggcggcggccggcgttagtgcggttgggccgccgcagagcgggcgtcggggcccttggccaggtggcggcgcaggcattcttggtgcacggcgcggcggcggcagcacgccggcgtggccagcgtgtcgcccaccttgaactcgccgaggcaggcgtggcaccaccgctcggcctccgctccggtgtgcctcgggcagagcggcagcacgacgaccgcgccgtcgtcgtcggtcgccggtggcaggtacagctgcaccggcagccattcttgcgtggacgggcgttcgtcgtacacgccaaggtatcgcacgtcgacgaggaggaggtggagtgcgccgccggcgccatcgccggcgacgtcggtggcgaaggagcatagctcgtcctcgaggcggctgccgtcggcggggaggtcgaggaagcggcagagtgagaaggcgagccagcgccaggggacggacgcggccggcgtgggctcctgcagggcgaagcgcaggtcgacgacggcgtgggcgtcggcgccgctgccggcaggagggtggatgccgaggcggacgacgatttgcttggccaccgcctccgcgtcgtcgccatcgtcctctcgcgccacgccgaccgtgccgatggtgaccgtggcgttgttgtagtgcacgtgcaccacgcgggtcgccgccggcgacgatgccatcgccgtgttccgccgtgtgcggtcgcttattagggatacataataataataataattgtagttgatattaatttgtcgaaagagacgtattgtgttggagtcggttttacaatttacatcagatcgattgaacatagtactacagtaatttctcctgatccgtttagactttagagatggttttcgtggatatcattatcatctattccttccgcccagtaatataaaaaattgttatgccatttttagcaaatattaaggaagtgctgtaggaacaaagcatggagaaacatccaggggtattccggctagctctataaaatgataggctagatgatctaggttcgaagcttcacctcttctaattatttgacattagatcattccctgctatttacatcttttttaaaggaacacagcatgatataaaatatgatggttgggagaataaagtagtaaaaaaagatgtgggtcatctatatggaaccggatcctctgattctacgtcagagggacatccacgtccgatcaccgttcactacgcatccaacggcagcatcatttttaagctcataagcattggattcacaaaatgataaaatagcaagaaatcttagccattgaaatgatcggaatcttctagaagttgtaaaatacagagagaaggaagagtttgagccactcattgcgtctcattggttatctcatgttggcctcccaaagaagcctagggctggcttggcgtagccaatcaacccaaacgattcttagaatatactccatcagtccagaatataagaagttttagagttgaacacagttattaagaaagtaggtagaagtgagtagtggaggatcgtgattggatgagtagtggaggtagatggaaaaagtgaatggtggagggttgtgattggttgggaagagattattggcgaagaagttgttatattttgggataaatcctgatggctaaaaagttgttatattttgggacaaaggaagtatgaccaattaaataattttagaagagggaaaattattctacatataacactttatcagtcagcaacaatcaaaacaaatatgtagaaaaaaagttaacatctcaaagcttataacataattacaattatgatgtgcaattttactagacccaggatatttggaaccaaggtagtagtgaaatttaattttgattcttacaataatatcacaagtttagcataattatagtaaattatttatttccattacaatatgtatttattacatatcaaaacagtatagtatttgtattgatcctacacttccgaccaaatactttcttcgaatattaatcaagtatgtaaaacaaaaatatattttctaatagtgggggataaacatatttataatataatatgatgataattgggttacacagcaatagagataacatgattgcaaggtggtggcccaagcagtagcaaaaaaagacacttacagtcgtgcgaataaaaacaggaaacaccaaggaaaagataaatacaaaccctaagtctatacattaattattggtttagctgaatggtgaaaaaattattgttaattgtaataacagctaatagataggttatagtcgcgcgaacgtgcatcattcactagttgctttgaaacactaacagaaagggataaattgattgcgcgacgaaaaaaaaatatactgttatataaaaaagaatactagcttggaaattgttcacgcttagaaaaaatgatacaggccctcggcaggttttttctttctttctttcttcaaatgcaacacaaaaactctcttatgaacgcgcatggatctttcttcaaaatacaacacaaacacatacgcccatataaacgcgtacatccgtgcatatcatagtcaaaaatgaaccacgcaggcaaattaacgttgttatctatacgctctgtttcaattgacgcactagtgatcaatatcgatacatacattgttcaccaatcctcgatatataggatggtgacgcgcctcgctaaaggacgttggcctctctgcagcaaagacgtggcaaacaacgaattgaatgtgaggttgggaatttgtttgtgccggccggttacaatggaagagaacagcggtggtggaacagtctgatggattttaaacactgcaaaccagacacagatgcatagaattcctagagtcattttagtgcatcgtatcttgaaatcagtaacgtgctaagcatcatccactgtaggaaaaaaaatcatggccagaagtatccgaaaacaaaagggagtatacatttctcgcctacaaacatttcatgcgtacaatgcaaatgtttcacatcgtttgtacccatagagcatttcagattcagcattcctgttagatgggcaaacccaaattcctgaagctgctgaacagtctatgtctagtagcgtccaggttgacccattgatgtaccttgcttcattctacattgcatctcccagataggcgttgcaggcttgcagcacagggtgtcctctaggttagatctattgactgagtctgtagctccttcctctgaaggcgcctgatccggtgttggcggccgcgggtcggaccggagcgttcgcctgcacacctattctgaatcgagcaacaatcttatgtctgtacagcagttaaggaaccatggagcgtgtaccatcgaaaatatagtagtagtagctattgaacatggattgaaatgctttggccatgaacccatataaaaaaggatacacccacattggtgtcttcaggtagttctttccggtggctagcgggtgcaacactgagaggaagtagtacgtgtgtccaacgagaattcccagaaggccagggagtatctctgagccaaatatcacatccaacccaagcattgcccatggtagataaaaggactgcagaaatggagtatattaaccacaatcaaacataatttgctccacaagacttgaaaccaatattgatgacctataaagggcatcgagttctatatatggtagtagtgaagcttaccctcagttggacaaggccatacatgctgatctgagaattcggatattctctgctccagacataaagaagcatgctgaccatgggtactcccaagaaataaatatccaggaagggaatagctgacaatgcctgatccaagcaagaaagatttatatgtagtatgtgagtccaatgaattgaatttttaaggtctgattaagctgctaaaaatacagtacaagctagcactgaccagcagtgatatggcaccaaatatcatcatccacaagaaatcagctgtgcgcttttcaaatgcacccttttctaactgcacgccgtatcttgctctgcatgcccaaacacacaattgattcaaccaatggctgcaagtttacttattgtaatactctgcatgctttcaaacacacaattgatttcaacaagacttacatcatcagaaggcgaatcccaaagttgatagaaaacttgcccaggaaaaagaagcttgtaaatagcctccatatctgtaaggcccagaaacagctcttatattgaaagtaaaatagcaggagtgcaacaaattacaggtgccaattgccaacataagcataggacaaactgcaatgcttgattacattggccaaatgctaaacaaatttgttcatagggcattgtgtggacatacaacactatgcacggtatagaaggtgcatgtcgcaactaagtatcagttagtgtttgagaggggaatggggtagacaaacaaatcctcagtcctaatgtgtttttaaaaaattcgggtgcaaaaacaaggggcaacaataaactgtactggtagataacagaacagacaatatataaacatatgctgacctgaaatttcttgaacacaaagggatagtataaggcaagaaaaggtggattcagtatctggagctggcacagtacagtggcaaagaaacacaatgttccatatgccttgcttattggtggaagtgagttgtagtacctgaaaagggaaagtaagtaatcgagtatccagaagcagctgtagcaaagagttatgactttgatgtgttcatgttctagctgtaaacctcgattaactagtaaaaaattacatccatcagtgagcaaaaacaagtgcaattatcaaacaaaatgaatagtttatcaaatatgatctcgttcaaaatttctgattacattgtaaaccaatatgctaaagcatgctcaaagagagactgtcacactaacagcagaggatctaggatgaaaattaccggatgtcctgtacctatcacagttctaaaactaacagtctagttatatgctaacatggtctaagctaatggaattccaaactcagcctgtgtcccgtgtaccaggcaggtactatatatatcaaggatatcaactcaggttatatattccatatacattacagacgaacagtacttcccacgtgtacccgacaatagaaacaaactaacacaattgcaaagcctttataacagaagtgtcactcattgtcgattcagaaattagctcaatacttgtagcaatttcaaaacccatagcagagccccaagcagttaagaatttaacataggaaaacaaaattcagcaaagctaaatgcattttagaaagcgaccaaattatttcaataactttcaactcataccaaaacagcgaccgcctttaatgaccacagatcataagagcatacccaatggccaatgtcaacccatgctaccaagcttcaagccagagtttattacaggctgttgtattcaccgtgtgcaaaatttatcaacaaataagcttataactatccaattgtgcatctaggttttgaagacagtgaaatacttcaacaaataagcttatagctatccaactgtgcatctttatgttttgaaggcagtgaaatactataacatactctataatttatgcgcattggagaatgaatattagcagatatgtattggagaacaaagactgcaactatctaatttaggtctttactagtggaacgaaccgagaagtgtgcttctgactccaaaatttacaaatagcatcagatacaaccttcccaaccaaaacatcaatttgttccaggcgcatgattgtgctttagcaaggagtgtaaactctacaacgacaatacaataatatccacttgtaaacagccaattcatatacctcaattttcatcaagtttgtaaacagccaattcatagacctcaattttcatcaagtgaggccatgccaaggaatccgtcagaacactcctacttcacagttcccaccaatgctaaaattacttgtcataaactcgtcaaaatcatcaaaagtagtgtattaactaataagcttatatccatctaaagacacctgcagttacaacagcccaacccaaccaatcaacccaaaatcctacacgcgatctctaattccgaaccctaagagcccaagtttaaaccactaaattcattgcgccaaaaaaaaaactaaatacaccacaacgacccacgcctctctaaccttgaaaaatgaaactaatcagctatactcacgataaatttagcccgggcccctcctgtaatcccccctaacccaggccaacctcgagtgatctgagacgcggcatcagagactaacagaaacagatcggggggagactgagggaggctcactctgccggggaggacatctcgtcggcggcggcggtggcggcggcggcggtggcggcggcggcggattcgaagcctcctcgactccttctcgtcggcgtcgtgttcgggggagttcgaaaaatcgaagtcgaaggaggagaaaaataataatggggaagtcgcgttcgcttcgtcgccggggcggaaggttccagagtcgagagagagtcgagaaggccagatgggagaggcgggatgggccgtggatcctggatcggacggtcgaggatgctcggacacgtcgacgtgggcgatgcggggaaggcgattggtcggagacgtggatggggcgctgaggtggccggggtggcgtggcagcgggcctcttagccgttggatcagagtgggatcgcttgatcctacggcaggaaacaggaaacactgtacgagcatataccgagagtgaacatagaaataagaaaaatataagaatataatagaattgtatgtcgaaaacacagagaaactccatttataggataatgcttaccatcggccgtccggccagaaagaaaaaatcgagcgtcccaattcaaaagaacaacaatgtagatgcatggtgaaccagttcgatagatgtactcacaagccaagggagcgtgcatgcaagcatgtttcaaaatttaaattttttttctcttaaactatttatttgaatttctaactaattatattattagattcattgcaattaaatctttgtaacaagatatcacatgactacattccgatgacttttttttactttttaaatgttgcatacattgttaatgaaatgttccaacaagtatctgttgatgtttcactaatgcatttgcaatatttcatattatcttttttatatgtttcagcgaatacttttttatgtttcatcaataataataattcgatgtttcaagctaaatataaaaaatgtttcactagtcgggacataatgtttcatgtaataatgattattgttgcagtcaatactttttatatgttgcatctcttcgaaacaatttatgaaataggttgaaacatctccacaagtgatgaaacaaatttattaagtatttgtacaaaatattttatgtttcatatgattttttttatgtttcactcattggtatttagtgtttcgtgtagtagttgtgattgcttcatttagtaatttctatatgatgtatttctcttaatctgaaacatttcaccatgtgagttgcaacgtgatgaaacaactttccatgaatggtgaaacaatggttgatttttcgaagcatatgtatatttttattaaaatataactatgtgagattttgttataaatatttaattacgatgaatctaatggtataattgaaacttagataagatatataatttcagagaaaaaaattaggcacatgtaatacgagggagagagagtatgcaagcagcagcagcacaagcaacatgtacagggcaggcaagcaacacggcaagcagcagcatatgcagccaagcaacgcagcaagcagatgtgcggcagtgcgtggttgggcgtccgatatttgtgaaatattggacgtccgacgcgtagcatcctccaaatttataggatgctttgttgtttggaacacaagtttttttttaaagaaaaacacatggatgttatgcctgaatacaagattaaaattctatcctatgataacgagagtgataaaaaacaataacgtcggagagcatatgttttagaatcctttagagatcctatattttcatgggaatgtctaacatgtcagtagtggcagatctgaaagatcatggatcctttaaaaaaaccttgtgaaaacacgctactatgagaaggttttttttttggataaaattttttcgctggtggcacagtctgccgcctgtgacaaataaccaatgaaaatagagccttttcacctgcggacgactagccaccaatgagatcccctcttcacaggtggccatgcttaagacggtaacctatgctaaaaaaatcatcacaagcgatgagattacgctggccgccaaggatgtcgtcatcgttgtcactgagccgcaaccctagccgttgtcaccaccatgggctaacgtcaccgagcctgtgtgcagagtcattgccgaggaccgtcgctgccagatctgatggtcccacacactatcgtcagtcgtcttcttgctccccagccagatcgaccaacggggaggccggggtcaccaaatacccagatccggtggcctcgacctcctcattggttgatgtggtggtggtacttgttgacggcggtttcctcatggcaacatgccacgacagtagcgcgattaggcgttgtgccttaacggcgggtgtagggaaggccaaagatggagtgagaaagatggtaggtatgaggggcaaggcaaccgagggatggagggtgaggcaggaccttttaatatggtgaaattttatcgcgagcgatgctctttacctaccgccagcgaaaacctatttttactagcgatgcttaagaggttcgcctcaaaaaataacatgtccgccaatgaaaatcggctttttctgacggcccatgacccataatcctccaatacatttttataaatgtttgtttcgcttctccgccagaaaagaggcggcatcataaaaagttttttatagtgtaaatcacgtgacaaagagatagaaacgtcggctatttaatagatagataaaataacggtttgtctagttaaatcataaaaataattatttaaaaaaggaaaaagtacgaattaccccctcgaaactaggacgacggcatgaattacccccctaagccacaaaatcagtcattttatacgaactagctataccggacgaataatcccctcgaccgaaaatccaaagcggtatcgtcctacgtggcgtgcgcgtgttaatctagtcagcattttttttaaaaatggtggggcccacctgtcatactctcccatctctctcttcccctcttcctctcaatctctctgtcaccgtctcagatatcgttgggagcgacgagttggtggccgacgatgggcgtggcggtggcggggcgggcggcgagcgcagcggcggggtggtggaggaggaggaggggtggtgttgttgcctccgatgaacgcgatggagatcctgcaggagatggtgcgcgtgctgcgggcggacccgcacgcgttcacgtcggtgctcttcttcctgctctgcccggcatcggtcggggtgcctcctgctgtccaccgccgcgctggagggtgcagccgtgctcccgttcgcgcggaagctactcctcgcggcggtggcgtcggggctcccgctcacgcatttcgtcaggcagctggcgcaccaccttgccgccaccctcatcgcgtccgttgtgtcattctcggcgacattcacgctcctcctcgccacccgcgccgccgttgcgtacgcggtcatggcgtctacgcgggcaagccgctcctcgccggcgccaagcctgcctctcctccttcctcgccctcctcgtcaccgcgtgttccacgctcaagtcgatgctttacccgcccgacattgtcgtctgtgccggcctcctcaccgttctcgccttctccgtggtgggggcagggcaagcggcaggcgtggcgggggcgcggagggcgtggtggagaggtgggcggtggcctgtggccagcgggagtgacggtgcccgtgtccccctgctgtcgcgccgccccgctgcccccgtgttgccgtgccccccccccctgtcgcgacggagggcggtgaagtggcgagggtggaggcggaggtcgttttcgcccttccgctccgagcccccggtggccaccgccaccgcgcccgagctcgtcgtcatcgtcttcaacctgggttcgtcagtctctctgtctctctcaccctctctctcgggctgtcgggaggtcggcgcgcacggcggcgggtcgacatggccgtggccgctgcccattcccgtgctctaccgcagccccccgcacgccgaccgcctgtccgcgcgctgctgccgctgcccactgcccgtcgacgcacgcctgagagagaaaaggggggaggggttgagaggtaatgacatgtgggccctatattttcttttatttctttttgttgattggatttccacatcaacgccacgtgtatgccacgtaggagaaaaacagctcaggattgagtcgggggagtaattcatccggtatcaatagttcgaggtgtaatatgtctggttttgtggttcggtggggggaggggtaattcgtgctttttccttttaaattaataggtatgtactcttcaccgattgcagtagcaccactatgaagagtatgctttaaagagcttaatttacttatagataccaacctcatgcattgcagtgggattttatgagaaacattaatctaacagctgatggctcatagacaatttgatccaatgatagaagcaccagtttgatgatgcattaagctcccttatactccctctgtccctacatatataagggattttaggtgatatgacgattcgtagtcttaggatacgtctcatccattcaaaatcttttatattttgggacgagagaagtaccaattaatgcacctaagtggtggttacatagaaatagaggattagttttcatgtacaatattatatctctgactacttcttctctataattcttcatcatttcagaccctgtttagatcaggggtgaaaaaatttggcgtgtgacatcggatatacggacacacatttaaagtatcaaacgtagactaataacaaaacaaattacagatttccgcctgtaaactgcgagacaaatttattaagcctaattaatctatcattagcaaatgtttactgtagcaccacattatcaaatcatgtaacaattaagcttgaaagattcgtctcgtaatttacacgcaatctatataattagtttttttttagggtttagggttaatactgtatgcatgtgtcgaacagggtgaaaagtttttgcatggcaactaaacagggccttagtcaagtgacaagttactctcatggcacatcattgtgtataggactgaaggaaaccctgctgttggcaagttgtcaatgtctttttctaaaatgggctgcatgttatcaaggtcttttgtcgcattgttgacaaacttgtatatcgccacctacgactccacgggttttcgatgtgactttgtttggcctccattatttacttcttcttgtaccacccttgcctcatagttcattccacatagaatttttacacctttagtgaacttccaagttcgaaggcctccatcactaatatcattaacacagatagtgaaatttagagaattatgggaccgagatgcaagggaaaggagaaagggtatcatgagagcagaaaggctcacaagtgggccaacctcattggcatgtaaaatacatgcatatataaatgtattttcttgaaaatgttacattgaatgacgatattttaagggcttattgggctaaaggtttactctctccgtctcaaaatgaacaaacgggatgtgaaacatcctaatactacgtatgtggacaagcctacaagaaatttcatctcttacattatatgagtaattccatatatttacactatatattgcaaatcttactaggaaagaacgattggttgcctatttgatttcttaaaactgtactagataaattaacacataaataaaataaaaatgaaaaacataagtcacagagaagagatagcatacaaaggagagagatagcaatcaaatgttgaaaaaaaatgttacggcatttcgtgaaaaaacttttaattatataaagattttaaaaaagtcaaataaaactctttttcaagttataataactaatagtgtgctactccctccggactgataatacttatcgttttagacaatgatgaggttaaactttacaatctttgattataaattatttttaaaatatttgtctttcaaatatggtaactacatttatagattagttttaaaaagtcatatatttcttaacacttttatacatattataatgaaaaataatagtcaaagttgtttttttagaccgtgcccttgtccaaaacgataagtattatcaacccagagggagtaatagcttgctctggtttccgtgctcagttgtttgataggaatgagtgcagcctcaggctgtgttcagtggtgggtgttggaaacacattacccacgcacggaaaacggaccgcattagcacgtgattaattaagtattagctatttttttcaaaaatagatcaatacgattttttaagcaactttcgtatataaacttttttaaaaaaacaccgtttagtagtttgaaaaacgtgcgtacagaaaacgagaggggagagttgggaactcatgtaccgaacacaagcctcaggctagattcgattgataagggtaggggtgaaaacagtaacggtaattaccggccgaccggcgttcgttttcgactttctaccggccgagccatatggaaatggtaatcgaccgaaacaaaaatggaaatggtaaaaaatatggaaatgaaaacggaaatggttttgctgttataccgatcgtgtccgtatttaccgtattctcgcggaaattaccgtttcttataatatggtaattaccgtattctaaatatgtcgatattataggacatgtctatacttaacccacagcttatagattgaatgactcttcaataaaatctctaacttttgtacatggctaaaatgaagttaatttataatttatatagtataagcttgaatttatgtatatatatataacatacttatgtaaagttaaatatatgtttttatagtttaatgtttccgtatttgttaccggtttccgatctgtaccgacatgtttccgtccgtattgttccgtttccggttttccgatatttccgatatcgtttttgtttccgactttaccgtttccaatttcgtttccgagaaaaatatggttacggaaatggttgaggctattttccgatcgtttccgaccgttttcatccctagataagggcatcaccaatgtatatttaccaactagtaaataaggtgggacctagtaaaagtaggtatttattgttaaaagtttcacaatgtataactagcagggttcactttctcgccggtaaccgcgcggtaaccgcggttaccgggcttaccgtggggggtcggtaacgaaaaccggcggtagggtttgggcaaattttgctcaaattcaaaaatttgaaaaataatcgaaaaaaatcaaaaaaaaatcatggatgtaaagcttgttttgtatgttgttatggtgaaaaaatttcatcaaaaagatgcaggtaaattcaaatttgagcgcaaaacctattgtgaattataaaaaagaaaaaagattaaatggaatgggccaagtatgcactgttcacgaggcccaataaggcccacaatgggaggaaaatatctttggaagcctctgcttcgtttctctggcgaatcctaccgtttttcccctctctcgcgtagctgcgctcaggaccgaaggggcgacggcgtgcgcccgcgccagatccgccgcctccgcgccggcgaggccggttcccgcgcggtaagcggcggtaaccgcgcggtacgcgacggtaaccgcctgggtcgacgggcaagaggtaatccctccgttttgaaggttttcgcgcggttaggagcggtaaccgtgcggttttgtatggttaccgtcggcttcgtaatctatgagacgatatacgtatgtgcggtaatcgtgtgaaaaccgtggtaaccgtccaccctaccatggttaccgtggcttgaaccgtggtatggtattttttactgtgatatgcatggacatatttggggatttaggtcaatagaacatatttttaccaatatgcatgtgaaatacattgggaatatgagtttatttcggcatttggttgcccgtgcttggctaaaaccatgcatgtgaagtatatttgattgctttggtctatgtacatataggttaaattaaatacgtcatagtatggaagaatttggatgcatgcttaccagtgtacatataattacgtcgtattattgcataatgggaggtatgtttataattagcagtgataatttctcatgcatttgatacagggtggagatgtcagatagtagggaccctgtgtgggagcacggggagaatatcccacctggatggcgctgtaagtattgccatacaaagaggggcggtggtggggcaacaagactaaagcaacacttggctgcaagagggaagggggttacatattgcaattcagtgcctccggatgtccgtgagttcttctgccgtgagttggacaggataaaagatgcaggtgaccagcgtaagagtgatagcggaagaagggttgaagcagcaagggtcaactattatgacctaacaggtgatgccgacgaggaggaacaaatggaagcagccattgcagcctcacgacaagacgaaaactttaggagggatgttgaggagcgtggtggcacttatgagcatggcggtgggagtggatccgctcagccggaggcacggaaaggtagaagtaacccaatcaccaatatgctacgaagggctacgtctcatagggagtcacctgctgtgagagattacaacctagcatctgccaaggcccctgtgcagccacgcattgacacaggattcttcacaaagaaggggaagcaagctaggcaagccattggtgagtcatgggcaaggttcttctttaccgccggcattcctggtagaaacgccgataatccatactttgtgagcgccgttcgggagacacaaaagtggggtacgtatgcatctattaaggaacttctttttttctaactcattgtgcactacttatttcatacgtcaattgtaggtgaaagtgtaccttctccaactggtaacgagatagatggaaaatatcttgattctacagagaaggatgtgaagaagcaatttgataggttcaagaaggattgggatgagtacggtgttactataatgtgtgattcttggacaggtccgacgagtatgtcggtcatcaattttctgatatactgcaatggaataatgtttttccacaagtccattgatgcgaccgggcaaagccaggatgctaactttgtgctgaaggtatgtatggttcatgcaacaaattacttcatcacctgttatcgtcagtgttaggggcatggactaatttttattatgttatctaccaatgcaggagataaggaaggtggtacgcgaaataggctcggagcatgttgttcaaattatcactgacaatggctctaactacaagaaggcgtgcagactactacggcaagaatacaagacaattgtgtggcaaccttgtgtggcacacacagttaacttgatgcttaaggaggttggaaaaatgccagaccacgaaatggtgattgagagtgctaggaaaatttgcagatggctatacaatcataacaagttgcatgctatgatggtcttagctataggtggtgaactggttaagtggaatgctacaaggttcggaacaaactacatgtttctccagagtttccttaggaagcgagatcttttcatgcaatggatggcttcctctgtcttcatgcaaagcaaatttagtgggactttggaaggtagatatgcacatgcatgtctatctagtctgtcttggtgggagaacttagaggcagtagtgaattctgtccaacctatgtactcattccttcggtttgctgacgaggacaagaaccccaatttgagtgaggtacttttgagatatcagttgctcaaaatggagtacgacactctttttgcgaatcaaagggacaagtttgaagcatacatggagatcgtgaacagaaggatgcacgacctaaccaatgagactctcatcaatgccggtaaatattggtcataacataatccacatggcatattatgtaactcttacttaacatgtgccatgttttgtagctgccgcattgaaccctaggacgcactacgcgtattctccaagtgctactgtcttccaagacctccgacaggcattcgagtggatgacggatatcgatacggctgccgccgctttgctggaggttgagatgtaccgacgtaagacgggtgaatttgggagggcactagcaagaaggatggccatagatgggaaaacttcacctggtatgtttctaatcatggaactatgatatatctaattgatcttgatgtattcagaattatgaaatgacatgttacttggcttttgcagcacaatggtggtctatgttcgcctcagacacgccgaatttgaagaagcttgcgttgcgtttggttggtcaatgttgctcctccagtggatgtgaaaggaattggagcacattcgcattcgtacatacgaaggtccgtaatagacttacccacaagaagctcaacaagctagtgtacgtgaactacaaccttcgccttcgaattcagcaagcaaatgcccaaattagggtggaggacgatgatccccttcaaagattagcggacctctcattctatgaaactaacaatcatatcagtgcctggatggacaatgctcgctctaatgcttgccccgaactagatgaagattcagctgagagtgacgctcccctgcctagtcaacttgtgtctgacctagtcaacttggatgacctgcgaaggaccacgggagcttctagtattgctgagtgggctgatacgaatgtaggtgacactcatattgggaaaaggaagactcgaaagccgccaaaagcacgtccatctaaaaaggtaaagggcaagggtccacgatcgactagtgttgatagcgatgaagagacccaaggaagcccagagtaccaagagtccaatgatagtagctcaagaactgaaacagatgacggcgacgatgatggtcaaggaggccaaggcactactaatgtgcctcctaggggtcacacccaacaatcagatcaccacagccccgttcaattcactggtgtgatataattcagttgcaatttcaaccttcatcttccaattcagtactggataattttcttgcaattttttgatttgcaggtgagggcgacttcactcatgctactcaggaccaggatcatggtgctccaagctctcaacgaactaccattgcaccgggagtccgacaacagcaacaattcagtgacatacaacaggatagctctagctcattcagtgcctctagctttgaaagtggctatccaacgtatgtgtacaaccgtccccaagcttctgattatcctgctactacatgggtgtatgaatggcaagagcctcagtggtatgctcaattgtacactcagtggcaaacaacatcatcatggacaggtcaaagttgggaggaatacaaggcggggttgctacattcacatggcttgatgctcatgtccacagaggagtacaatatggcatataatcagtagaatgcgtagctatgcatgtccttgtttatttcctttcattcgaactagaattgtaatcgtggacattatactgtggactctacaatatagagtaggtcatgccgaatttttctgttgtataaccacatcttaattaactaaaatactcacattttagtttttttctattatttttttcatttttcttatttcagttccaacataaactaaaatactcacattttagtttttttctattatttttttcatttttcttatttcagttccaacatatcgcggttaccgtcctcttaccgcggttaccgtaccaaaccgtgcggttaccgtgtccataccgtggatttttaattcaaaaatttgaaaacgaaatttgtgcgatttttcgcggtaaccgcacggttaccgcggtaaccaccataccgcggggggtcggtaaccccccccccccccaaaacggtaaggtgaaccctgataactagtcataaggatcaatacatgaagggagagggatgaggatcaatacatgccaaaagaatcaatgtttttttctccttactagtcccttcttcccaaattgatcatcatgtaatagaatccaaaatttctcaaattgatcatcatataactgtatggacacggatttcatcagagtacaattaatgcagtgtgggagaatgtgtacatgctatggtgtaattggcatggagttttaattgatgtatgcattgtgggagaatgtgtgcatagtgtcttgattgatgtgatttaaattattcttcgtcttggtgcctaaacttatatgatgatcaatttaggaaggagggagtactaggttgcagtgctcttgtttggtaatagctatttactggttccacaatacttaggctccgttcgttccagggttcccaacctccctccctcgttttccacacgcacgcttttcaaactgctaaacggtgcgttttttgcaaaaaaaaatattctatatgaaagttgcttaaaaaatcatattaatccatttttgaaaaaaaaaatagtaaatacttaattaatcatataataataggtgctttgttttgtgttccggggaacccctcctcccgaacacagcattactagtacttggtatgaagattaaaatattgcctattatctggtttgggagcacattgtggatgccctaaaccacaaagaaaggtccaacaaaaatataattccagtaggatttttatatttctactttcagtagtttaaaaaccaagtaaacaaataggaaacaataaaaaagttggcattaaataagtatggaaatttaaatttcagctacgagttataagccagtaagcaaataatagggacgaaagtttggaaggccaattagaagtgccttgtaacccagattgagttttttttagcagctcaatcgcttgcaggaaaactctactactttcatgtactctctgtgtaaaaaatcaacttctatctacaattctactatggtccccatcgtttggcatattcatatgcttatcagccaaaatttgaattttcaacgttaaatttggagctgattttggggtttttatcgaagtttattttttagctttgtttttagatcgctaagaacacatatataaaaattttattcacaaattacttttcgtttgtaaatatgccgtttggcttattccactaatatgccaaacgatggctccagtccagatttttttggggggattttaataaaggaggctgtacgctgtaaaaaaaaatatctcccgtactccgtccgtctacaaaataatctaatatagaatgtgaactatcttttttttaaaaaaagaatgtgaactatcttaaaacaatgaaacaatgaatttagataagtgtttgtctaaatccatggttctattttgtgttaattttttttggaaaacgaggcagtacgtggcaatcacatgatgggagtagatgagaatattttcagtttggatccggtcgtccgtccacggcgcgtttggcaggtcaggtgcatgtgccggaccagcgggcgttcgtacaggcagttgcgatccgattctctgcacccccgatcttatccagacgccacgccccaaccaatcgacatcacacggtacgaaccacggcagtctcgtagtacagcgtacagcctccggtttccgcttctttctttccagcctctttcgtggttagagagaggcagttcctgtattttgggttttgtttatgcagagcatcaccgacgcattgccaaaacatttttaatcccctaaatcttttttaaatctttaatagtatgatttaagggataaaaatatcttttccttcgagacagcttgatttaacttattaaaaaaaaacaggctatgtaacttccaaacaaaactggtctctttgagagacattcctgatacgtggaaaggtggaaagcgagatttaaagagaaggaatgttttctttatataatgagtttaggaatattgttggtcgttaattatatgggattgtgagtggtatataggacaattgttagccatgctcttatcactaattaaaaacatagctttagacctaatttaagggtagattaccgagtactttcttcggtctcaaaataattttattttttacatcttattgtcccagataacttcatcttttaataatttaaaatcgttgtactagagtttgtgaaagtgggaggtttattaaagtgagaaattaactatattaagatttattaaagtggaaggtattctaaattctcttacctttgtattggtgtgtataggatgtgtggaaaataagttatgttagacaaagggagtgcattattaccgtggattaaatattttaataagctaactgcacctgttttttaagttagaatattgtggcatagatatgataaacacgtgacgcgtgctaaaataggagcattgcaaagtttgtgaaaatgtatatgtactatgttcatggtcaattgctcgtatttttgcatgtccgcgtcatgaattagccgacacaaagcttgttccttgctcgctacttaaatctgccttgttgactcgttttcttctgtccagcatccgtgggctccaagaaagccatctagtggatcttcatatcgtcctacccaacgatctgatcgctgctggagaaaaagactttaatcccggttcgcaactgttttagttctggttgtgtaacagggacgtataatccggcatatttattccgggactaaagatacattaaaaaaatgtgtggtatgtgggattcaaacttaagatctctcatctcagcccttacgtgcgctaccatcgcacccactacacatatttgatttggatagagacgttttctttttaaactaaccatggaatcatctttagtccgggctggtaacacgattcaaaattaagatctctcacctcagccctcacgtgcgctaccatcccacccactacacacatttgacttggatagagatgctttctttttaagctagtcatgtagacatctttagtccgggttggtaatagtaggcgggactaaagatggatgattttagtccaaccgggactaaagatcgttgggggcctgacatggcctgacagttattgaaccgttgctaaaataatctttagtcctggttcctatttgaaccaggacaaatatgattttcggcatcggaataaagatcagttctccagtagtagatagatttttagacgaaactcgacgttttggatatagagaaagaagatggaggaagcataaataccggtaataaagtggaaattaatgtgatgaatcactaatacagaaaccgacataggtgtctgctgggaaccagctataggtgccggttttctaaccggcacctattggtcggcaccaatacaaacagccgacacctatgcggaaaatagaaccggcacctttagctttgctcgagccaaaaaaaaaatagagagagccagctcgaattgagccgaactcaccatccacactccatcgtcgttcctcccccgagcccatccctactccccttcatcaccgcctcttggatcaagatcaactccaacaacaaactagtcatcaagaactagcgagtagtacaaagcattaagaactcaacaagaaatcaaaaagagaaactcaagaacacatgtcacaggggtttcaaaaaagaacacatgccactggtagccacctcacccacgccaccgccgtccttttacacactcaccgtcgtcgttgcatggggagggcacggccgctgccgccgtcgaggtgtgccaccgctgcctccgccaagcgggagcccgccgccttctcgctggctctcctcccgctggatctagaggaggggagggtgcggccaccgccaccacctttgccaggcaaccactggccatgagagcccgctgcctctccaccggctcccctgtcgccgaatctagtggaggggagctcgccgtctcccctcccaccggatctagcggaggagagggtacagccaccgctgacacctctgccaggcagccgccggccgcgggagcctgccgtctctcgcctcctccccccactgcctcccctcccgagtgctcgccgccttcgctaggcagccatcagccgcaggagcccgccgccttgaccgggcagccaccgcaagagagagaggggagggagagcgacgtgagagagatgggaggggagggagagagagacgagagagattgagaaggataaggcaaagacgagtagataaggacgcggtgggtgtggtgcgctgatggctcggcttaaagttataggtgctcttttttaaaaaaaagtacctataatatattataagtaccggattttgaatgatacattttaagttgctgtgtactatatatacacgagaaaactcatttatataggatttgttacccataagttaaccgcacatattacataacgctattttttttgagtcggaaatagtacctacaactcctccttcaagatccttaggaattacaaagtcaggtaaagttcatacccattattactacacagttacataacctttaccctttttaagacataaaacaggagataaaaatgctcaaactatttttatcacctgacagtgacacgtggcacgccagaccatcaaacccaatccatctctaatctccatatgatatcccatctataaatttcacccaaaaacctctcctcctccaaaaacaagcagcgatcccaaaaatccaagcagtttcctcctctccaaaccaggctcatctccatctccttccccgcgcgagagagagacccctcaccttcgccatggacggcggcggcggcgcgaagaagagccggaacccgcacaaggcgccggcggactaccgcagcgaccgcaagtcggcctccgggatgagcggcgagcccaagaagggcggccgcggcggcaagttcacctgggagggcgccgacggctacgccgacgaggacctcgacctcatctcccccaagaactccacctcccactccaagtccgccgcttccgccgccgccgccgacagcagcagcaacaagaagtccggcgacgacgagtagtaggcaggcggccgccgcctcccccggtgtcgctcggtcggtgttcatcccctcgcaatcctagctgttcttggaataagtgtgtcgtgttcatcggtagtggttggatcgacgggccatggggatttgtagatatatcatcattatctatcttttaactcttgctaatgttggagtcttcggttcggttctttggcctaaaccgatttatcttttatctcagccgtattagcaattgaaaatcctgcactttggttgaatttgctgctctttgttttcctgatgaatctatcgtcttcagtactcatctgaagatatttgcagctctagttgacgatatttactgaagattgcaggttataaatttaccagatactctaggatcaattaatcctagtgctaccaactctgaattatctgaacagaagatggaagtttcatgaatcggtgatctgatctaatcagtatctgcagtgtgatactgtgaatctgtgatacacaaactgacagtaatgacaagtcgctctcgtgattgcggcatcgcggtccattcattgtccaaggccgataataaaaagaatgattatccgtcatcatccagaaccgataaataaagggaaatgattatccaaaaaaaaatcatctatggtctattgcggtattgcctattggtctctcaagtcaactattcttaaccttttttttctgggcagactgattgcactgcactattgcactactggttttgcgactatcttcagtggacagtggcctgcagcaatgagctgagagaggtaggatctaaccaaaaaaaaaaaacacaccattgtgtttctgtgccagaattttgttggatttttttaataaaaaagttcaattcttgtaagaagtggaattttttttggacgtttcaactaatacaacatattaactactacccttgaaccacacttgacacttcccttcctttttcttctttccagatttatttatttatttattgattcaatagcaacattgaagcatgactgcatgagcagtagacactagactgtggtcgccaatttgtcgccattgacgggttaaagctgtgtatatggccgattttaacttgaaaatatagcagaattcagttcaattcagtttttggttgagctgatcgatctcgatttctggcattcgctgacatgctgttaccattgcacatctgtgaagttatcattgagatgttctaatgtattgaaacaaaagtgtgaccgctttgcacaagttttaaactcgtgtcaataccagagtttacaaaaccgcgcggttactgcggttatcatacatggtaaccttttcagtttttaaaatcatggtatgtctcgcggttaccacgcggttttcgcggtagccaccttaccgcgggggtgcggtaaccgcgccaaaaacaacaaggggaatcctcgtcaatactcaatagttgtgagttctgattaatcaattcatgaattttcagttgaagagatgaaaacttgtactgtaccttttagaacaggggccaactgaaggatccaaataaaagagagttccagctagctttgattctaccccttttcaatgagaaaattcgacctatagcacaggaaaaaaagcggtaccaaaaaatagcataaaaagttcccactttcgatctatagcataggccaccattttttttcgcccggtagcacttccgtcgcattttgaagtaacggcgttagatcggagtggagaaaatttttgtcggactcatttacccttcgttccccacgtgtttggccgcgtgttcggtgacgccggcggcggcggaggtcacggaggagtagaggccgctgcttaggaggctgttcctcgaggaggggcggaactcgtccgtcgggtcgtcatcgtcgtcgtcggacatcgccgagctggacggcatgtcgccggacagctactgcatctgggtgtcctcgccgtcgccagcatcctcgccgtcgcgccccccacggaagagcgggtcgacggggtccatcacgcggtggcgccgcatcagcgagctcgtcatcggccgcagccatagcgacggcaaggagaagttccgcttcatctccgcgctgtcgtccctggccagggagcaccccaaaccgaagcccacgacgaagggcgccaccgccaccaaaccgcattcttcactgacggcggcaaagaggccgctcgaggacgaggacgacgatgatgacttgggcggccctagtgtcaatgtggatggatgtgggccgttgtatgccctcgggctcatcagctccgtcatcgccgacggcgctggcaaacaccgccgtggtggtcgtactcggcgtcgcagcccacacctccgccgtcctatccctgctgctgctcgccgtcgaggttgccgcctacctccaggggtggaacctcgaggaggtggcgtcactccccgccgtcgacggcctcttcgccgcgcctccattgccctcttgctcgggaagaagggcaaatgagtcatttttcatgtcgactcacatgtttggatggcaaatgtgacgggagtgctataaatcgcaagaaaattggtgtcctgtgtttctggtcgaagtagaaaatttgtcgtgctattttttggtaccgggttttttcctttgctatggatcgaatttactccttttcaattgtaattggaaaatgtgtagctagatcatgtcaaggtgctacacccttttccaattgtgcttttaaaaaaaagaaaaggaaaattgtgtagatagatcatgtgaaattacgttgagataatttgaaattataccttttcgacgaaaaccaaaatattttgaggtttcggcacgggatgaaagcaatttctgagtaaaattctacacttgaccaaaacttaaattcacaatagtaaatctaaacgaaattcatcgaaacttaggtgaactctaatactagggtaaaaaagaaagttcatcccacggtctgcacagtgcatcgcaggctccccatcaggaaaaagaaatagaggggggcctcatttcacgctcgcagaaggcaggagaaactcacccttgtcaagatagcatggggcaattctatttcttcatgttggacatccacatagcacacaaatctaagtaaacaacgataaattattaaaaactagtggtaggtgagaaactggaagagaaattaaacttctaagaaatcttttatatcaaagttagtgataggggagcatagaaagactaatgacttatgttgactttggagcctaatggtagaggcgtgtgtaaccatgagtccaccatcatagtagaaaataatgattttgcaggtatttactgtagcaatgttgtaaacacaggaactatgctaaacggtagtatatcgtattattatttatttggtactgtagcatactgtaacgatcaatctcgttcgtttgctattcacctttaactttaacaagtcaggggatctcaatccattaacgtagaggcagggtttatgattccgatgaaatccgaccagatttcacgaaatttcgacgtttcaacgaggcttggaagtagaaaccgtctgagatttcgagaagtttcatccaaattcaaatttgaattaataaaaaaagaaaaaaaagaaaaaaaaacttataaatactatgatatttataaaacctattgggatataattttttgaaaaaaattatgtattgtgtgtatttactgaaacttacatcaggaaagaaagaaaagaataaaaaattaagaaaaagaaaaacttacatgggccaaaaccaaccggaattaaaaaaaaggaaaacacttactaattgaaatttcgatcggaatttcggtaaaaccgaccggttttcgagaacttgtcggcaaactcgaggaatttgtattcaaattttagtttatgaaatttgttcggaatttaccggttttctaccagatttcatgaaattctgaataccgcaagtgtctggaacggaagggcatgtcagaattgtaaaccctgtgtggaggggtttttggatttccgatttaattaaagaaaaagaaaaacagagagaaaaagaaaaggaaaatcgtcggcgatccatctcgcttctgccatcccatccccgcccgagatccatgccggcagtccactcgcggccccccccaagatccacccgcgcaagtcacagatcgcgccggccatggccatcggcggcgacgcggcgagcatggtggccgtcggcctcgtgtggggcaccaccaacgccctgatgcgccggggcgcgcttgtctgggaccaccgcctgcgctcccttcccgccacctcctcctccgtcaccggcgtgctgcggcggtgggcggagctcctcctgacgtggcagtactcggcgccgttcgccgtcaacctcgcggcatccgccgccttcttcagcctccttggcgccgccccgatctccgttgccgtgcccgtcacgaacgccaccaccttcgccgccaccgctgtcgccgccgccctcctcggcgagggcacgcgcgcagcgcccgcagcgctcggcacggcgctcatcgtcctcggcgtctgggtctgcatctcctagcacttcaggttgtgaaaagggaccctttcttgggaatttctgtactttctttttgtttctcttaaaatgatggaatagtatgtactcatgtttgatgaaattttctgtgcaaagcttttggaaatgatgaatgaattatggtcgaatttattcagcacagttgctgtgcttggaattctggagattgagcaaacaaaatgtgagcctgtctcagcaagcgattcttggaattccatgatcagtgtagatgaatcctctgaagaagatccgagtaagtgacaggttattgacattctgcagttcacaactctgtttgcccccctgactcgagctagctaacattgatgccaacttgccaagtgtgcattcatgtattttcacaaacatttgatgatcttctcaatggcattcatgtattttcagaagttttcaaactacacaaaatgcaaaatccaaagagagtgtagcttaactcaggagaggaaaatttctactctatgatagaatcttatcagccatttatgctagtctaatcaatagttcattactgaggctaactagttgtaagttgtaacttgcaaacactggttttgtgcacacaattaattgtcatgattaaactctaatgagtgatcttgtgacttgtgagcatgcccattctactgtctgatgtgaatccctatcaaaggagcatggcccatcaccatgagatttttttcagcactttgacaaggatagccatagaccagtacaagtgtacaactgaaatgtaagaacaagtagtacttgtctgtaagagattttttcacaatgattgacagcgattcacttgtaatatttatcctatcctttgttgactcatcctcattgtgtccatgaatctacaccaactaccatggattacgctgtcaaattgattctaattatgtgatcatgtgaatacagatgcagtatataaatgcaatatgtattgcaatcttgaaaaggctggcaataattttgatatgcaacaggtaataagctggagggctcacatgcatctcctgcctccatcctggacacaccttgcaggatggatggctaggattgatgatcagcaagcacctcctccaatggattatggatgtctcataatcagagtcaaagcagaggagaaatcacaaattcacaattcacaactaccagcaggcatggggagacagcatgcatggttgatggtccttggcagctatcacccaaaaattcagagtgagatgtttgctgctgcatctgcaaattcaagtacatgggctgatgggcacatggctgcatgatctgtatatctgcaagtactttgtggagtttgtagcaccacggttcatagctttgaccacatcaaggtgctagttgcagtgaaagttgtgaagtggatgttgcagttgatttgtggatgttttgctaccagggcagaggaagagtagatacagaaaataaaattactccctccagataaaaaataattacgtttgactttcttctttcatgttccttatagtgtgactttgcgcacggtttaataaaaaaatgtacaaaatcttttttatacagcataggcttgtcacggagcttggtgttactgtatgggcttgtcgacaagcagctgatatgataatatacttacctacatggcacttgccatgtcattcgcgttggtcttcaaaaggtttgggtttgaaaataaaattttatagcatctatgaataaaatattattttctaaatgtttaaataatagaaacactagtagaggcctggtcactcaataaattatattttatctagaattaagtagctagtcgtgtaataacataaaggactagaaatattaacttattgcttaaaatgaactttacatgtacaatggagatgctcttggacccctctaactgtcgaatgcaaacaaaccattgatccatcgaagtttttggggctttcatattacgcaaatgtatcgggtttgctctttagagcgagtactgtatgcatccaagtacttacccctaagtgtcatgaagctcacataatgaggtggagaagagaaggaaggaaagaggggagtcatcccttacataaggagcaacctctatacaaactccaagagggatgaaatgaagggatcagtgaattaagactaaataaataaaataaaattatcatggtacattgggacaagttcgccaaaggcaatatattgtatatattacttcttaattaagatgactattacctctattataaaacttgatattaagcatacatccatgctgcaactcatttgcaacatatgggagccaacattttggctccttggctgctccgactgatacaacagatactacttttgtgtagttgctgtgtttatttttttcgagcattgtgtctcctcctctcccccctcctctacagctctaggctataacccgaattccctccaaattcactgtattagtgcatcgctttcttatttttgtatgttgtatccattaagcttgagacatttgaaacattaaactgaatctctcataacaactctcttgttagtttaagatatgcctaacccttcacttcaattgcagaaagtatcaggggctattcaaaaggctattctatgactgcggctattgcaacaagggtttacctttttattttcaaagtgaaaattgctccttatcggtttaccgaataccaataaaaaacaataaaattttgtcaatgttgcattaaaactagctaatactaggcaatattggttgaaagcatttgggaatttcctaactgtgccgataccgttttcataaaactaatataatagtaatatctttaccgatttaaccatttctaaaatttagtctctctaatttctatgagcaccgcattaaaattgacactaaataattaaattcatacatataaaaatttcctaaccgtttccctaaaaaatgataaaaaaaataatgtttcagatcattttcaacttttttcatcactaccgggtgaaaaccgatcggttttgtgaaccctgattgcagcttgctattgaattcttggttgcaacaatattcctgttggttgcgacacagtgataacccaagctacccaaaaacccctaataccttgtgaaattccgataatataatttagttgataactatagtgctaaatttaaaatactcgatatgccgtgtgttttattatggaccaaaatataggcacacattttttttgtcaaaccgctaaaatgcagtagtacctatataccatggaaagccatataatgtgtgcaaatcaatgcttttttcatgtgatcattggtgaaaatactttgcttaagacatccgatgccaaagaaaatatcggatgccctttgcatgaggccccaccgcccctccccacatctctcttgccatttgcataggacatgttaggccgtcttgtctctccccatctctctcaccattttcatcaacccgaaatacgacgctcgggcgtcaagatgtccaccactgcggctataatctccggcgagagctctgtccccgtccttgtaggaccttggctcccatccacctcctctttttcctccttgttgccggtcccctccatggatcttcctccctccgttctcaatcctctccatggaggaaagtttgacggcttgacacaggcaggcggcggtgaccatatatgaaggaattggcaaggtggtggctgggctccgatgacggagaatcaatagatgtaagcaagagagacatatctggtggttggactagatgaagaaggaaggaggtaagcttttttccttttcgggagttttttttaagaatgttgcaacatattatttcgctctatttttattgtatgttgcatcttggtgtatatttgaatgttgcgtcttggtgtatatttgaatatttcactctatttttattgtatgttgcacactttgattctagggtgttgcaaccaaattcttcgagtgttgtatctcgttgcaacattttcctttaagcagtgaaacatttgtttaccgaatgttgagacatctgaaacattttttatcgattggtgaaacatgtgaaacaattttttacataggatgaaacattgtccgtgctgtggccctctccgatcattggcacagattaatttggcttcaccatgacaaaatgagtaggtagaccgtgagaagaattagggtgcgattgagacgtttttaattattacaagaacatctttcgaatatagaaatatactaagaaatcaggagaaaaaatattttggtacctatctaatacgatcatctaccattccttcccccaaaaaatagccagaaaaatacattgcctaattcaaaaaaaaaaaatcggtgcacacagcacaggcaccgcacagctatctcggcaaaatggcctttcctcttttctcctctcttcgggccttccctttcccttccctcccgcgactgactttttttcttttttatttttcacctccctcccaagtcccaactccccactccagcagcacacgcgcgttcccccccaaattccaaaatctcgctagggtttccccctcctccgctctcacactgcctcgcctccccggatggacgagaccctagcctccctgcgccgcccggtaaccctagcccctccgccgagctctcacccccctcgaccgctggattcgccatttttttctgattttttttttggatgaattgcacaagcgcgggcggccgccgcggccgcgggaggaccacttggccgccgaggacttcgaggaggagggggaggatgaggaggccaggcggaggcgctcgcgcggccccagacgaagcgcaagcgcgcggccagcgccgcggccgcggccgcgctggaggaccaaaccctcatcggttcgccttctacccgttcttcccattctcctttgcgcgttggtcgccgtggtctcgctggagtgtgggggttggttgtgcttggggatgcactgcttagtgtgtagctgctgagttgacgagagtgagagctagttcgcagtgacgcgggataaattagtctatgtggctctctgggtggtgaattggtgattcctaaggttgaactgaggttgggctagtttagttcatcaagcagtgtgattttctgcttttgtagttggtctagagaattttgttaggattgtttcttttttcaatcaggaaattctaggttagctgaacaaaagaccattgatttcgattggactgttagttaccttggtactccctctgtcccagtttagagggcgcgcgtaaatttttttgacggtttaccagtttagagggcgtggttcgtttttcactgcttttcttcctggagtaccctccgcatgcatgcacatgacgcttggatatgcccgctcaataactgatcaagcgacgcaaccggccggcgcgtggagctgcacatgtgtgggaccacaaggttacatgcatgcagctgttactaatctgcatgtgtttggatcaaacccattttattaggggcagtttaggaaaaaataactctgcatgtgagctggtctcggtgaatttatttgtgcgccctctaaattgggacggagggagtactatcacctgttactggttcagtaccctatcaattcattggtagtgccaaaacctagccaaattttggctctaccaattatttggtagggtagagttcagattatatatgtttgattagctaccaatttgtttgatatagtgaagaaagttctagagtgttgccaaattaaatatgggcattaccgctttggctctaatccaaacaaatcacactactatttaagctgccaaatatttggtaaggcacattttggcatcaatccaaaatgacccatagtatcacaagccgatcttgaaactgcatggagagtcatgatttataaagatatgtgctgacctcagctggggttgccctaaccatagtcctgccagtactgtagtgcctgcccagaatgatgccagaggcttgtagattatgcatcgagatttaaaagatcctatcataacatgctgctcaaaatctatgacttagacacttactcggcaagttattttatcttcaatttgtgtcttattcctaaaaacttggaacttgcagatattattaaacataatggcaggcttatcagccatgctgtcaaaaaattggtcgaggattatgaatcagatccaaaatctgtgatgtttcagatattagcgatgctatttgaggtaatagatgttaacttcttaatgcagtttcttttggttgcttatttcataaaccagtgaatcttataatgacaggcttgtggagctaggcataacttttatgcagactacctgtatgaggcagatgtggatggtgttgtgttttcccttgtcgagctagcaaaaaaggtatcctgctgcgattttccctagaagagtgaatggagaataattttttgcagccttgtgattatccaatgtgcatgctatgtttatcctacatgttactaatcttgaaatgatatgcaatgctctcttttggatgatttcttttaaccttaacttgaaaatagggaatggttgaagataattacaacaccaaacagaaggatctcaagaacttcaaagaaaatcttgtttccttttgggataccttggtccatgagtgtcagaatggccctttatttgatggtagcttattccaaaaaatcaaagactatgtggttgctttgtcatggtaatttatctaagctataccttttattttctttgtgttagacacttggatgcatgtatctaatgtgctgtggtgtatttcagtactcctccaagggtttatcgccaagtagcttcattggttgggctccagcttgtgacgtccttaatatctgttgctaagactctcagtggacagcgtgagaccactcaaagacagttgaatgcagagaagaagaagcagactgatggaccgattgttgaatctctaaacaaaaagctagctcatactcacaaaagcattacttacttggaggaactaatgcggaaaatattcagtgggtgaggacctgaacttgcattttaatgtacactgtttactttcatatttctcaaatttgccattctgatgtggttcacttactggtatctggacaaaaatatttgcatgtggctgttttctgtacatatctcagtctactatgtccacttaatatattattttaccacttgcaggttattcatgcaccgctatcgtgatgttgaccctgagatccggatgtcgtgcataaaatcacttggtatttgggttgtctcgtacccatcacttttcttacaagatatatacctgaagtatctaggatggacacttaatgacaaggtacatattttagttctatgatttttggttgaaccttgtctgaccaatgagatgtgcaagttttgttatgtcattttgtgcaatctttgtttttgtagaatgctggggttagaagaacttctattcttgccttgcaaagcctgtatgaagtggatgaaaacataccttctcttggtctctttactgagagattttacagcaggatgatccagcttgcagatgatgttgatatttcagtagctgtgtcagctatcggactcatcaagcagttactgaggtgagttttgggcaaaatcttttgcctgtgaagagatcatttggtcactgctgggcaaccttacttttttttaccagagctttcctaagatatggtagtgagtttggggtgtataactttcgattgtacagtttgctattagggtttttgtagattggccatgccgctatgttttgagaactaaattttcaagcaataaattgtattttttagcattttccagcataatggaatcatggattttagccaggaaccggtgaattagcttcctttcatcaaataccatagagaaataggggatagttcatcactagtgttatcattagctttaggatgcaatagcgcagttcaataaatattctcagtattcacaattcaaaaatatttttgacctgcaccattgtagaaatacattcaacatgcatttacacaagcttttgatttggaaccaccataaatactcgcttgttgaatgaaaattggtccaaagaaatttgcagaaacacaggcttaaatgtgcactcttaattcacaataaaatacataagagttgcatattcaaaacaatgtgctatggacgaatggatcagtacgagtggtatatggtatttgacttggcattaatctactcatgtggtaattgattgacttgttgggcaccatgtgtgccttgtctatcctgaactttacctagcaatcacccttgttattatttactaatatcagtatttgtcttaccaaagtgtgctaggggaccatgcatttttttcagctttaattttttacatgcattactgcagcaaaacaaataacttttctgtttattccttttgcaggcatcaacttttgagcgatgatgatttaggtccactatatgatttgcttattgatgagcctccgctgatcaggcgtgcaattggggaattggtttatgatcatctgatagcacaaaacatcaaaacctcccagtctggagcaagaggtacttgtctctggaatgtttctgcttttatgccaccttatcttgctatcaaataactttcttagttcatctactgattgtactatctaattccagatggaaacaatgattcatcagaggttcatattggtcgaatgctgcaaatcctgagggaattttcagatgacccagtcctgagctcttatgtcattgatgatatttgggatgacatgaaggctatgaaagtatactcagttttgtttcaacttatattatcagtatgacttaaccgctataactgcaatgtcctattctgtaggattggaagtgtataatctccatgcttctggatgaaaatccattaaccgagcttactgacatggatggaaccaatctagttcggatgctgcgagcctctgcaaagaaggctgttggggaaaggatagttcctgcaacagacaatagaaagatgtactacaataaaggccagaaggtgtcaatgtcatttctgtcgtatcatatgttgctgctgcaagttgattgtttatttcttgatcgtatcatttgttgtattgcttgtttagtgttgctgccttagtggttatttaggacttgtaagtactatgcgtagaatgtaggtttattttgttggatattggcaatgtcctacacctttgaaagttagtctgacaagttaatctcttaaaagacctgtttgctagatacatccatttttaaatattacactgttagactttatttggtcaaacttttgaaacattgaccatcaatatctctcaaaatattttgtttgggaacataaaaatcatattggtagtttttttctttaattgtacttttacaatattaatttttttagatattattgttatattctaatagaaaatagtggtcaaagttgcacacccaagaccaaagaaaatcaacagtgtcatctatttaaatacggaggtagtaattgctagtcatgtagattgtagttctgaatctgttgcctgcttgttgaatctggtttgtttgtcgtaccattgttcatgtatttgttgaattgttactgaagcattattattctgcaggaaatattggaaaacagcaagcatgaaataactactgctttgctgaagaaatatccacagcttttaagaaaatacatatctgacaaagctaagatatcacctctaattgatatgatgatgcttatgaaacttgagctgtactcactaaaaaggcaagatcaggtcagttgaatagctatttattcttctgcacaaactttctgcttgacttgttgacagtttcgtgtacattttggttcagcatttcaaggctgccatagatctcattgcggatgccttctttaaacatggtgacaaggagaccttgaggtcttgcatcaaggcaattactttctgttgcactaactgtcaggcagatcttcaaaattatgctgaaaacaaactgaaggatcttgaagacgagttggttttgaaagtcaaaactgcaatcaaggaagtagaggtatgcatgtcttattcacagtctctttgttttaaagccatgaaggtaaatatgttacaatctacattgcaggcaggtgatgatgaatactccctcatggttaatttgaagcgattttatgagcttcagttgtcaaaacctgtcaaaaatgatggtttatttgaggacatgtacagaatcctgagtcatctaaaagatatggataatgaggtatgaactattaccttgattagctattactactccagtctccctttgcagagttcactgtcggtactgtattagctaatatgttcatgttttaaataattaggtgaagagctttctcctccttaacatgtaccttcaattagcatggtgcctgaatgctattgatggtgaaaacccatctgaagcttccattgacgaacttttatccaggcaaagctctctttttgaaaaactctattattacttggtggttctgcctacttatcagaaagagggaaggagcaccactatactttcctgcagagtaagtcttctgagttaaacattgaagaaaagaacacatttttttgtattatgttgtatgctgatctgcaggctgtatgtcttggctatgtttagcccactgacttgatattgccttgtttttttgtaggtctgtgtcattactgctgagatgtggtgcctgtttaagaagccaaaatattcttcaacaaggctcgagagtttgggatatctcccgcaactagatgttgtccagaatttctggaaactatgtgaacaacagctcaacataccaggttttgatgttacacagattctatacttcattcgttgtatagcttataaaaataaatttctaaataaaacctcatcatcatgttggtgctactcttttaattgaagttgatcatgttcatcaacagatgaaatagaagatgaagatgcaaatgaagaatatattgaagacacaaacaaggatgttgtcatgattgcagctgcaaagctagtgctagctgatacagtttcaaaggtctctgctacgttttctaactgtaatgaactgttaggtcctcaagcaatgttttcctactacatcttctgttgtaccataatttggtcaccttggcagcttcctattgtcagacaaactaagttttcaattttatttctgtgtgcaggattacctgggcccagagcttgtttctcactatgcatcccatggaacaagtactacagagataatcaaacatctaatcacctcgcttcggaaaaatgctgacaacaacatgggtgccttatttttcgaggcactgaaaagggtaggtattttgtcccaccttcaaatgcacacaattattatttattatagtaactattgagtaattatattatgttactgattgtcgattaggaatttacttgttccagcttttacaatgtttaacaaactttaaaggaacttctgactttgtcaaccatatcttgtattttggaagtattttgactaaagacacttatactaaactcacttttgtattagaaacttttgctttatctgcttttaactgattttatgtgtgtgactttcttttgtaaacttttctttattttcatctaactagggatatgagcggtatatggcccatgtaagtgatggggaaaatcaaaccctcattggcaagtcttattcagaatgccaagatcttgctggtcggctcgcggggtcctatgttggtgcctcgcgcaataaaaacaagtctgagatcttgaagataatccaagacggtgtttcttttgcatttgtggaccttccaaagcaattgtctttcctcgaggctgctctactgccatttgtttctaaacttccatcgtcagatataccagacatgtatggcatttactcttgtcatttatgatgcttccatttattttatttatgcacaattttcatttatttcattgtatgtagcctgatagatgtacagaagaggactcaagatactaatactaatgaagatccaagtgcttggcgcccgtactttacgtttgtagagcatctacgcgataagcatgcaaagaatgaggttttgcagggtatgttgaactcttcctgaattttcccttttttatgttacataactgcaaatctttcttattgaaagtatggccgattctattgtttcctatccagaggaaaaggaggaaaaacctgtaaagcgcaggggtcggccaaggaaggttagagatgtacctgcaaggaatctttttgatggacacaagtctagcgatgaagagtctgttagtgactctgatcagcaagggcatggtgaagacaatgacgacgatgacgcagatcagcctctgatcaacacgtttaggtcttccgcatccaagctaagatcactgaaggtttctcagcaaggaacaagcggtcagaaaggaccttcgagggcatcaggtaaatggtcaaggattttgctctttccacatcagtcggatgcactgacgaatctacagcagcaaccatggtttctttctctgtttccattctatttttgtgtggtgttcccattttctaattacagtgtgtattttcaggaagcaatagctgagggcacgcactgacgtcgttacgcatgactgaacttggcacaaatgaatgcagcagatttgtggcgttgtagatgatttgtacctaggtgctcacccttttggtaaacaacgtgacatagacatttgttaggtttttaccccttcgccatgtatattatgttcagtaataatatatgtagaaaatcgcatgttgcattgtaccaatttgatcgatgtatttctcctgggttccgagactaaagaacacttgcatgcgagagatagggagagcagcaaccattttttatttattcaatggagaatccgaaccttggattggtttgcatgggaaccaatgagcccggcaatccttgcataccaaaccctccattctaaattgatctacatatatatattttttgaggttatttctaaatgatctacatatttgtgttcattcattaagtctatttgttatttgtgtattggagtaaatagacattgatgcatgtatcacaggtatttataacccacatgcaatatcttgatctgctattggctaggaaatagtgaggatggtgcatgcatcgagtttgctgctagagtaaatatagtacgagagagttattagcttttcttgattttggtatacctatgaaatatgtagatcaatttggaatggagggagtaatgattactctttcgctgtcgctcctcttcgtcgagccgctgccatccctcccatgccgctgttgctgttgtagccactccacctcgtcgagccaccgctgaccgtccttttcatctagccaccgttgcgcggcagccgttgcacaaggagggcggcgggaggaagttcctctcaggccgccgccgtcgctcccttcctccacaagccagcgtgccgctccctccctccgtgagccagcgtcgagcgaatcttctccctctgtgcctcgcggccgctccctccctccacgcaccgccgtgaacactcggcgagagagagagagagaggggatacgggggagagaagggaatagatatggatagggtttggtcgatgatattttagtcattaaaaagtaattatattgctttctttttgttgaatgaaaagttaacggtactatagtactatagaaacagggccaaacggagcactcatttttaaaaagtatggttaaataagcaaactataaaaggtaaggtcatattgatagttaagcttcaaaacagggtcaaataagtaattgtccctattgtgtttttgaatagcaagaaaatagcgctaagtcaaacatttttaactttattactaaaaaaaagataaaaaagataaatcatatgagaatggatattactggatttatcattaaacaaactaccgtaagatgcaattttttgaaacattataattttttaaatattattggtcattatagtatcttgaagattctatcaaagtttaaaaatgattatattttgatacggatggagtactagttttgggttatcgcctggtaataatcactttagttagtaccggtttgtttaataacattcacaatttgttgtgaaagcatttgattgaatttaattgagttgatgctgatgttggatgcggcattaacagaacagaaactgtcaaatggattagctgaaattaggtgcataatttctttcatagttattattataccctaccacgaaaaggcgagtgggtttgctgaaagaatatagaacatgttcttttgcgaattctaggcaggcaaaaacggaaattgcaaatggataagcaaaataaaaaaagccatttaggctgcttccgtttgggagtgttgggaatccttctcttcttgcaagtaaaatgtagcgatggattagtcaatattagctaaaaaatcttaaagaaatatattaatataattttaaagtaatttttgtaacaattcttttacaaaacacatatcgttttaactgtttggaaagtgtgtgcatgaaaaacgagagtgaaagttaagaaagtgtctaaaggatcatacatcacccaagaatcttgggaccattgaacaacacgcatgtaaaacttgtgtttcgaaagaaccaatacccttttaaccaataatgttattaacaatcatgtggtgtgcattttaaaatgttcatgtgttaagcatgtgttgtaacctactaaacttgcatatacttaatcgtactttctttctttgtcgtgccttaaaaataaaaaacacaatataagatcaactttgccccttatcattcttttctaccatcattgtctttaactaatactctgtctacaccactgttgcattccacctatcttttgcttaattcctttgatttgtcatcgttttccttacttgttttcagccataatatttagcggccctcttttcttcgaggctacctaccttctgaagatgttggaaggcattaattcaaatagcaacttgataaagccgtataatcaatggctggatgcagatagcctatacccgcaactttcaatgacactaacttctttaggattggaggcattaagcataaaaagatcaataacatgacaagtctgaaattcgacggtttgagtggataaccttggaaactacgaccattgaacatcgaagttggaaccagtatgcgtgtggctgacgaccctatagtagtattcgtctaatgttgattcaagtctatatgtgaagtggatatcgctgtgtttgacgagttctagcatgagtaattttctttgttgatgattaccaatcttctgcaatgcaatgctattttcatctcgtttggcctgtcgaacgtgtgccaaacaaagtctatcattcaccgatattttcttctatgctaatcgaaacacttacgtctatgctgactcctcttatgttcaagtggataaactcatctttctagacatagagtgaagatggcaccatataacactatgacttttaacttcactagtgaggtcataatgttataatgcaatagaaggaattgtaacgtaccacgtaggcgataatgtgaaacgtagaatgtattctttacaacgggttgggacttgggagcccttccttttcaaaacacaaaacagagcaacatattagcacacgagtaattaaatatcaacttaaaaacttattaaatggattagtataattttttaaattaactttcttatagaatattttttcttttgcaaaaacacgaagtttagtagttcgggaagcgtacgcgcgggaaatgagagattagaagttggaaaaggcaagaaaataacacacctttacataaaatttaatagtacaaccaattgttggctccaaaattattcacaccaagaatagctattgtcgacggataatacccgtagaccgtattccgagggtattggggtacactggagcaaggatctacacgatatgacatcaatcacatagaagacaaagattatactggttcagacccatcataaggtaatagtcctaatccagattttatggaccgtgaagaaaactacaaagattacaatagagaacaacaaaactgtagagtaccaaatagattgttgtcgagatcaactcgacgagatcgatcggcgactaggtcttctagtcttgcggattgcttctactatggttagtggtgaaattatgattcaatgaccccgtaccctctagaggtcttttatttatacccctaagtgccttgacctctaagtaaaactcggagagaactttatctgtacgagatcttaaagtcctcatcccccccgaataagattctaacacctattcagaggaacaatttccatatatctcagcaaattccttatgattaagaaaacctttccgtatacttgacggtataccgtatttgtacacaatgtaactccgaggataggaggcatcccttatccttaaccctgacagctatagctaatatggacaatagccaagtattagattacacacgttttcccataagctatcttttaagttttttaactaattttttttctgtctcatttcaattcacactcaatcaattctcttgcatggcatgggaagcatgggagaagagtggttgcaactagatttggacgacaaataagccgtaaggtttcgattcatgtgctgtagctggtgacggaagatatttcctactttatatctctttccatctagaatgatgcatacacggacaatattatcgcccgcctactgactacgctctacttttctttgtccttggagaatttggtgtcgtagtttttaggtaggattcttctgtaatatagaagacgccgccgtattacggagaactattttggtgtaaagaaaaaataaattaattacaaataagttcctggacaaaggaccaaactgaaaaaaggacacactctactgttcgccaaccgcacctctatactctccctctcttacggcggccggggcggaggaacggccggccatcttccgccgcctcgcctcgcctcgcctcgcccccccgcgcgcgccgccggcgaacaaacccgggaggcgcggcgccgacggccacctctcctccacaaccccccaccctagcctcctccttcccaccccgttcccccgcggtctgctgcccccgtcgcgcgcacgtcggaaaggcggcggcgtggagcccggcctcatcccaccgccagccctccatcgcggctcgaatcgagccgaaggtattgttactccgtcgctgctcttcacctggcgcgggcgtagattggagatccgtcccggtttgggttgctctctctccctctctccctccctgcgagttatgcatccggattcttattctgggatttggcctttgttttgatgcgtggaggaggagttgaatcctcctagatccattgctagtcgagtgattcgagtccgctctgctgttcggtgcactgtagcatcaatcatggccgacgattctgggaaggagcagaaggggaagtgggatacaaggatttttttaggttttccgttccatggctgcatgcttgcgttcctaacacgagttgcgttgcattgaactgatccaacatgtttgctgtatgaactcgttttgggcggcttcactgcacacgcagagcccgctcaggcgctcattagtagttaaccgatttaagaacataatagaagggaaatatataagatgttgcgttatgttcaaggccaggagaaatgaggttcaacttttggctgtttcacggtgacctttgctgcattctgattgtctgacacaattctaggctgaatccagaccagtcaaatataggtttggcagataaaggttggcccatttttgcactagatgttattcaactctgctttaggccttcaactgtacacacacacacacgcggcaaatgtgtctcgaaatagtcgttacacggggaatctgttcatttcgttagaaaatctttaaatgccatggcttgcatattggttaaatgattacttctatcatttccctgagcccacaatgctctttttcactcctgtgcaaactagtgtggatacttctctaactaaaaaattctcattttgtttcttaggttcagatgatagacatggtgtcagttattgaggagctcagtgggctaacttctagagaacttggagagatgctgaaggagtcagagaactttgtcttgcaggagaagacagaagatggtggtacaaagcaggtgtgtatgtataatatttgttgtcatttgagtttcttttccctgacatacatttctcttcgtaggtggacatggaaaagcttgtgtcctcgcttcctcttcaccttcttgctgtatgtttggaacttgaaagaggttcagatttagcgtatgtcctccgtggtatgcgcttcttgcatagtttgtctgagctatcagctcgccacactaggctggagcaggtttacttctttcaatatttcactcaagcctccccattttatccacaaataattcattttttttcttttgaatcacgatacgctttgagcattctttttctttcatctctgtattgttttatatctctgtattgtttttgttccctagtgttgtgaactaaatgcaatgcaactctttttttttgtccatctttagtcattgctaagtttaatcaagtccaatttgtttattgatttcattttactctctgttaaaattgaactggctgatgagtgttgagaaacacatgtttatttattgcaggttcttctcgatgatgtgaaattatctgaacaagtcatggacctgatattttttgtgctatctattctttcccactggaagaaggttcggcaagtgccaccaaattatatattgagttctatgtactgttttttttaagattatcatttcatactaatttatggtggcagctattgttttaaattaggaaaatcatcttggtgtttctccttttatacactcatcacttgtagcagccagtcttcatctgttgacaagttacttttcatctcagtggcatgaacttgttcatattctgcttgcacatccaaaggtaacacatgttaatttagaatatgtttaacttagttgtcttttcatgcctaaacgaaagcatgataagtaacctccagaattttgtgatgactttaaaattaaccttgaaatatcattgatttttaatgctgttttaccttgctttaattgtacctgaatcctttattattttctatttttatcctccttaccggcttgtctataatagtctctctgtggtgcaagatgattttgtacatgataatgccctgttatttttggttttatcgttatgagttatgacaaaatagagccggcaacatgatttgggatgtgagcccttattgttttaaggtcaaatcaaaattcatctgaacattttaccctgtcctgacatggcattttgtggtttaaatcatctatcagcgataaatctccatgtaattttgtgtacagcctactgtatcagaaagccatgctctgtcaaatgcaacttttgctgtgtttactttaaagtttctgttctaacatataattagcacaccaatatattttttcctttgagcattaccactgttcaaacttgtatatttctttgtttggggcatttgattgcagggatacatcttttgcatcattatatcatttcataagatagtgtattacttcagctatcctattgttttccttgaagcaaaaatacaaagtccatactaaagttttagtgacttgtgcccattgcatatttttcttgtactgtaataatatttgactgaattatgtcactcttgtgtttatagatgacaattagaaagattacttaaaaagaaaaaaaaaagagcactgggttactattgcaaattctttgatcatgattcacgaatgtttgccagattgccagcaatacatggatttgacagttaggcaattattcttcgttgtttttatctctttatctatcttaatgtttgatgtttcatggtcaggttgatatctttatggatgttgcctttgatagcctgcatgatgatgtgaggtcactgagtcacaggttgtcaacattgagcaccaatacctttcctgttggcccttttgactcacgactcacacacttcatctgccaacagtgtgaagcatcattgcagtttcttttgttactgtgccagcagaagttgttccgagatcgtattttaaaaaacaaggtctcagatatgcttacaaatcctgtttccttttatctttggtatcactgttgattaaaaaatatttaattggatattctcttcccttcatgacatatcaacatatacatgttatatcatactgatttgatgagaaaaatgtgtgtaccttgaggactgtttatttgttcctcgaatgcagtgttccattagtttacatgctttgctcttgttccacaaaacagatcagtctagactagcctcgttcaagagacatgttttatgtttttttttgagcccacgtgtctgtgtattcctataaattatgagtactagcgtcaaatctgcaatttgttactatatattattacatttgatgtgttggaacttggaagctagatctgaagtaacctctttcttaacgcaggaactctctaggaatggaggtattctgtcactctctcgatctatattgaagttaggtgttccagagtgtctgaagggatcaattgatattgctgcttccatgtccagattgaaggctaagattctttctattgtaagttggtcatgagccatgactcaagattgcacttcgtataaataattaaatagagtgctactatatttactgtttgcacagtaccgagttactaactaaatccttggtgcaaaacaaatgctagttgctccaactttgtgaagctgaaactgtttcttaccttgatgaagtcgccacttcaccaaagagtatgcaactagggcaaaccttggcactagaggttagttctaccagggatgatcgcaaactttgaaatgttaccgactctgctacccgtggatttttttttcagttactgacaaaattcttatgtcacatgcaggttcttgatttgctgaagactgcgtttggaagaaaacaaaaacttaccttggattctcacgataagagttaccctatgggttctgtgcttatcagtgcgttgcgtctagttgatgtcttttctgatgattcaaacttcagatcttcatttataactaatactgtaagagtaactatttctaccttgatctatttttagtttttaccattgagcaactgaaaatttccagcaaatataatgttttattcaagtcccttttgttcatctcctttgcagattccatttctgacccaaattttggctattcctcatgatgagtttgtctcaaactggtgctctgttaatctgccagtgatagaagaagacgctaatcttgattatgatccatttggtgcagctgagctggcactggcagctgctggtaataagttaactgaagctaaagcaaactattcttgccctttcgccctatcagtatgccttctatagcatatgcgcagacaagaacatcatgtgtggtgaaaataatagcatatttgcatgtttttgtcccaaacatatgcgaaggtcagagctttttctctcctgctacaaattgctaagttgctatgttgatttgttgttaaaagcaagttccactgtcatgttagcagagcaagaaagagacctttttcttcagaaatttcagaagtacttggtatcagggaatcctagatcatcagttgatcatccagcatcagctgatctcaaggccactacagtttgcagaaacttgggtaaagtggcttatacttttatccaattttgtggttatgtttatgactttattcattatacttcatgtgtaaacctcttttttgtgggttttgcaggatctttgtctgagtatgctagatcgttaattcctaataacttgttaaacgaggaagatgtgcaattgttaaggtagttaagcgtttttgacttgtcatgtttcttagtgtacaaactgtgttacaaattttttgtttaatgcctaattttgtgggtcaacatttggttttaatttgttgcgcgctgcatatagttttgaaacacttttactgatatttctgcaaaatgtgtttttttcctatttgcagtgaatttgcttataagttacaaacttggtgtaaatcacatgttggacagagtacatcccaggtttgtttgcttttcacagtaattatagaatcatagtagccacctacatatccaagcattttgcttagggtgcttggttccctgctcctccttgagggataactacaaatttcatttccaacaaaataatggttcaactgttcaagtacatcacttgcactctgtctctgtgcaagcttttttaatgaacaatattcaatactatagccaatttttttgtatggtaggtgataggtgcaacttgtgtataaattagaaaaatagctttgacccttgcatcagatggtcaattcatacttctagcaatctagttgaaatcgaaatgttggacgtgacctcattctgggatgttttaggcagtaaagattgatccgtcatcagaaagcaaggaagactttaagccactgcagcatcccttgataccaagtactgttgttccagattccagtataaataaccttccgaaggtaggtttgttcagttgttcactatgttgagtataatatattagccattgacttggtaattcatctgatcccaacaaaaatgatgtgcagaacatggaagagcctacaccaacaaacatggaagagcctgcaccaacaccctcaacaaagcaagagggaaatgccagggatgagactcctagaagcactgtcgctttaaatggtgggttcctgcagaattcagtcggccaggacttagtccatcttggtgtggcgagaactagttcaggctttctagggggaggtaccagtacaagtacaggatccctgcgctgcaaaatggatcttgatcctgcatccagcagtatggaccatttcaaaacaccagatagaaaagaaagtggtcttcaggatgatgagaaaggagacactcacatgtatgatgagagacaacctaagagaaggaagcgaaccattatgaatgataggcaaataaacgaaatcgagaaggctcttattgatgagcctgagatgcataagaatgctgctttactgcaggcatggtcagagaagttaagtgggcaggtatagtccttcacctggccattcttctgttagatcaaaatattttatatacttctcattcatgaaaatgtgttttcagggctcggagattacgtcatctcagctaaagaattggtaacactgaagctatctttgttattctttttccttagcaatttagcattacttgtatgggaacatatcctgtgcacacaagccttctcatctacacagcgtgcagaccaactaacaaatttcacaaaaatatctagaaaaaattgtacaagtatttccaatagtattacacttatgtataaagtcttaacttcaaattcattatatcttagctgtaaccaaaaaaaaaaaaaatctaacagttttgagagtataaatctgttagaaatttgtcttttttgttgctacctatatataatgaatttgaagatgagactttacacatagatgcaatactactagaagtacatgtgcaatgttttgtagaatttttggtgatatgttttagttggtgtgcacggtgtgtatacgagaggacttgtgtgcagagcataagtttcctgcttgtataccataactgacgttttgttcatcaagttcatacttcacttctgtactgtttttacttctcagtccatagcttacttatgacaaaccttctttaaattctaggctgaacaacagaaaagctaagcttgctcgtattgcgaaagaaagaggagtactatctgagggtgagaacgcagataagccatctacgccagctactccccaccactgtgactcctcagaaagtgctggcgaggagagctacttgccacctgcgagggtcatgagtgctctaggcatatccaagggcagcagatttgtgagcccagatggcaatgagacaacatcacaggcagaattcaatcaaaatatcatgcttagccgccctttcacaagatcattctcatttgaacctggccgtcttgtttcgctcattgataatgatgggaaggaggttggcaggggaaagatcttccaagttgaggggagactgcaagggaaggccctgacagatactcgcgtttgcatcgttgatgttattgagctcaagattgagaaatggcgggagctacctcatccctcggaagcatcaggaagaacattccaagaggcagaatcaaggaacggtggtgtgatgagggtcgcgtgggatgtcatcagactatctccagtggttcagtaagtcgaacttttctttgcaatgcgtagaaagacgctgtgacacccaagaaagtacaagaagtaaaaagaagtttaatttaggatcagaaaatcgtgaatcttccggagcagtttgtactaagtcgccgccctgactgatgactgttgtatccatcgatcgaatgctggacttgtttaggatgaagtacatcctaatttacaaaattatgttattctgcttatgctaggtgcaacaaattcaagtagctggtgttgaccatgagattttttttttcagtattcatagacctcacttgttagctgtcgctatatgctaaggacaaaggtttcttaagatggacaaaggttcatatgctaaggacaaaggtttcttaaggacaaatgtttcttgccaaggacctcacttgttatgtgttggtggttgctcaggagcggcaacatgtacaccacagaatatttcagatcctttgtccattgagatattagaaaacattaagatggaattcttcatcagggattgcaacctcgcatgatcaggaaaccgctcttcctactcctgccacgcccttaatttagcacacgtcacttcagtatgccaaatctctgttaggtagatcttagatttttctcggttagtccaaagtttttctgtttcagataattgcattagtgcatgatgcagctacaatgcatgcattgtccctgttcgccccagatgcagtggcagcgtgctagctcctctggcttgataaaaactggtgacaataaggtcttgaacatcctttgtctgggcgtacaactcactcgttggactgcgccacatccaggacacacttctgaccatacagctactgtcacgtgttttttttatttcagcccctacttattttttgtccgcctctataagattttttattataaaatcaagtgtaacttttatattgtaaaccttgagaaagagatagaactacacatataccctcaacatctcagtggacccacttgtcagcctacatatatctttccccaccctccatccgaatcctcgagctcaaatccgcacaccgccgcctctgaccgcatccacgctccggtgtccacctctaatcgtttatacttcgatactgctataggcatcaagctggtagtatggcactcggtgcccactaggggagttgccaaatttagcgataagctggccattatcgccatcgatgtgatcgcacacacttagtagatcgctactttcctctccggtggtttcttaacgttccatctttcctcgtctccggtggttgtcgtgctcatcctcccctccctaatcccggtagatctcggcgtttcacttgacaaggctattgcccaacaaagacaacgtcagtcgtcacagcatagctgagctgctgaacactgcgctttgacgtggtacggcaaaggcacttgccatgttgtggcgttgtgcacatccttagtattactagaagttgctctttctgtaatgaaagatttaggtatgcaaaacgatatgaactcttaaactattataaattgaacttaaaaaatcatgtccaaaccaaagtgttcatgacactaaagaaagctgaaaacaacaaaactccaagttagagcacccgcaatggtaaagtaagatgctctctataaaacatgtacatctcagtaatagactagattaatagtaaaccaactcaatagtatgtctacatgggtatctatagctttctaatccattgccttgtttttctctatagactatctctagattagtagataactttgttctctctcttcatttaatctctttcaagtaagaaaatatgctgacatggatctcttatagggagcctatagataaccattgcgggtgtccttacaattacacagcctagtttcacgcttcacacacttccatgggtaacgaagtacagaagccctacagcagagagcgcccggacatggagccccagttccagttgtcgctgatgagagcacaagaaatcaatcaatcaaagcatgcaaagcaacacagtcactctgtcctctctccatcaatcaatgctcacccagctcacctcacctcactctcctgctcctcctcttcactcgcttcgcctccgtctcgtcgcgatcccacctgaaaactctcgccatgaccaccgacctcctcctcctcctgctgcttctgtcgtcatcccgcctcgccctcgccgccgcgttcggcgtctggatcaatggcgccgcctcctcgtcgccgcagagccaggagtacgaggcgctgcaggcgctgaaggcggcggtggtggaggacccgcgcggcgcgctggcgtcgtggcaggggcccaacgtgtgcgcgtacaggggggtgtactgctcggcgccgcccgacgacgccgccgcgtcgggcgcggtggtcgccggcatcgacctcaaccgcgccaacctgagggggacgctcccggcggcggtgtccctcctcgcccacctcacgttcctccacctcaacagcaaccgcctcgccggccagccccccgactcgctccgcgacctccagtacctcaccgagctcgacctcagcaacaacctcttctccggcccgttcccggcggcggcgctgctcatcccgtcgctcgtctacctcgacctccgcttcaacgccttctccggcgggatccccgccgaggccttcgccaagagcagcctcgacgcgctcttcctcaacaacaaccagttcgacggcgagatcccggagacgctctggtcgtctccggcgacggtgatcacgctcgcgaacaaccgcctcaccggccccgtcccgtcggcgtacggctacggcggccgcgtccgggaggtgctgttcctcaacaacaagctcaccggctgcattccggaggagctcgggttcttgcccaccatcgaggtgctcgacctgagctacaactcgctctccggccacctcccgcccacgctgtcctgcctcgccggcatcgaggtgctcaacatcgcgcacaaccagttcaccggcgagctcccggacctcgtctgcgacctcaagcggatcaccaacctgtccgtctccttcaacttcttctccggcatcagccagcactgcaaccgcctcgccggccgcagcgtgttcgacttcgtcggcaactgcgtccccggccgcggcctgcagcgcccgccgccggagtgcgacggcggcccgggcgacggcggcctcagctgcctgcgcagcatccccgtcacccgccccgtcccctgcgcccaggcctccgtctccgtcggcgtcggcgtcatcgtcggcggcgcgatgccatcgttcggcgccggcggcgtggtcacggtcaccgtgccatgaacgaacgatcaaccgattaaactgtattttttgttctccctctttttttttgtccacgaaatttaatcccatggaccattagcccattgccatctcatcactaattactaatcaatcgattggctgcttaagaattcgagtggctaattaagaacatttttggcttttgagctggagggagagaggtgttaatggcgccatgaatacgaggggtggcgccaactgctaacgacttcctcctcaccccgtgcagccgcggccatgtgatgtgctgctgcagctgcacagcttgcagaaatgcagtgtactgctgtactgtttacctgcttactactcctgccctggtatggtctctggagtttggatcgatccgccattttcaccttggagaaaattggtccctgcacctgtgaattttcgtgttcaaacgagtgattatttgtcttattttaatttttttatgattaatattttttattgtcattagatgataaaacataaataatattttatacgtcatttattttttaattttttttcataaactttttaaataagacggacaatcaaaagctgtatacggaaaccggtaactgcacttaaaatgggacagaggtagtactactatcctgtctcaaaatatatatataaaaaatgatcggatatgatatattatagtatcatgaatctgaatagacgcattcaaattcgtcgtagtgtcacatatatcacattcgacttgtattttgggttggaaagagtacaagatcagaagttactcttgtgtgaaccaaaaatatggaatccaatatttgttgctccggttaatatttaatactcccttcgtcctaaattacacggcgtccttattttgttttagaaaaaaataaactcgttaacttttgattaatgattatactaaaattatttatgttaagtattatatatggagtatgctatatcactgtattcgtgtcttaaaaattttcatgtgatattaattttatagttgttgataatataatgtgaaataaaataatagttcattgaaaactatatgaaaaattatatgccttataatttggaacaaatggagtactcccttggtatttagaaactacttagtttgtccataaatataaggatttagggtataaatataagaggttttgatgtactactttctcaatacacctgaccattatatttattaccattatttactctaataaatagtaacacttcaataaatatcactcaagattgtaattgctcttatctccttgaccaaggttttttttattgtttcgctaataatttgtagtacacaaattaataaggtaataataaacgtttcttgagtgacaaatactacaggttttacaacatcgggccaatacattttaagtgtcatttcaaattatctttttactgcactaaattttctagatgtgtttgctacagctagctcgctccgcccggtgccgtgtggcgagaaggagaaagagaagagatgaaggagaggagaaaatgagaatgagaatgacatgtggatctacatgagctccactattcttttattatttttagtgtaactgacctatgggtctactatttttatatatttttggactgaattgccacgtaggtgtcatgtcaatgccatatggaacaaagaactagtcaaaatagcaacgtagatgtcacatcagttaaaactgagaaaaatgccgccgagagacctaattttcactagttttgtaagctgggaaatacattatatctagttttataattcaaggacgaatttgaaattcggtgacaagatgaggtgcctccggtgtactttttacctcggatcgcaaaagtgacccatgtttttggtgggcctttgtgggctttccaaaagcctgtctcaagcgagcccaactttggtgggccgaattgtgtttagggaagttgtgcggcccatcacggattggcccattatactgcaactaggccattcagagcttcggatccatggccggcgagcccagctctacgccggcggcggcgacggcgaggaccacgtgacgtgcggatcagctcggaggcaacggcgatccatctcttctctcccccctcacgattcagaggctcaaccgagcggcgaacgggagcgctcgacggcgaggtgcgcgcacgcgaatccagttcccctagaggtcgcaactacgcctccacagtgttcctaattttcttgatttttctgtcacctactagtttgttgatctgcttaatttgtttgtcacatgctagtttttttgcaactatcggtgcttatcgatttagcgattcttggagacttggtatctttttgtgttgactcgctggtgttaggagtgatgctctctagctgctcgatgaaatgcctgataaaagcatcctgtcatgccatgccaatacatctatcaacatttattctcacgatttgttcttctttgctaatgtacctatcaccatcgatttgcatgcagtaggaccatcggatatattagattaatggtgaatggcgtaatgattttattttacaaagtattgaacaagattgcgagtggcttgatgagttcattattctttccgatttcttctgggtttctagagtcatgcagggggcgcgcgttaatctgaaggggtggcaacaggcagcggttgcatttggttctgcatttggggcattgcttgaccctagaagagctgatctgatagctactcttggggagactactgggaagccagcatttcaccgtgtgcttcagcggatgaggaacagtgctgaaggcagggtaaactcatgctaccctctatttcctaaagggtgacgttatgccgatgcatccatttgttgtgcttgaccatctctttatagccttttttactagcatattctgtaaataatatacatatatactcagcttctgaaacagcaacagtttctcggtcaacaaatgctaaggactgtatgatgtagattttttgtgtgaagtagcattatcctttttacttggttgtttcagggagcaaatgttatcctgaaaaatggaatttaaggtgtaggtcttctagcgaattatttttcgtatgttgtccatctttttgttgtttgtttgttctgttatgcattttactctccagaatatgttccttatttggctgcagtataagtttacccatttagtgaacaataaatttaaacctgctattgctatacttgatgcaattttccttcttattacatcactgccatgcaatttgcaagtacatagcaacacatgccaactgaaaatgtgtacccaactctgtggactttttttcccaactgacttaactaagataatattcctgcaggatgttctcctggagcgtcctcgagttatatccacgcaggtttctcatgcctgggacatgcctcagaacacatttggtgcagcatatgctcagttcatgggatcaaggaacttctcaccagatgaccgcccacctgtccgtttcattgacacagatgagcttgcgtatgttgcgacccgtgcccgtgaagtccatgacttttggcatgtgctgttcggccttcctacgaacctgattggagagactgcccttaaggtcattgagtttgaacagatgttccttcctatgtgcatgctttcagtcgttgggggctctgcaaggttcaatgagaaacaaaggacactgtttttccagcattatttcccatgggcttcaaaagctggtcttaagtgcacagatcttatgtctgtgtactatgagaagcattttcatgaagatttggaggaagtgaggaggaactggggaattataccgtgccctaatcccaaaaggagcagtgtttagacttttagatcggtacattttgcatgaaagatgtatgaacttggtatttagctttgtctatgttagtattagctctttcctttgaagaataatagaaagagttatgctactgatacctaaaaaaaactagtaattctctgtaatttagcatagcaactaagcttgcaatgtcaatgttccctttaacaatagtgtagatgagttacttacgtgtttatgtgtaatactagttgttttgctatggatagaagaaaatgtattataataatatctaaaataaaattatactagcaaaagtgcccgtatgttgcaccgggtgattacggagtgtgtatattgaccaaaagtgttgtttggtttagaaaaagtgcccgtgcgttgcaacgagaaacatacagatcagaaaaatatgcaattaattaaaatacaaacacattcaataactataattataaatgcttctggaaaaaatgaagtactaaaaatgaacttcttttctttttcttcggcctgagggaccaaaaatagacttctttctggcccttgccagtcagcccaggcctttttcgctcacgcgggcgcacttcccctccctaggccgcaacctgggcttgggctagaaaagtggcctcgctctcgatccctcttgggccgatttcggcccggccgacgccggccgtctgatctctagggttttgatcggacggccgagcgtcgagatcggggaaacaaaaccccctctgggtttggtgtgaacttctgtgatgtatgttggtattgttgttgttcttggatgattttgttattgttgttgttcttggatgtggtgtatgtcgtcgttgttcttggatgattgtggttgattttggaggcaaagagtgattgattttttttgggcgacggacgaaaccggactgaaaaaggcagagttgttgattttttttgggggcgatggacgaaatcggactgaaaacggatggaccaatcggactgtgacgataggaaaaatacaaatatttatattattagttatatatatagatatagatttactatatggaatattcacctcaatttgattttaagggtatgttcagattggtgctaaaataaatcttattaaaatttggcaactttaaaattttgataaattagcaatatcgccaaattttcataggattgtcgtacatatgctgaggaagagacctagacatgaccgaaccgtgtcatgcctgaccgagccaaatctccgtgccattaggctatgggccattaggcaagcggttcgtcgtgaagtcgtgatggcgagggatggagatgggcagatggcctgtaccccacatgttgtagctgcagccgcatgcacttgcccgacactaccatggctgccgcacggcaccggccatgtactccttgctttgctcacaaaacgtacgtattcccggccgcaacagcatggtcaaattggtgccgacgcgacggtaaggccatgtacagtgcgtatcctcaaactatagcctcgctcacgccgcccgccgcccgttcacgagccatgcccttggagggaggcacgaccctcacgagggaaacacgcgcctctacctcctccaattcccttttcttgaggccgaggcgaataaaaggaggggcgacgaagaaaaagagaatagagagagggggagaagagaagagaggggaacacctagtgtagacttttgggttgggacacccactatgagcttgagtacttttattcaattgcttcagattttgagaagcctatttagaatatcctccattggaagatgagtgccccagagtgtcctcagttagtgagagcactctaagaatggctttgattgtacatgccctaattaactcccgtctgttggtggtggtggtggggttcgtagatgatcttgtatggggcacgtatgaggcaccggagcaacacgtacgtggcctcgttgggggcgatctcaacagggggatagccgtgttgttgtatgtatgcgtacgttagctgtcgacggcttgcaacaccctgactacatgtacacatatatagctaaagaaagttcgcttcttcttcagtggcgcccgcgttgagctgctactgcatctcatcaccagctagctctgtctcttcaatagtgaaggcttgtaggcaggagcgcgcacggtacagtctcatgcgtggcgaatggctcgccaccttgcacaagctccaaccaccaccgccgtcgatggcacccccgtcgcatgccagttagcgccatctttaccccgtcaggtgctctccctactccctcacctcgcctcctcctgctgcattaattcccgggaaagaggggagagacagagagagacggggaagaaaggaaagagaggggaggaaggagaaggtcaacctcactggctcctttgcgtccctcctcttcttctctgtcatggaccaccggagtccaccttgtctccgacctaccatattttagtacttttttttaactatgatgtcacattagcaaaaccaatcatctatactgtcatgggaactgacttaaatgattttgctggtgaagatttctggcaccgtgctttagggatatcgattaaagacaacataaagacgagggaagataactggacttattccagctaccaatagtgtaggcctgcctgccgattcttccctacgtgctctgcatgtacacaggcccttgctggcccatatataaaaggtgcgatgtggctgccatatgtagcactataccaggctcgatggagacgggaatagattttaaggatcccttaattaggtcagttttctttaaatataatgtaaatgattacgaacaatttcaaaaaaataatgatgtagtgtacaagtgacatcaatcacttaaaaattcaagttaaaaaaatctataaaatcgtcacacatttgagcatgaatagtaccggtactgttaatatattggatttgtctttttgatgtgcgagttaagtttagatttgattaattggtactttatataagtttgaaccttttcctgtagtttttaatttttttatatgaattctaagtttatttcacgtaattttataaattttatatgttggcataattgattattcaaccattgaagagtgataagtaatagctaataggaacgtgatgaaaccattaaaatattctgtagggatgagaaaagtaactgaaaattttgaaaatttaatttagacgcctaacactactaaaaataaatccaatcaacttggaacaagttcaatggaacaaaacccatcaattccattattactcgaaataaatacaacaagcttgcgatcaacagtacattgatcatcaactaatgaccaactgcatgccacacaagcgttattacaaacagttcatggccttaagcaaagtacgatgaaacacacgccaattacaacgtacggattcatggatagacagctagttaattactacctccgtcccaaaataagtgcagccgtggatatccgtgcccaacgtttgatcatccgtcttatttaaaaaatttgtgaaaaatttgaaaatatttagtcacacataaaatactattcatgttttatcatctaatagcaataaaatatactaataaaaaaattacaaataaaacaaacggtcaaacgttgaacgtgaatagtgtaaaactgcacttattttgagacggaggaagtagctagccagccagcaatggcgtctcctccggccggtgagcaatgcaagcttgttgacgtagtacacatcggattggaaagcttgaaggtgcgggctcccgccgccgggccgaggaggtcgctccactggtcaccgatgttaccgacaatggcatagccatcgctcaccagcttatgccgctcaccgctcttgaacgcctcgatggagagaccccccgtcggctgaagcaccagcttctcccacccggagtagccctgttgggaaaggttgcggatggtgacggccctctggttctcggtgcggactgtcaggaacaccggtttaatgccgagctcgagcagccgtcggtaaagtcgtagcgtccctgctagcgccggtgcggtcccctgctccacgtattggaggaagctcctattgtcgtacggctgggctctgtaaaatggataatatatataccggccgtttcaaaaatgtgtaagcatgtagtattagcaaaaaatatattacacatgttcaacttttttgttttatgcaaaatattttaagcaactaaaattgtgcctattttactacataatgtctaaaaaaacttttatatttttttactaccggaaagagtattttagtcatcactacctcttatgatgaacgggcatcaaacaattgcaagaggtattcattcattactagaaatatgagcgcggcgccacgccgcgcacgttaatatcgacgtggttagaaccacacataatcaatgttaatttgacaacgtggagtggaatattatatacatgtaaatttggtttaacatcagtttattatatgggcccccttttttaagaattgttagtttttttgccatctaaaagtggataaaaaatggtataattttggaaaacaagcggtaacacgcaagaacagcagagattggtttgaaaactataatttagtcgtatatgggtttataaatgataaacaacaggtttactatgcagaccaagtactaaacgaatttacagcgagttgttaatacttgtataagggtctgcacatttatccattactttttccattacataatgtaagttattctagcatattacttttttcattacataatgtaagttattctagcattttacatatcattgtgaatgttactgaatttagacgcatatatatatctatattcactaatatccatatggatgtagaaaatgctagaatgacttagggtgcgttcgtttctgggggattgggtgagaaagcccatcgtatgccgcacgcacgctttccaaactactaaacggtgcattttttgcaaaaattttctataggaaagttgctttaaaaatcatattaatctatttttaaaatttaaaatagttgatactcaattaatcatgcgctaatgactcacatcgttttgcgtatcttcccaatcttattaatccccttctgctcaaactcacccttacattacgaaagggagcaagtatatggttattggtaaggatttatagggaggctaaggtctagttcaatctgtgaagagtataagtcagcagcctatatacgtgttggaaagttactttatcagtatggtattatcgtgccttaattctgggctttggaacatatggtactgcgtggggccggtagagttaatattagggtgtgtttcgtgtactctcatggtaccaaaacacaacagagcatttacggcaagagtagtcaggaccaccatagtaagatcgaccagaatacgcagctaaagaaaaaagaataaaaataaataaatagccatcagaaaaaaaggtagaaggaggaagacggaaacaaatacgataaatggagtataagggaaaaaagcacgagaggaaacaaacctttcaaatggcatatataatcggtggaaaaaacaacatatccaacagggaaagaaggattagaagtaggaactgtaaacgaggaagaaaaaaaaaagttttcacaccgagcacgggaggaagaaactaagaataaacaaagagcagcagagaaaacaaggctcaacatgggagcaaataatcaaagaaacgataaaaaagataagataatgagaaagaaccaatctggtgaagcaaacaaccgccgacgtaagatcgccaatttccttttccttcgattcaccaaagactggtacgaaggaccagacttgaacgatgcagcttaaaaaaaagtagcatgatcaaactatctaaaaagtagagggtaaacacaaatttaaatctaatgagtatcgaaaagcatagcgcgctaatcgtacagtaaaaaatgcaacggaagaagtcatgtttaaatttgggtcaaaaggagaataaaaatgaatatggtaaccaatgaaactgaaattaccagtttgtcgtgtcagttcacatgctgagcgcgaggaaaaactcctaccacgaaggattgcagcacggcgagctctagcagctgatgcagacggcataaaccaatacggccaagcaagtatacccagtgcttaatacgatttggcaagtaaaaacaataaacacataagtttacagaaacaaggaggcgtacaatcatcagaaaattagcacagtataattgaaagaacagagcaagcgtcgggaacgggaggagaaaataacaaagaaaagacaaacaacaaagacaagcaccttgaacgaacggatcgcagagagaacagaggagctatcactaatgcagagaggaacaatataaggggaggagcaagaagagacaacaagcaagagcatggacacgcataaaacaaacagcaggcatgcaagctgacacctaggccattaaacagtgaatcaaatcgccagcaacctctgttaacagtaaataccaaaagaggtcgggacacatccggaagaatacaacgcatgggacaacaaagtcaacttacagaaagaacaaacggacagcaaggtcgacaagaaacaccagctgtttttttaccactaataacatattaaagactaatcgagcaatcaacttgaaaaattacaaggcatcacagcaacctacatcacccaaagggcgaaaaataccgcttacaaacggaagttaggcaggttaaaataaatatgcccatgtgtgtacgtagttagtacacattttttttacccctacaaacagcattttacattttaccaactacgtaaatctgtaacactgaaaccatatttggaaaatagattaacataccgcacacaacagcaaagagggcaactcgtcatacactgacacctgatgaaaaagggagatttttacaagcggtaatacatatcatcaatcaaggttaagcaaggggatttgggaaatttaacaagcacaaagtaaatctaggtgttataaaaccggccccgaaatcacatcggaaaccaaatacggaagaaaacgccataggagatccaaacatgatgacaacaccgagacacgatatttgataacggagttcagccgaggcctacatctccggggcactgattacgggcgcttctccccgatccagcatattacagcgtatgagagttacaatgactcacggtcggtcgctgccggtagctgctccctctcgctatgctaagtcaccatgcggttacaacaggcacgctcctctatttatgagagaacctaggatagagtccgactcttaccctagtcctaatacctattacaacttcaagtccaaaactgtaaccgactacgtacacatattcgatataaactctaacaaactccaccttggcgaatatgccatgccaacctgaatttgttacttgctcgaacctccgtgtacccggacttgagttggtcatttttcgctgctcaggccgagctgccccgacaaacctccatcaggctcaccgtaaacaagagactcccgctatcccggtaacttcttcctctcgactccacctgcagcagtgctacaccttctctcatatcaccatagttgtcttgccaagcgaaattgaattcctttctagctgtcacatcatagactccccgaagaccatgttcacctccatcttccgtcttaaatttgacttgatctaatccatggccagataaccgatgtcatcaccaaatagataaattgaacttactagacatgaagagaacctttcttgcttgttgtcttatgaactgagctaaaaaatccaatatccacgcttctccgtatctgtagactgagtatccgataatttgagaaaatcaccgttgcgttgaatcatctgaagaacttattatcatagagcttgctctttctcttcagtgatgcagattccatatatccccatcatgcaaacccgcagattctggatataccctgtattgccaaacagaccgttgacaccctcaacgattttcccccgctgttacccgggatcttcttcacgcacctttgccacacccctgcaccaccgcagccttgccttcgaatcataatgcagaagccctgatgcacagttatttgctgtcaattccagccacctagcctccgtgctgatctccacgtccattgcgactccgagttgataaacaactctgcaaccgtgtcgatctccaccagctacgcaaactgcacatcctctgcaacctgattccaataccaatttgctgctccgtgcatggacctacacacaatatgcccatggacttccctgccgcatgcatgcacatatccagagccaccacgaaaacgagcctgcatgcacatgcatccaattaactactccatgcatgtaaccatgcaattaattaattgatgtcttcatgcttgacttgttcttcgtgtctgattatgatccatggcaaaaaatccaaacggctcctattgcttggtccaattttattgtgttgctcctgtgtgcaccgccaccgcctcctctgaccggagccggcccgacgaactacgccagcacctgcacgacgactacaccaagccgtggtcctaccgctcataattcgttgcccaaaccaccgccgccaagaaatcgggaccgatctcttcatcgctttggttgtttgattcgattgcaatctctgcaatcccgtggattcctcttgctgctttacagggacaaattgagcccgattctatttccaaatcgaattctcctccgatcccctttcgtgtctgacgcggtatccttcttgatctctttttgttgtgtgtattgaagccgagctcgtgctcaactccttttctaccacggcccccttcgagtcgagtcctgcatgaacccaaatcgggtctgctaccaccagcaccgcttctgtctccgtcgtcggcttggcctcgcacgtcgctacgaccctgacgtccaagcttcacgtacccccagcgatatcctcgctccaagagcaagcacacacaggacatagcatgaccaccgacatcgtcaatgacttccgctgccaatctgcgtcgaccctatcctgtcctctgtaatccattgcatgtacgtctctaagtagcaatcctccatgcagtaccttgccgtcaacacctccaaaacagcctctaggaaccatccgctccgacttccgattgaacgccatcaatctagtcaagagccgaagccgacaagtcacatgccgtcttcccagccgccgaacgacctgagcgctacgtctagccgtctccctgtcgaacgcagctcatcgaaaggcccaggtcacctcgcccagagtgttcgattccaccaaccgagaacgccaatcgcctccagcttcaatcaaccccgagcgtgtggccacacgtctccctgttgagagtagctcaccggaaagttcgagccacccacccgaagtgtccgacccatcgattggatcgccaatcgcttccgccgccatcaacccgagcaccacgtttagtcatctccctgttgattgcagccatcgaatggttcagacagccacctgaagtgtccgattccaccgatcaaaattcctttgatcgccgccgtgctccaccttgcgtccatgtccgtccctggacaccctgtgtagccgtcgcggcgtggagcacctccctcgtacctctactatggatctcccacaggctttggtaccacttgttataaaaccggccccgaaatcacatcggaaaccaaacgcggaagaaaacgctataggagatccaaacatgatgacgacaccgaggcacgatatttgataacggagttcagccgaggcctacatctccagggcactgattacgggcactcctccccgatccagcatattacagcgcatcagagttacaacgactcacggtcggtcgctgccggcagccgctccctctcgctatgctaagtcaccatgcggttacaacaggtacgcttctctatttatgagagaaactaggatagagtccgactcttagcctagtcctaatacctattacaactctaagtccaaaactgtaactgactacgtacacatattcgacacaaactctaatactaggtaggaaaaagtaaacagcaaataaattgaaaagagggccaaaacctgcgtaccgtagtgcttggtaccatgaaatacaaaaaaaaaaaacaaagaattcggcaagtaacgatgtacagagcgtatagccgtgctgctccttcttctccatacacccccacagtaaaatttccaccatctctctccatcgtggagccattggaaccggcatattgggggcatccccccgatcaaaatctgtccggcgagcaggaactccccgacggcatcgggatagagcggctgacgtggacgcggttcaacacctccgacagagcggggacggcggcgtccgtgcagcacaacacccacgcagatcccacagagctacccctcatcctaatcgcaatccccggccaggaacgggcaaatcccatcccccatcgtcggcacctcctccggtcagcaaacacaacggaagggaacacatccaagatcgaaggaaaaaaaagcagtcacaacagaggggaaaagagactgaaccgagtgatgaacaaatacagcaagaaagaacaaagaacaacacaaccccaatgtggactaacctcgaccgattcaggaagggaagatgggaagcagcaaggggcgccgacaaaagcaacaggacaggcgagctcgtacgaggaaaccaccggcgacggggagacgaccaatccgaagggcacaagaaagaagaaagggtcaacgagggccccatacagagacggccggcaggggaaaatcgcacctccatacccaacacaagaacaaaccacaaacacaccccaaaaacagaattttgccttcttcacattcaatttacataaaagctaagggcctaaacagaaaatcacaaagacacagagtacagaatagatagaccgatgtgaaataatagaacacacaagtggaccaaaacaagaaatggcaacatgccacgcgccattcaacgcgccagccaaccggaaatagccgtcactgtgaccggcatccaaaccccaaatgcatgaactaattacctgatcaaccggcgtaattaagcaggcaaccggcgcaccggcaaatcataaacgcgcaggttaggccgaggagcagagaacagtaaacggagacgtgtaaaaacaatcagatagccagaaaaaaaccaaaatcacgagaaaaacggtggggttaggggagctattgattgatgatttatgccccctaatgtataaacgttgttatatacatttgtcccatgaatatggtatacatgatgaggccccctctttgtactcttctgtaacagtttcaagttactatatggtatactccgtacattatgtcggttatcatgttggctttggcgtttttcccgtctcacgacatatgagtaccagatgtgttatactcgtgatagaaatagactgatgcacataactaataacactggccgttaacccgtgtgttatttgggctattacgattggtataaaataaatactgaattttaaccatacattgaacgcattggttattttctgagttacaactggtttttcccatgccctaattagatcgatgaaacatgcaagtactaattccaaaatttcagaataataaattgagctatgatatccacctgtatgttttggtttgacacatactatcataataatcgacctaatcgacagacggtcaaatcttcctatatcgtattcctaatggactctacactcttattttcatatttcttatattttaattccgaacttaagttatttcctgtatagactctagactcttctcctaatcttcattattttttaatttcgaatttcagtgttttctaaattgtaattctatgtgaaccctaaaccataaaatctattttttgcaggcggacctattaagaggccacacacaaaaataagcatatttttttttgcagacaggcctctttagaagccgtatgtaaaaatgaatgttgatttttgcagacgtgaccaactacggtctgtcttgtcttgtagtaaagttctaaaaggacaatgagttgtatggcctctcttttcgtatgcgggttcttaagtggcctacacgcaaaaatattcattatattctgcctttttttctccccttctctctcttcacccacttcaaatttttttcacctcctctcttctctctcttccactcccttttattttcactcctatcatgtctctctttctcttctctcccctctctctcttcctttcctctcctctcctctgagcgtctggcgcacgggtggcggctggctcggcaccgaccatgagcaagcggtggctaggagcgggcgggcggtggccggctcgggagcggcgctaaccccatccccgctcggcaccactgccaacgaggaggaggaggaggaggcggcctagagcaccgccgcatggccggattccggcgctggcgccgccaccaccactgcatgccagagttttgatttttgtttttgagatttttattttttcggatttatattttttgcatgaggaagacataagcacccgcaagtgaaaattgaattttcgcgtgcgtgtgtcacccgcacgcaagaatcctgttttttgcagacacttccgggcagactggccagagtttcacatgcaaaaatcccttttttgccttctggaaagattgtttctgtacttgtggaagatttgacaaatctaatagcgttttctattcttcatgaaaaattaagttcaattaacttcgaaaatgctcaattctagaaaccatcttgacccatcattaataattccactattaattactgtaaaagatacaacaagcttgctcaacacagtacattattgatcgatcaatggccaattaccaaacaaaccattttttatagcaaacaaacgttattacaaacttaaatcccatcccaccgacaactaacaagcagaaaccctctccctctaaaaagaaaaggagaaataaagcatatgagtcgaagattaattatgagacgcaattaatgagaaaacgagtagatgaaacggacacgaagcatggatatatagttagctatatagcgggctagctagctagtcgatgtagtacatgggttagggaacttaaaggtgcggcaagccggcaaccctccgcgatgagcgacgaaatatagttccactggtcatcgatgttgcctacgatgatgtatccgtcattcaccagcttctgccgctcgcatgtcttgaacgctagcgtcgaggtctctagcccttctggttggagcacaagctttcccaaattgcagtagccctgctggagaaggttgttggtggtgagctccctctggtcgtcgtcagtacggtcactcaggaacagtggcttgatgccgagctgtagcggctgttggtacagcctcagcgtctcctcactggagaatgccttttctctcccaattagaaactctttttgtagtcccggattataaattaggagaagaaattcgggattaaagatagcggtttaaatacccgggaataaagatgcatctctactctcggttggtgttaccaaccaggactagagatattttatctttttttatatactcgtgaatcattgtttttagctatttgcacttgtttttcaaccaaactcatccacagatcatctcccgacatcccaaatcattcgtaacaacaaaatcatcatccacaatttcaaatcatccacaacaacatatatagtcaacaaaaatatcatccacaaattaagagggaaaaaaggaaaaaaaaacatccggcgtgcgcccggccgcctgccgcccggtggccgtcgctcgccacgcgcccatctgcgccgccgcccacctccgcgcgcccctccgtgccgtccgccacccgttgcgcggtccttcatgccgctgcccgcggcgcctccctcagccgctcgctcacctctaccgcaagcaggcagaagaacacgacttagtaggaataaggataagaaaatagagagaaaagagagaggatacgaaaagaaaggaggaggacaaggaaagagtggttgctagaggataagtgcgagggattatatactatgcgctgatttttagtcccggttggtgtttccaaccgggaataaaaagagtagaggagcagacacttttcaaccgggactaaagatcataaaaaggctatggacttttcaaccggggctaaagatgatttttagtctcggttctttttggaaccggggatggttttcggctgacctagcaaaaatcagttctctagtagtgcctgcagagcgggcacacctcttgcacgtattggaggtatagttagccgaaaggctcgaggctcaatggtctggtccatggcacgaagttttggtccgtcctaggcatggcacaacccgaccgttgggccgtgcttgggcctctgcatcggcatggcgggccggcccggcacggtctaaagatttaggaggcaaaatcgataagggagccaaaatagacttattccagtcattcaaggcaccgccaaagagttgtgggatgcaaaatagacttagtatagctttatatataagacacaacccaatgagttgagggacgcaaaataaaaatttttctaagaaggagcacggtggctttcgtgccttcgggctagcgggacacggctcgaatcttattgggccgtgcctgggttgttggtgcagcaagtaggcgggcatgtaggtcggttgttcgactaatctcggatccggcttgatcatggccgggccgtgctgggctaggcggctcgtttggtcatctataactggaggcagtttacattgttgaatggttaagtcctgcaaatcaagggagttagattttaaagaatcatagtagccaatccatattgtatattgtattattattgatattagagattaaaattttaggtatatatcaccaactatgttggtcatatttggaattatagcgcttaagattaaggaaagtacacgttgtgatttttgccttactaggcccccgtgtcgccccgctccagggcaacacgggcggcgacgccacaaaccccgccgccaccccttccccctctcctcctccgcctcaccaccaccgacaaagctaagcgacatcaaggacaacaaatgtggggcctctcccttcgctccagccacagcggttggggcaacaccaagatctcagctggaggggggtggcgaccgtcggcgctagttctggcaccgacgaggccggtcgcagtggattcggcccacccgtacccagatcgggcaacggaggcgccgacggcgccgcttctggcttgaggaagaggccacggcggatctggggaggcaagtccgaccccctgcggccaaacgggaacgagattgatagcacggtggcaaagtcggtggcgtgcgtggccctagagtcacgtgctcgcgcgggaggcgctaggcggcgtagacgcggccggcgggcctgggcggctggaggaggagggcaattttcttatattattaacatgtatatattatagatgttatagtgcaatttttgaacaccctcccttaaaatcgtgggcccgccacacctcaggccaaccaccatggatgcatatgcaccaaggaatggatgcaagcaatgccctacctagagtgtcaagttagttcattttacgtactgataccatcaagaacatatggaccaactataaggtgtagtgtcccatgcatacagaaaacaaatttactactccctccgtttcgaaatgtttgacaccgttaactttttagcacatgtttgactgttcgtcttattcaaaaacttttgtgagatatgtaaaattatatgcctacataaaaatatatttaacaacgaatcaaatgataggaaaagaattaataattaattaaattttttaaataagacgaatgatcaaacatatgataaaaagtcaacggcgtcaatcatttcgaaacggaggagtattcaacaataatctgtgcaagctcatggttgcttgtgaacagcgaaaataggacgcttcgtaggatcgatctgaggtgtttgttttcaatattaactagcgtatatagtcacacgttcgcctgactttaacctccctctatactgaatgtgtttttacatattatttgtggtttataaacatataatgaggattcatttgaatttattttaaaattatttatatgtaaataaagatcacggatagtactgcgaggatatgactagggtttatatttatcttctccattatattttctctctccctatccgctcaaccataaccatatctgcgaagatatctttttctcatgtacttgagccaccgcacgcgcttcttcaccaaattaccaatcagcatctccatggttgcatgacccctttatcttcatattatattctattcattctcattttcggcaaattatgtttttacatacttgaataggtgttaagaaaatgtactatttggcaggaaatctaagtataacacaaattgattgtcctgatatgtaataaataaatattatcacggaaataaatattttacaatgattatgctaaacttgtgaaactaccctaagaaacagactataaaattttaggtgatcttatcatttattttttaaaaaatgataaacaagaaaccaggagacatcctgttgagagataaaaatccatctcccttattatttctcttataatgatatattcagtcacataatggatgtcttctagcggaactattgaactccctcgggggtacgaccctcctttgttgcatgcagtccaagtgattacaaaacatttttgaagatggaaaacatagatggctgtgttacatattcgtggaaaattttaaaaaatacatcacatcaggcaagaaagtaaagttcagttaaactcgtagttggattgttacttttatttgtcgatgtatagtttaaatttgttgattaatttttatccttcatttttatggaggaatgtacgtaagtggcaatactatatatatcctcacatgtttgtgaatggacatatatatcatgaacgattattttatcttcttttgttcttaattttttataattcctgcaacaacataatcgtagtctttaaggtcttgaaatcgactttctatctccaaaatgtgatcaaatcccaaaaagagtggattttaaattaccattttaatatctggctaattactaacccaatctggaatttcctttgggccttgttcggtttggagggggttgaagggaattggaagggtttgagggggaataatttcacactataatagatgtggaataaatcccctttaatccccctcttgggattaaccgagcatggccctggtgaaaacttttcttgtgggctagcaaaactgccgaggaaattgctgtttccttaacggtgctaagcaaactggcaataaattgtactgtatatttattgaggagtgactgcaagtatatggtagttttctcgggtgtttcactgaatcagcaaattaagaaattgccttttattgcgctttattcgaaaccaccaacaatccttttctagatggtgctaagtaaagtggcaataaattgtactgtatatttatagaggagtgactgcaagtacatggtagttttctcgggtgtttcactgaatcggcaaattaagaaattgcgccttttattgcgctttattctaaaccaccaacaatccttttctagacggttttggtacttccttggtggttttgtagcactcaagaaatttcctgatgctggtaattcagtcaggccatctcgaataaaactaaaaattctagagagagagataagttaatttgttactatttttgaagatttgacaactccaatcacttttctgtttatgtataaaaaactaaactcaaagaacctcgaatatgttgaatgcaactctattagaaaaaccattttttccgacgatgacattttttttttagccaggtagatctctcggagctaaatggccgcctacgaaaatgacaaccggggtccgagatcgccgtccgcctgcgaaaatatattttcccatgcaggcggtaccttaagaggtctgcatgcaaaaatattgagcaccataaaaatagtcacctacgtagccaaaaatcgttaagtcccgcccctcccacgagtcttttacccctataccattaaaaaagttgctgcttatctgtgtgccacaaaaaagtttggagtcacctgtatgccatgagaaaaactttcactgacccgtgtgccattccgtccaccttctgttagaacttaacggttccatagctctgacatgtgggacccatgtatgaaaatgactaatttgcccctaaaggattttcagctctattctcctcttctgctatctcccgtgagtgcctgctctctccctgttgcgccgcacgccgccgcaccctaaccctagccgcacgccgccgcctcgccggagccgtcaccgccggaagaagatggcccggtcgtgcgatgccatggagagggcgcgtgcggtggctggggagagcggcaagtggtgggcgctgctgctggggtggtcggggaaggccgactacatcgaggcgccaacgccggcgaaggagaaggcgcgggagctgcgtgcgaggatggcggagacggagagcttccacgacgccatgtaccactccgccatcgcctcccgcctcgcctactccgcctaggcgcgccgccgcctccgccggaggaggaggaggagggagatgagtccaactcgccgccgccgccgggggtggcatcgccgcgacggcgtgtatataaaacccgggtgggattcgtctcgttgctctagctgctgttgttgcggaggaaatttagaagggatctggtttttttagaattgatcccttgcatccatccatctactttgccttttcattttcttccgagatgtaatctggatctgagatcgagatctacccgcttgtggtggactatgatgcatcagatccattaggtttgatatgaacttgttgctatggatgcaatggtcatgtatggtttgatatgaacttgtcgctatgggtgcaatggtcatgcccttgttttttccttgtgatatgtcgttatttgttggtatgcaatggtcatgcacctgttttttccttttcaaaaaaatcatttccgatttttccttattttttccaccattttctaatttttcccacattttcctaattttccccggaattttaatcatttttaaaatttattctcactttttctgattttttgccttttttaatattattttccattttttctgattttttaacgccttttccaaattatttttaatttttctgattttttaaacccattattgtacacaagggcaaaactgtctttatatagcccctaacacctctgttatgtatccatccatccaaaatggcacacgggtcaacgaaagttgggctcatggcatacaggtaactccaaacttttttgtggcacacaggtaagcaacaactttcctaatggcacaggggtaaaagactcccccttccacctctccctcactctcctcagcatgtatcctcttctcctttccccagcggcagcggcgggtgacgtcggctcctcccctttggatctggccggaggtaggttgtagcactcggcggtagagaggaggggcggcgcggtgccggcggcgggtggcgtcggctcttccccaccggtccgggggtaggtcggcagcgcccagtggtagggaggtggaggggcagcgcaacggttgcgggcggcatcggctcatcccctccggatcttgcggcaggtggcttccggctccacctctccggatcttgcggtgggcaaggtccagttcctctcctccggatcttctccctctccttggccagaggtttggttggtagagcgacggcatcctggagcatccgccaggcggtagggggaaggaggggcggtggcggaagctcacgtggcggctcccctctcctccctttcctagatcctcgctccggtggcttggcgcggtagcggtgactgcttgctccaccgacaacggccatctgcgatgatggtgtgatggatttgttttgtttgtgaatttatgatgcttccgtgtggattcgatttgattttggagatgggggattggattagattggatgggaattgggaattgggaaatgggaaataggaagctgcggctggccaaaacggcatcagctgcaattttttttagcataacaaaatctcttcgcaggcggatcagttgcccgcctaggaaaatcatggtttttacgggcgttgaggtacagacgtcattgctgtccgcttgtgaaatacgttttgtccgcctgcaaaatacctttttttttaagtagtgcaagacatcatattggcccatcagttccattattaattctgtaaaaatacaacaagcttgctcaacacagtacattgaccaatcaatggccaactgccaaacaagcgttattacaaattcaattttcatctcacgaaaaattaacaaacatatcaaacatatgcacgcgtcaaagattaattactagatgcaaattcatgacaaaaaacgagtagatgaaacagacacaaacaaggtatatatccatggatagctagctagctagtcgacatagtacatggggttggggaacttaaaggtgcggcaaccatccggcgagcggcggatgtcgttccactggtcgccaatgttgccgacgatgatgtagccatcattcaccagcttctgtcgttcgcaggtcttgaacgccaacgtcgaggtctgaagcctaaccggctgcagca

SEQ ID NO: 75620 - DNA, 624 bp, Oryza sativa
gcaaatctttaatttcgttgcttgacattgtcttgcgagggatcaagtttcagttttggttaaaaatatggcaccacattttttttacttgttcttaatcactcttcccctatgcgattgttacttttaaccatagttctctttatatagcgtgtattacccgtcaacaacgaggcgtctgtggtgactttgtcaatctccaagatttaccggtccagccttcaaagatgctcataggggtagggtttgtgtgcgtgcgttcataagggtgagggtgcgtgtgtgttgtgagtgtctgcgttgtattgtgtagttctaaaaaaaacgtaattataaaaagacagtgcaattacgtagtaaatataggtaatttattgtgtaaaaacgatttgataatatattttgaaaaatgtggtatgataaatatagctagttccattaagttttagtccatgtttaacatatatttgtacctcgttcgtgtttccttcatacgcatagcagtaacttatgttttgcattttacaaagcagttacgatgagtaggtcattgtagctcatttacatatggagggttgtgattttgttagtaccttgacattgactcaaagcggcacatctcgg

SEQ ID NO: 75621 - DNA, 632 bp, Oryza sativa
ttttagttcgactttcgaacttataatagttcaaaataatcatctgctgtcatcatctactcaataaaaaccgaaatcctctgtcaccatcaaaacatagcaaaaatcaaatgccattaaaaagtgccaaatgacagttgacagcccaaaataaaaaagaagaaaaaaaaaggaacactattatattccagatttccagctgcaatatcaagctaccaaatggatccccaaaaaaattgcaatccattccatgaactgagcccaccatgcaccacacaacccccgctcctccacgcttctcgggctcccgtagaccgggtccacccgccaatccccccacacgtcgatatctccagcacccaccgcacccactctcctcctcactccgctcccctcctctcctcctcccttctcgcggaggccgccgcaaccaaaaaaaaaaaagtctaaccctagatccaggccccgcgtctccggcgatctcccggccatggcgactcgccgggccctctcctccctcgtccgcgccgcctccaggctccggggggcctcgcccgccccgcgcccgcgcgggcccgtccaccgaccgtcgccatcggggtacctctttaaccgcgccgccgcgtacgcca

SEQ ID NO: 75622 - DNA, 718 bp, Oryza sativa
cacacaaactttcaacttttccatcacatcgttctaatttttactttcaattttagcgttgaactaaacacagccataaaaccaaagcacattaagttcaaaagctacataccaaaagccatcatcaactgacggatgaatgcatcgcttattcgcttcattgcttgagttaaattaatcgcaagtttaagctagctagctagctagctggggagttcccacggactgatcaaatagcagaccaatctaagtaaacttttcatcgagcaccttgtgtgcatcggccaaagcatagcgaagatcctggcatgcatgcttggagcaatcctgacatggcctctgcagagagaagaataaggatgtggtggcgcacagctagaaggcctaagcatctatggggtcgccggagcatgctctacatgggccacagccgcatctacacggaccactactacgaccccatcgagctccagggcagccgccgccactgctgtgagtctacatggcactgacctcaatggttccatttgagtttcatggctttcgccgccgccaccgccgcgtggaaccagggcgcctctttgtgatggctggcgacgaggggttagcgctggccggatttgggatgggctgaccggtgatgctgtgatctctttatacctagtggtgtgccgcaatctgtgaatggggaagaaacggaggggattgggaggagacg

SEQ ID NO: 75623 - DNA, 1817 bp, Oryza sativa
  unsure (1)..(1817): unsure at all n locations
gtcccatcgggggtttggtcaatgcaactcgatctgaatgggctggaagaaccggcccaaaccatcccatctcaattggaaaaagtacaccgaaggtccctcaacttgtcatcgggataaaatacgtcctcgaaccgcaaaaccagatatgcgaggtcccttaactatacaaaaccggtcacccaaggtccttcggtggttttaacaccgattttggtctatgtggaggctcgaaccgcaaaccagatatgcgaggtcccttaactatacaaaaccggtcacctaaggtccttcggtggttttaacaccgatcttggtctatgtggcggctgagtcagcgtgggacccacatgtcagcgtgccacgtcaaatttcccctttcttttttctctcttttttttagttctctttgctgcggggagtagcaacgggcggcgcccagcgtgctgagcggcggccggcggggncggcgtgcgagcgcgcggcggccgggaggcggagcatggcgcagaagaggcgacgccgcggacgaacgcgttgccgacgatggtgtcggcgcacgacgcgaggccgagctcggagatgacggcctcggcggtggcggcctcggcggtggcgggcgcggaggtcgggagcggagcatggcgcagaagaggagcgtctcgcagacggtgaggtgggggtggagcacgtcgtcctgcgccacgaaccccgcgcgccgctgcacggcacggcacggcgcgcgcccgcctgccagcaccatcccggcgtgccggccggcgagccgcccgccgaggatggagaccagcgtcgacttgcctctccccgatggtcccagtacagccagcacctcccacggcctcaccttgtcggttatccccttcagtatcgtcctctcctcctgcgcgccaccaccaccgcctcctgccccggcgtgcgatatcctccccagcggcgcccccctttgccgccgccgccgtcgtggtcgcccgctccaccttgacgccacgtcgatgaactgagcacatcaagcatccaaccaaagatcaaaatcacctcaaccacacagagcagcatctatctatatcatcgatgtgtacctagagattaagtggcgtgcaaacggaggacaagaaacagtccatcttggacggagggcgaagcggggcgacggcgggcggagcagcgacgcgcgcgaagccggcggggcggcaacgggcggagtggggcaatggcgcatgcgggcgaagaggggcgacggcgggcggagtgccgacgcgtccgaactccgaaactggcggggcgacggcgcatgcgggcggagatcggcgcggggcgtacagcgatcgacggcggcctgggggccccgacttgctgatgctgttgaagacgaacaggagggcgtatacaacttgctgctgcttgtggtgatggacgacgacagcgggagcttgctgaaagccaagcctaagatttgtgtaaactcactatctctctctcacacgaattcactgatctcggaagaacgatgaacacgaacagagtttttggtgccgcttactcgctgtgacttttctgatgctcatatatatagccaatttgtacagactcaaattaacaccactacgccatcattcacgatgacgcgaccacgacgctgaaacccggatgactcgcacacgacgcacgacccggaagactcggcttacatgagaaaaaaaacagagaaacagactctgacgaaactgaagaaacgacaacgctagacgcgttacagtaaccgataatatggcacaggattatagctgaagctaaca

SEQ ID NO: 75624 - DNA, 719 bp, Oryza sativa
ctccggggaacgacgcgaagcaatttttcgaacaaccttctcttcagacagatcatctccaaggagacgaagatcgctgacaacaccctggagacgaaggctgaaatcctccaggtgttcgccattcttgaatcgcatggactcaaaagtttggcgcagcttctatgctcgggactccttaacacgatctgcgcccactcgcatggatttgagcgcgtcccaggcgtctttggcactgtccttctcggcgagcggccggacaatctcagccggcaccgctcgcaagatggccgaaagtgcctggcgatcctcctgatacgggacatcgccggtgtcgacagcatcccatagaccttgagcctggagattgactcgcatcaacaccgcccaatcagagtaatttgagcgtgtgagcgttggataggagaccgagccgccttccttaacgatccgctgcacgacgagctgtcgcctgcgtggccgtggaggagacggcgagagccgatggcctgttcgccggggagtacgagacgtgccgccggtgggagcggacatggctttgataccaaatgaaagccaagcccaagatttgtgtaaactcactatctctctctcacgcgaattcactggtctcggaagaacgatgaacacgaacagagtttttggtgccgcttactcgctgtgacttttctgatgctcatatatatagccaatttgta

SEQ ID NO: 75625 - DNA, 676 bp, Oryza sativa
  unsure (1)..(676): unsure at all n locations
accacaggagccggagatcaggatcccattctttaaaggggctttcaaggggcttgggggggcctttggcggttgctccggcttgtgggggggggcccctttttcttctgaagccttttgcggggaaagagggccgcccggctgacacaacctagcattcncccgggggggggggggggggggtgggcccccggggacccccttttgggtccaaagtcccaaaaggttaggtttaccccggggcactccccaccacaattttaggtttcagtccggaggaacgcccgccccttagggtttgggtgctgcgggttttagcgtcggggggccccgcgaagctggagagctgcttcgtcgaggagacgtggttggaggcgctttccgggggagctgcacaaaccttcggcgctcgagctctgccgcttcgtcgcccacgagaggttgcatagcccggtgcccgtctaccccccgccgcatctagtcttccacgcgcttcacgccaccccgttcgaccgtgttaaggccgtcatcatcgggcaggtatggcatcctcccccattttctctcgtcactccataagccaatccattggcgtggatttctgtgctaaaagaaggtatccttttcaaatatacatagcagcgtaaacttgtggccatttgaccttgggtaccta

SEQ ID NO: 75626 - DNA, 8129 bp, Oryza sativa
gcgaaggagggttcggtatcgtttacaaggtataccaatcaaattgtactatccaaccgtacctgcacgtgtgctcatctttttactagcttattaagtcatgcatttacgcgaccataatatcccttagtgaagcatattaatattatttatagtaaccaactaaaataagtgtttgtagaacatactttgcaagaaacgtagttataacaataacatgtatattctgatttgtaatgtggccggttcacgtgtccgattataaactatgtactttatctgtccacaaatataattgatcctatgtacttcatctatccactttaacattgaggtggaattatttggtgttccaaaatcacacctatcgtttggaaattccatatttttgtagactgactgcgtagatgagaagtacaattttccaaatgacatccatgaatagagatgtgtacgtaaaatttagtggtgtccaattactttccattgataaagtataagtttcttgttattcgtacttgatgcagagatctaggattttttttattaactagctgggtggcccgcgcaattgcgcggctagcacctaaacaaaatcatatatttttttagtatgattttacttaaaatttattaaatagctatctcattgttttaagactttgaaagaccaaaccttatcatcctcatgtttataattatatagtttttaaaagtcacaccagttactacccctcatgtcttctccttctttattttcttgcttgatataccactatttctattcattcttcttggaacctttaaaaattggattttatagtttttagagtttattgtcacgttgggtttcatttttataatttctagatgtcccgtcaaacgttgccattatactcctctacggcccgtccactgtctcttctctttattgtcattgagattttaaaaatcgaacataattatcgtttgggttcatttttactttctagaagtcctgctaaaccatcagcggctttgccactgtactcctctacggctcgcccgctgcctcccttctttattgtcattgagatttgagattttaaaatcgaacatgattatcattggttttttttactttttagaagttccgaacctttaaaaattggagttgtaattttattttttataatttttagaagtcccatcaaacgatgccactatgcccctctacagcccgtatgctgcctactctttattgtcattatgattctaaaaatcaaacataactattattggaattcatttttttattttctagaagtcctgtcaaccgtcggcggctctgcaactatactcttatacaccctgcccgctgcttctcctttttattgtcactgagattttaaaaatcgaatatgatgatcaatgtgttttttttttactttatagaagtctcgacaaccgccttactcgtttgattcacggcctacctgatgttcctccttttaatcgtcattaggattctatttggtgttttattaacaatttttatatgtcgtatcaaccgcctccactctacttctttataggcatgttacttaatttatctcgtcacgtgttttagatagtcttttatttcaataatctttatttttatcacaaattttagttatttataaattgcattcctaattaaaatctttttttttctaatttcagaattttttaaaaaaaatttagttaataccgtattgtgttctttcgatgtttttattttttattttcaatttcagttgtttgaaaattatatttctacttgaactctcttttagttttctagttttggatattattttatttttttattctaaattttaattaatctcgtattgggtttttatatggattcttctttcaatattgcttatttttaattccgaatttcagctaattttaaattatatttcttcttgaactcttcttttattttcttttgctaatttcggatttatttatatttattccgaattttaattaatctcgtattgggttcttatatggactcttctttttaatattccttatttttaatttcgaatttcagctatttttaaattgtactcctacttggactcttatttccttttctaaatttggattttattttattttatttttatttcgaattttgattaatctcgtattggcttctttcaatattgcttatttttaattccgaattttagctatttttaaattgtatttttacttggactttcctttccttttcttattttggattttattttatttttatttcgaattttgattaatctcatattgggttcttatatggaaacttttttcaatattgcttatttttaattccgaatttcagctatttttaaattgtacttctacttggactctccttttctttttttctttttctctgattaatgtgggaatttctagctcccacagcgaacgtggtgcctcctttcaaagctattttaacaatataatagatagatgttgggatgtttaatatccccttttcacaagggatcaattagtgctattttatctttcaaaagaaaaccatataagaaataaatctcatatacatttatggaccataaaaaacaaatctcatataaattttacacccgtcagtcagtcagctaactcaattaactgggcataggcccaagctcggtgctgtagcatgtggttcaacttttttttctctttttctttatttctttgctctctagtgtctactattcctatctctttgctacattgaaggagcgtcggaaaattctaaaataccctctttcatctaaggctatcatttattttatctattttgtcactttgtgaatctgacggctaatattaatcagatgaatgtggctcatactagttgcattctgaggttcgcttttcactaatagagatttcatgatgaatacatatccataattccattattaatactacatatacatccacttgcacagggagttcttcccgaaggtcgagaaatagctgtaaaaaggctctcacaaagctccagacaggggatagaagagctgaaaactgagctagttttagttgctaaacttcggcacaagaaccttgtgagccttgttggtgtttgcttggaagaaggcgagaaactactggtgtacgagtacctgccaaataagagcctcgacaccattcttttcggtacagttcagttctctcactgccctaacagtttgcgaaaatggaacatttttttttccattacatgaaaaatctgcacgcacaactacactatagattcgaatgctgatttctttgtttgaatggaagattatgagaaaagcaaagatcttgactgggggaagaggctcaatattgtaagcggagtcgctcgaggcttgcaatatctccacgaagactctcaactgagggtagttcatcgagacctcaaagcaagcaacgtgctgctggacttcgatcacaacccaaagatttcagactttgggttagcgaaactgtttgagtgggatcagacgcaagacgtcaccagtcacatcgctggaacatagtaagtactaagtggacctgcaattccatcgcacggtagtatgaaagtataattaacgatcatctccttatttttcagtggatacatggcaccggaatacgccatgcgtgggcagtattcagtcaagtcggacgcgttcagttttggtgttctgatcatagagattgtcacgggaaggagaaacagcagcttctccaactcggagcaatccattgacctcttgagtcttgtgagcatcattaatctctgctcctcatcatcatcaccatgacctgatcaatcacgaaaaccatcttcttaatcgagacatcatcctgaagaatttatcctgattacgcatgtaggtatgggagcactggacaacggggacgatcgaggagctgctggatccggcgataggcagccgtgcagtgaacgttctgctgaagctgatcaacatcgggctgctctgcgtccaggacaacccggcggacaggccggcgatgtcggcggtgaacgtgatgctcagcagcgacacggtctccctccaggccccgtcgaggccaacgttctccattcaggagatggacggcgccgccgacacggatctctacgagtcgggagcgtacccccggagcgcgttccagcccaccggcgacggcaacacgagagcagcggcggcggcgtcgccgaatgagttgtcgctctcggagctggaaccaagatgagcgtttcgaatttggagcgatttgtgcggatgaccgcagggtttttcttcaataacgaaagaatcaacacgtgtggcctctgcacttgtttgtcgataataataaataaatgccctcgttgatggttggttggagctctgcatatagttgcaagattgttttttttaggcgggtcacggggggtaaaatgtccttctgaatatattacgtcaaacgattttacacaagacaaagcttcaaactacgcaagcgcagaaaccctggagaataagagaaaaaaacataggaaagacaaggaagagaaacacgacaggaacacaaccacccccgagggcacttgagccaccctaacaggactaagagagagagggggtgcatgatgtttttcactaacaagatcacaaaaccaaactcctaatctgagctaaagccaattcctaacttgacaacatctactctacactgcccgaaaaaaaaatctactctacacgcaaccttcaagcaccaggaattgagaattgccggaaggccattctcatctatagataaattactccatccatctcgtaatatggcattaacaatagtgcacttgacatattactaaacctatcttgatcctacgacactatctcacgtggctcgatcttttagtgaaggcataactaccccatacaattgctacacagtgttgtctttaagaatctggggcctgggctaaatataaagtgagaccttatatataatgtcgacgatgtgctagagctatgctaaaaatactcacctaactacttgaggtgacgacctggccaaatataagaaaaattttatgcacttattaggaatccttactgcttggaacacacattcacaatgttgttactttaaagagcatctttacggttcagcggtcgataccaaaatcctggccgttggatctggcccgatccaaaagctggtagagtttggtaccgcgaggtaccaattctgtccttggtgcagtacctcgtggagaacagaggtggaagggaaaaaaatgtaatttcgcgtgcaatgaatgggaggaatggacgggaaccctagaattcctcttccgcgtcgccgcctttctcttccgatcagctgccaccatgtcccttttccacgccgccaccgtgttcctcttccgccctgccgctgtcgtgtttctccttcagtgttgcaagatcggcctccgcaccatcagcgacagtggaggcagaggcggatgagccggcgacggagtatgtggttgcggcgaccgagaagccgctccggtggcggcagagtagaggaggactagctggtgccggagtaggccacgggtgaggcgcgatgaaggaggcggcggtgcacacgcgcgtggggaacaaagactgtggcgcgtgtggaaggatagtcatcgaccgagcgcaccctagcttattttctctcccgatcctacccttcccagattcaatggttggatgaatttccgtaccgaccgataccagtaccactcggtacattctgctggacgataaaaaatctctattttaaaagtagagtgaagagattttaaatatgccataacacattagcatagagtgaaacatacgggttttttgaaggccctaatatctagggtccaaacggtcgtttatcttgcacgtctcgagggacgggtcatatacacgtattcggtacaatctctaacatgcggcattccatatacaggtgtaattattctgattgctgtaatcgacatggacggtgtaactataataatatacaggtgggaacaatctttgcagagttacaaccagtatcaaactgagttacattctgcataaccactatgacacttccttttatctattctttattatagacaaacgagtgcagaggccatgacccatgagttgattctttagttattgagaagaagatcatgcagtcatctactcatctgcacaaatcgctccaacaaacactcatcttggctccagctcggtgagcgacacctcattcggcgacgccactgctctcgtcttgctgtcgccggtggaccgaagcgcgctcgagtagagatccgtgtcggcggcgctgtccgtctcctggatgcagaacgttggcctcgacggggcctggatggagaacgtctcgctgctgagcatcacgctcaccgccgacatcgtcggcctgtccgccgggttgtcctggacgcagagcagcccgatgttgatcagcttcagcagatcgtcagctgaacggccgcgcatcgccggatccagcagctcctcgatcgtccccgttgtccagtgctcccagacctgcatgcataatcaggataaatttgtcaggatgattttcaattaagaagatggttttcgtatcatgtttgattgatcaggtctcatggtaatgaggaggagcagagattaatgatgctcacaagactcaagaggtcaatggattgctccgagttggagaagctgctgtttctccttcccgtgacaatctctaggatcataactccgaaactgaacgcgtccgacttgactgaatactgcccacgcatggcgtactccggcgccatgtatccgctgaaaataataggagatgatcttgtaatgaacctgtacctactttcataataccgtgccatggaattgcaggggatatatatatacttactatgttccagcaatgtgactggtgacgtcttgcgtttgatcccactcaaacagtttcgctaacccaaagtccgagatctttgggttgtgatcgaagtccagcagcacgttgcttgctttgaggtcccgatgaactaccctcagttgagaatcttcgtggagatattgcaagcctcgagcgactccgcttacaatcttgagcctcttcccccaatcaagatctttgcttttctcataatcttccattcaaacacaaaggaaatcagcatcaagtcctatagtgtaatggtatgtatgcatgtatctctttcatgtatgaaaaagaggaacgcttcgatttcgcaaaggcagtgaggggattgtaccgaaaagaatggtgtcgaggctcttattcggcatgtattcgtacacaagtagtttctcatctccttccaagcaaacaccaacaaggctcacaaggttcttgtgccgaagttttgcgactaaaactagctcagttttcagttcttctatcccttgtcttgaactttgtgagagccttttcactgctatttcttgaccttcagaaagaactccctgtgtacagatgaatatatgggaaactattctaatccctcgaggggattttcctcgtttgctcaaaaaccatctaaacggttatgaaaaattctggaaaaatttgataacattcatacaacatatatatacaacttcacaaaatcttatccaaactcaactcacacgtcgagatataaaaaagacaaattcagcgtatgaatagtagtgcactgtttatatctaaatttgtctttttgtttctcgatgtgtagattgaatttgaacatgaattttggtggactagtaggtatcattatactctacattgtcaatttttttcagaatttttcacaactatttgcatcgaatttgaaagaaaaaggtatacgaggggatatccccttgagggattataatccactcccatgaatatatagataaacttgttaataatgaacacgaatgtattcactttctaataaaaagatgaacaagggttacatatggtttgatttgtaccttgtaaacggcaccaaaccctccttcgccaagcttatttctgtcagcgaagttgtctgttgc

SEQ ID NO: 75627 - DNA, 623 bp, Oryza sativa
gtgcagcatgggtcaaacagttgagttgatgacgatcagtgaagtgaggatgatgagtcaagcgcagctgttgtgggtaggtacctgaacgtcctccacggcggcgcggaggtcggaagagtccttgacggccttgaggtggtcgacggtgccccagacgacctcgaggctgtcgacgatccgctcgagcgactcgaccaagcttccccaggtgggctgcacgcccttctcgaggtcggtgagctcgccctcctgcatgcaacaaggaatggtcgggtcagatcggaaattaaatttgcgggaaggaagctggtggatccagggcagggcaggggacgtacgaggcgggcgaggagcgtgcggacagcggggcggacgtggatgggctcgacgcggtcgaagggcgggaagtcgaagtcggcgaggagcgggttgtcgtcggtggccatggaggaggaggcgtaagccgcggaacaagtggcgggcgaggggcggcgggaggcggggcacaaggcgctaataggggaagaggccgggaggaggaggaaggccctagacctagacctagaggtatatgaggaggaggtagggtttgggaggcgagctcgagcgacaagtgggag

SEQ ID NO: 75628 - DNA, 627 bp, Oryza sativa
caataaatttcaatccccctattattctacaatcaactggatcaaacacttacagcgggtggcggtagaggagccaccttgggcgatgccttgggcggcatcggcgtcggcgtcagcgtcgtcggcggcggagacgccagcccgggcagcgccggccatgagtcggcgtccatgatggggctcccaggcgccaccacgaccggcaccgccgccccgttccccggcctcttccacgctgcagcggccgccgccttcttcccggcaggggggctaccggtcgcagccggcgtcgtccccccaccaccgttcgccgccgcgtgctggtcggcgttggaagccatcacccacaaaccgctgtaaacaggatacggcacgagctgctgcggcggcggcgggtgggggtagggattcggtaggcgctccactcagcacggcatgagaggcgatcggcggtgagagatacttccctggggggttccaaatattgcccgcggcgagggtggaggaggaggagccccggcgacgatcggatcggggacgggataaaccgtcgcgcgcggcggcggctgtagccgcgatgccctcgtcgctcgctgcactcttcttcccctttcgttcccttccacg

SEQ ID NO: 75629 - DNA, 21496 bp, Oryza sativa
cagttatgtttctaggagaaaagtgcttaatacgatgacatttccggtaagttgggttcgtcaatggcattttcttggattggagcgcttgtcgataatattttcttacaattttttaaagaagacaatatttatcaaaaaaaattgaattgttcttaaaatatgttcaaatttgatgtggttactgcatgattcccgttactttaccctgagacaatgtttggctaatgggaaatggaaatgatttcccacccatcaaaaaatatctttaaatcctaaccattcattctccctctttcatttaattataacccttcatttattttccaattataatcccacctccccattttccattatccaaacaaactgttctcaagatacaaccatgaacgctaatttagcacgcatgggagccgtcaggacaatataacagcatgtcagcatctctcaatttgcaatttgccaaagaagaagaatcttttattcattataactaacttgcaaatgaaaaggagaacaagggagagtagtgctagctaagctagtgcctagtagtagtggttaggagttgtggatctgttagagaattaatcatcgatgtacatcaattatattgttccgggcaaaaacctttctttctgatcttcgtcttgttgtcgttattcctgactggcttggattaattgtgcgattgctactcctcttatatgattggtcagtataattggttaggactcgtgattattccagctgctacaacgcagcatctcatttcatttcatgatgacgcggttgcaaaggcgcgacacatcagacgggcgaaccggtttgatcaaaaagtcttcagccccctcctccaggcaccgccggattctcgtcggcgaattctccgacgacattagcaccaccggaatctccttcagctccgccgactcctgccatgcacaatccaatccaatcttcagttgctactacaacatccagatacagagagaggagctgagtgactgtctgaaatgctaaccttgaccctcttgaggagatcgaaccctgtcatctccggcatgcagtaatccgtgatgatcatatgcacattccgatcctgcatcataacacaaactaattttacattcatttctagcaattcttcaaaactgactgacatccacaggcatagggatcaaagaacataccaggctgagaacctccagtgctctcttgccactatccaccgtcgtaactgcatgcacaacaacaaccaaacaaaattaaaggtgactgactgcttattgttcttgatatgtacttgattgtactaaccaaccagaccaaatgagcaatcaacgacttcattctacatgaaactcaattctacacagatgacagatgacacatatatatttgctagctagtagtcatatcgatcagttaatagaaataaaatgcgcgcaattgtacctcgatatttggagctgcgcaggagtctggagatgacagtacggtcgacgatgctgtcgtccacggcgaggacgtgcggctccggctccggcactgtcttcgtcgacatgaggcagagaatggagcagagcagagtagactctctcttttggtgttcttggcgatggacaagtcgcagcctggcctttatacagtggtagttggcaaaaaactgagtaccgaccgaccacagaatatacaatggaaaaaggaaagcatttccaacaaggagaatgagaagaggatgagaaatggaggaggatgagatctaagcaaatctgcagaggccgtggtgcagcgcttgccgaagcgcctaccccctaccataccatattgtaccatgccaggcgtagctgcctgcccaaatatccatacccataatttcctattcaggctcctcattatactagtatctgtttcacatggcacaatactgctcacccgccctcatcatctataaaaaaaagacattaattacagtcaacacaagtgtgtgtgagaaattagggggtttaaataagatgcccccatgccatccatttccttctcagctagatgagtcacaccttcatatggatttcttatagctagacaagatccagatcttgagtagcatattgattgattttgtcccctatctcaaggttttggcatttcatttggctgtattgctctttgcaacaaggttcaaacatgcaaattcaaggcagaaatgtgagggaagttcagcaacggaatccatccctgtccctgtaccttagggagccttcccaacagtagatgcactaaacacccacgctacaagaccaacaaattatcaaggaccaaaacaaatattttccagcaatatatgccctaaacacccacactacatgcacgaactatccacattacagcatttttgaaggaaacattacagcatgtccaaaatgtatagggaatcttgaggataaaattatttgtgcacggcaactactactccacagtcccacccccattctaaaaataataatggcggaagaatgcattcttcaaaaactaatcaaatttcaagaacccagagattctgatatatgatgtctgacctgaggctggagagttgagaagcccctttattttatttcctgaagtcagtttctctgtatctggactgccgttcagaagcctacatccagcatagcaacgtgattggtcgcagaagaagggttgctgctgctgctgatccatcttgggagtcgtggctttttctttatgaagcagcatttccttacttcatccttcataagcgttcaagtttaagctgttcaggtataatgagctgctgctcttgagtaaacatcaggggatcacagctcagaatcataaggtcaactcaataaaaatgaaattttcagctcatgcttttgagaaacgtaagaatcaaaggccggtaatgatgcaagaatttttcatctgactctgctgcaacgtaggaaaatgtacttatccttgcgcatttggtgaaaacaaaatggatcagatatttagattcagttcagctggagatacgaggtgctgtgagagcgagacatttgcctcttccacacacctaaaaggtctagtaatattcaagaaaaacaagagttgaaaatgttatatagttagctactgaagcaataatccacagcaaaattccgggacatgtatcatgtatgtggcacagtaccactcagagctccactctgaagccatgtattgctgatctgttttaaaaaacaaattaagattaaacaattagcataacaaaacacatcttttagcagccagatggcattgtggagcacacaaggcccctcatacaggctgcactaaagaagagttcacatcaggtattaaatttgacgtgtcaatctaaaaaaatataataggtcggcatacacttaaacacgcccctacttgtgcttgaggcaatctttgatgttggtgcccttttacaatatgaaagtcaaccatgttactatgaatttgaagcatccagcatgatatgccactatcctgagcaatgacagatggatcgcaactgtgtgtcaacaattgacaaaatgcatctaatgtttttaatgcaggagatcaggaaagtaacgagagaagcctcattgtcatctagaagagaaagtagttagtagggacaattctacactcacaaggcattatttggcacatatgatcaaaatatacccccattgcatacacaaaaaggaacgaacgttcaactgcaggatagagttttatccaagggaaacgtgataatatagtatagtatctcagataggtaaaaggatactgcttgtaccttctaggacaaactgggtgaaataggatatgagatgttcgtagtgccacatattccatttcttattggcctagaacagaattgatttaaaagcacaaatcacagcagaagttgtctatttgggctactaaatgtaatacctctccgatgggattgccacaccatggatggagaactaccagagtttatcataacttggctagtcaaggattgcatcatatctgttctatactgatagctgcaggataaaaataatataaataatgagaatctcaataattcgtcctccaacagaaaacagtacaaaatattgtagagaaataaagaagaataaagaatatgacaaaagtagattagcaggatatatgatataccaaatactcaagcagattctctctcatttgtactcattacttacagggaacattatgatgtttgtgtattctacctacaaaggatacagatatctacaacttgtacaaaaaagaggcacacatgagaaacacttcaaacctatcccacctaaaagatgccaaactatgtagcagactatacatgagctaatgttagcagcatatttaccttatgcatacaatacacacacacggctccaatttttcaggaatacgcaaaaggattgtgcacctttgtattaagagaataaaacacacacaggtccaatcgaaacaagaaaaaaaaactctagaacagcgtcttatgtttcaacaagtcctatattcttgatgacaaaattcaagaactccacataagcaacttaatccaatgatgaattcatatttttcatcgccagattatgctctccacaattatcataccacaccactctgtagaaaaaattccacatgttggactatttaccctcgccctctggctacacgaaacttgcaacagcaatccttgctcaattttttttgttgttgcagttttccagatagttgaaactttgaacacaaaacgaaaccagtcctgcggtaagctttcagatgttcttacgaggctgttcagtagctgactgttctaaaaagtatgcagccataccatttggtccttttttagtattaataacagctgatgagggtagaggagcattaagagaatcgataacatcgtcaacaagttcagtgtactgtgtgtcagttagctcagacatagtaccgctcccagtgccactactgattgtgaatacttgtttcctttgccgaagccctgctgctcgtgccacttcaaaatcattgcttactcccattgatgaatccctccaagaagcatcttgtgcatatagttttagagaaggcgttggtgcaagagaaggtgtaattccagctaccttcggagggtcaatgggactattctgttgccagaaatcatatcaaggcagtaagtacagttccgataccttgtaacaccagatttaaataagtcacagaactcaccttagtaaagaagatagaagttcaaagcaacatctgagggaatgtgactcacctcatggtcctcatccaagtcttctaaatcctctttcacatcgtccaatctactgtcttttgcttccttatccatccgatgccaatcaggtaattcagagcccttgggggaaactgaagagcaagtgccattggttagtaaagatacatattctattttcccaaattaagtgataatgtattaatgtgcaatcaaattaagccataatgtcagattattgaaataagaaatattgtgctatccccttggtctttttcccactgtgtagtactattactgctttcaatagaattattttaagttccattttagaaagttcacccaacagacactcacctttatttccaacatctatagacagttcttggacagcctctgtaatgttgagttcagaatgagaagaagaagagcatctggtattatcatggcttttttcagcttcagtgccattatccacaaagaggggcatccctgccaaacgaacagcaacttctggtccatcctgatactgtggctcagaaaatcctttgtcaaaattttcagtggctatggggcaattatcatttggagcatatggaagcgatcctggcttgttcagaaaactttcagtgtacttgacatcctccgtaattatggctgcctgctctgaattataggcaatttcatttaatgtttcgttttccctttcttcaccagcgggaatcatatcaaaactatgaacatcaaccattagaggatcagttgatccttttccagatgatcttacagcttcctctgtgcagttatatgaagcagacctatttgaagagatttcaggagtcaaagtctcctcaaaactaaaattttcgtcatctgtctcaactgattctccacgggctgcttcaggagtttctatcaaactacattcaggcccagatgacatggatcttgagtagtacggatgatccgttgaatattttgactcatctaaaagattgcaagcccctgagaaacttgagatgcttccatctcttgggtctgacggtgttttgttggtatcctgtagatctgcaaccatggattctccagcaacgtagcatgtagacttctcagcaatatcaaccttatttcgagaaatgggagtcattgtatgttcatcttgtagcttgaatgagcctttttgaagccctaagagatttctgttgatctgtgtgttatgaaaaacaaatgatgaattatttgaatcagcaatgttgccatcatctagagatattaaagtcccctcaatgctgaagataccatcatgaagcctatcagatgataatttctcttcaacttgaagaatgtctgaaatactagcatctggaatatcttgagaccccaaattggtaaaatgatctttagaattgtcatcctggagagccatgtaaagattctcaaaacataaagcggtttcttctccttgttgatttccttgctgaccgcttcctaaacatccagtcaaattgacatctgcagagaacaatgatgaagttgtcttgtatgggttattttcagccttggaattctgaactgtatgaacagatgaaaaagacggtaagtccaagtaatcatctgattttcccatgtcattgcctgtgtctggagttacgaaagcattaacaacattggatgaaacttcatgtagtaaaccatctattgattccccagcaacttcaagagtttctatcatgttggtctctggaataaattcaacagacctgttgtttccataattttctgtactattcacactttgaaacatcatggtgttcttatcatccaagttgaaattttgattgttccctggttcagccaatgcgccacctccggtagcatgcattatgttaacctctgaaacacatgaggatgacctggaatagagtgaatatttttcagaatttatgctctcttctggagatacaaaacttccctctacaccaagagtaagtccctgtattgtttcagatggaacttgtttgccatcatgaaacgatcgaatctcatgtctgtctgaaatacattgagaagatccagtgttattcgtccaattttcagctcttgtaacctcatctagaaagataggattatctaaaaaagcagaagtttttccatcttcagactcagaaaatctgccctgaacagaagagggtgcattgtcttctgcagcactggcacgtaaaaggtaagaactcgagctgcttgaataaaatacatcattattgatctcacctgaagataataaaatcccttcaaaattacaagttatttggtctagctgattagaaaatgcttcctgagttttctcctggccaccttgaatttttttcctcacgttggtgtctggaacaaaatgtgcagggttactatcatcacatgaagggttaacagcagcctttatagggttaaatggcccttcatcttgcgattcagacaaacttttcttgacagcttcatgagcttcagtaatggttgtctctactccattgcataaaaaaaatcggatgtagctaacgagtgttcagaaatatcaactacaggtggatccataaaatcttccttctccaaatcaaaaggtagactgttcggctcctttaagtgcaagtcatacgataattcctcctttgagacctcatcgctatctgtgagtagctctccagatgttgggttgttcaattcgggattaactgcaacaatcctaggaatttccatcatattggcatcttgacagcataaagggaaacctgaagttttcatgtactgttcagtggtactgactgcaagcggacccagcagagcttcctcctctgaacagatgaatacatcatttccttcctgcccgttaaatccacatggttctttttcccaggtatcctcatcacccttcatcgctaactctgcagaggatgaaaatctcacctcaggatcctcaaattcctcgcaatgcgactcttgaaatgctggaaggttcaatctaggactgacccctgtatcaatgtctgcaacagctgcaatgatgtttgcatcagtacagatgcaagcaagtgcattggtaacctcatcaggattaattatcacttcattgtcatcaatggcatgtgaagtagggaccttctctggagtgacagtatctgtttgcagcgctgtcaatttgtgtggctcaagcaatgagtcctccttgccaccctctggaggaacctgttcaaagttttctaatgcagatagcactggatcagatggatcctggctcacatcatttaagctaccataagcaacaatgtagtcagatggagaagcgggaggttcattaatagaaactggataggattccagtttttctggttgagatggtgagctttcctcactgactttgacaggcatttctctgaagacagtcattaaggatgacatcccatgttcagttaagcatgagtcacctctatcaaaagaactgtcatgagagttaactggacatatgagattctccttgcaggagctgaaattagtgttcacgatgtccaataatctatcaaaaactttgtcttcaccacctcctacaggcgattcgtgatgaatagttggaggttcagttaacttgacaaatataacaggtccagaatggttcctgtaatccagaggagagaaaacagtatcttcaataggatcatgggcaccaccttgctgatctaaatgtgtggaggcagctggtacttcttcatttccatctctcagaaggattccaggataccctatcaatggtgctgaactgccacaaatcggttttatgttgtttgattgacttatagaggaatcacttaattcaggaaactccttgccgcagatggaacctgcgacactagatgacattgtattctgtgtatcttcctcgatgctttcggtagcaatgcttgttgttctatatgttttctcacttgagaatctcctcttccgtaggccatccaagggcatcggctggaagtccttactatgaccccaagacatgtctgcttcaccatcaccccttgagctaatacttggctggcggcgtttcttaggtttagaagttctgttctctgaatgagttgctggcagaaaagtactatttgaatcagttgccggcaaagaattactggcatcatctacatcgccacagttctgcttctgcaccaacaaacaaagagcaataatgttgagcaaagcagaacaaaaatggccaaagaaaagaaggaaacaataaccaaatcacataaatgtaaagaactacatcatttgcaggttaagcttatatgcagagaattagaatgaaggaaacaaacagacctgtgcactgatcaggtcgttctggttaggcttccttggctcaccatcatttgcctgcttctgctcctgaatccttttaagccttctatggtccttgagatcaactgcaaagcaagatgagatgtaaccacttgagagatattctagcaatgcactgtgaggatacacaaagaattccacatatatttggtagcaagtgcggagctttaacagtatgaagacattggtgctcaagcttgccaaatgttagcaacagtctgaagagatagagtcacagagacaagaaaggtggcgaagaaggatgttacgcacgtcttctggtgaagcggatgaaagcggcatagatgagtgtagctagagcagggatgacaagaacaggcagagcttggatgggctgcctccagctcaaattgcgcctcctggccctccagaaagcataaacgaacaccaggacctggcgatcaatttaagcaagaaaagataagaggaaaaactgaagtttttcaattcagaagtaaccaaaatcacatgatacatcaattgagattaaaaaaaagaagaagaaaaaagactatccagccaacgttggaggcgacttgcgtgatcgatcatcagcatccgcgagtagcaaggaaaaataaatcgattggtggtgtggctagcgcgcgcataaaagcaaacacctggagcgcgcttccgtggaaacaagtgtggtgacgtatgggggcagggcagggtcacctcacctcgaggttgaaggagaggaaggcgagcttgtgggcgagcctccgagccgccgccgctcgcctgacaaggcgcgaacgcaccaccgtttcctcgttttgaccatcgtcgtcgtctccgggcccggcggggtggtgtgcggctccagtccggcgccaagcagcgcggaggcgggaccagaccccggagaagaatccgacggagggatcatcggcggccatccctttcctcctcttggctcttgctttctctctctctcttttctgcgcactaactagtctctcgctctcgtaggacatgcacgccacgccacgcactagcagaggcagaggcagaggcagaggcagaggagaggctttctcaactcattttttcgactcttttcctatagaaatcattcttgtgtgcagttagctaatggttctttaattttcctctaatccaaataaaatcatatattgtgattcagacaagattttgtactcgttgttggagagtttgtgcctgccgactcatactgcgccagccaactgaatgggcttattattattattattattattattattattattattattattattattattattattattattattattattattattattattgcgtttacgttcccccgacattcatttatttttaaaaacttaaaataaccaatactcgattaattatatattcacatcgtttaacgtatcttctctttcccattatctcgaacacaagtgctgagcctttcttaatttctcaccatacatactagtactatcagtgcaagcaccctaaaccggaacctagcctataaagttgacccgaagatactcatccctacagtgcaaatacctcttttgtgtgacttaattagatgagtgtagtgtgggaggaaaccgaccctatagtgggcgtgatctcgggctgatatcgggctcgtggacacgggtagtggggcgaaataatttccccacctaccctcgactcatcttctcctagccctcccctccatcgctttctcctcctcccggtcacccttcccgtcgctcgccgtcgcctcctccccgtccggcgccagttccgcttccgctcgctgcgccgcactgctcctcctcgcctcaccgcgcctcctctcgcgtcgtgtctcgcgcggcggcggctgctactgctccgacggtggcgagttgcggcaggcagcggcacaggcccctagattcgttggcggtcgtcaggaggcgaattgcctggagaccccggagcaagccaccgccgccgcgcctcctcgcccacagtgcacgcggcagctgcgaggaggagggggagtagatccgggttctttgcggcagcggcaggttctcggtggcgggaggcgtccccggttgccgccgcggcgtcggtcaccaccactggcctcgccgccgcccggatgattttgcttcttgacttttcttgatgatttttcttctctttcaatccccaagattttcttgtcttttcttggctcggtggtgggaggaagaatggttgtggcgggagaagaatttttgtgggcacaacggggatttctcccccctcgattggtgcgaggtcacgggcggggaagaatcgcaccccacagtgctgacgcctctcccagttttggccgcgcgtggactcgtgaacatgaggttttgcgtcgccatgctaggcgacgaggtgccttccttggtcgcggtcccgccctccacgtcgacccgaatccgagctagcgcaacgagatcacgcgccagctcggtgcactgtgagatgaatctgatcatctggcgggcaaaccagtgagtcagcttgtttgaggttacctcagctccaacagtcacaagtagtcgtacggtagctaggtaggcagcaggtaggcatttttttgcattggcgggcaagtcgtagcagcgtagcttgcgactgacaaggcagaattcctccttatcatctcgctggagttggacggcgatgagcaagagggcaaagcgcgtgggcacacggcggtggtcgtgctggatgcccatggtcccaggtaggccaagctgccaggggttaccagcacgcacccccatggcgttcaactcctcagagaacgtctccggccacacgtaccggaccaccgggggcgccgtggccgtgggcaggtcgaaggcgcagaggcagcgcaggcgtgggcagaggcccagctcggggacgaacacgccgcgcccatcaatggggagctcccagtcgccctccttgcgccaccccacccccacgggtgtcgaaggagtaggccggtgtcccgctccgacacccacacgtgctcgccggcgcccatccatccccgcaacgtgccgccccagagctcgcgcggcggcgcctgagactcgtcggcttggagggaggaggagctggaaggtaggggatctcctgcaggggcggttgccgatggcgtagactccggttcccagcgggatgaggaccgtgccgcctattatctcttccggaagctccgggccaggcgacaacacgtcggcggtggcgtcgcactcgaggtcgaggaggacagtgcgcttgcggttgctgaccccaacaatggtgttggaggcgacgacggcgaagttgaggtactcgagagcgagccgccgcaacgtgtccatctgcgccatggggcggggcaagggtctcaacactgtccactcgtcgtcgtgggtgaacatgtccttgatgttaatgttgaacaagaggtaggtggtgatgcaatccatcctcttctcttcttccaccaccaaaactagagttttcctcctccccttccatcttgtgcttgtgcgctgctgctgctcatccgcctccatctttttttttctttccgaagaagatactccctgccccgcctagcctgtatcgaggaaatcttattatacacaagtggagtatgtagtccgattccgtttcgacctcgctggctgcatcacaagtcgtttcgatcctacaactgtgtcgctgtttagagtcatataggactttcttggttaggtccgatactctggttaagttgatatttctctaattgtactctcgttttatatagttttgttatgttacatctatcaactaaatagatttttcatatttctgaactgggtgatgaacgtagagcagggtatctgcatgaatattaatttctggtttgtgcaaattaggcacgatcaatcactagaagatggcacggtacatagaaaatcaaagaggaagttaattgtaggagtaaaagaagtgatgcacgaatgcatgcatcaatcacatacgatcttttttgtttgaactaggagagcatggagctcccccatttccattaatagaaacgtagaggttacagagtagcatcaagtttcaggacatcaatcacatagtaagaattaagatagaaagattcagattgttcattcagtcatcgtctccgacatggaagctcaatctggagtggcttgctgtcttggtagctgctgcttccgcacaagattctgaatcagactcctgcaggggccaagttagtattagtaaatcaggagtaagaaagaaatatgaatcattcatgagcatgcatggatatgacattgagggaggaaaagcttatcttcattaagcaaagcaaattaatagtactagtaatccattaaagacggacctgggtattgtgggtgaggaggagcttttgcatgttgtggtggcttcccctcgagtggcccatcttggccttgttcctctctgctcgaagccgatccagcttctgctggtccttggcgtcaactgcaatcgacattaactaatttgacgatcgatcattggttattgatttatgcagtggctgcctccactccatgcgcaattaaggttgagaaagaaacaaattgacgatcgatggaggaactaaggacttactgaatttgtggaagcgggcaatggcggcgaagagcaaggcagcaaaggcgggcacggacaacagcacacccagcagtagctgcttcttcttcttcgttttattcgcagcagtcttgattctcgccgtccacaacccataaacgaataatccagctgcctcaagggcgaaggaggtgaaagcaatggtgcgccggatgacgcgggcggtggcgtggcgcctctggatgctggctttgacggcggcttcctcgtccgcgaggcgccgctgctcgtcggcgtcatcgccgagcttccaccacacgcccgagaaggaccccgtgcggggcagctgccgcgccatgatcgatcaggccggtgctacgtacgtactaccttcgatgttcgatcgatcgatcaatttcttcttctttcgatgtgaatgcgatgccctcccattgagaggcgactatctagcttgctagcggatcagtagcttttcatatttatcaaaacgcaaccccaagttgacgatcgatttcttttttcccgttttctctgtatataatgtaatatgtgtgtgtgactggcatacatctcatactgacaccagccaaaatcactagattaatatgatccatataatactcttatttgacagtaagaagaatgatcgtgccaggtcgattgcagtgcagattttgacgccgaccaactccaattaaatcagacaaactagtactccttcctaccactacatgcatgccgcagcatcatcatgcttgcgtttcgtgttactctctctagttgttagtgctgaccgttgacaaattgttggaaaagttcactgtagatccctcacggtaacggtcaagtttaaatcttatctctcaaccgtaaaaccaggtactggtttgatttggtccatattccacgtgaagttatgagcaaaacaaaaattaaaaaaatataggctcatatgtgaactacacaaaaagatttaaaaataaagggcctcatatgtcagtgtttcattaaggaaatagctatacatatgataaaattggtacgattttgttacgatcctgtcttgtatgcgtacgattagaccatgaaaacatgttggaagcatcgtacgttgatcgtaagagattttatcgtacgtatagcattggtcgtttcccaagtcctccatctcaccctctctctcccctctctgtctctcatcaaatgtcgccagcgacaaacctccatttttttatccccatatccctctcgacaacaaggtgataggcagcgggtagagcgagtgtgtgtggccggaggcgacccgtggagaagcgagcggacttcgacgagcgtgcagaggcgcaggtggctgcggaggagcgggcaacaacattcctctccagccaatggttggcctccttccccttctcgctccccagatgctaccggtggctaacaaaagaggagcaagacaacggtgacctcatctctgtctaagtggcttcctctccatcagcgtcaaactccctctctgtcagcattgagctcccttgtcggccgaccactgtcgccttcttgagctcactgatgcggcagcggcggatctcaagctcaagctcacgaaggagggacaccaaccacaccatcctcagcttgcctccccacaccccccgccacatccttggcatccgccttcccgcgcccgcccgctctagtgatcacgtccttgccctcatcttcgatgtcgttggccgtgtttgcctcgacctcgccggctgcgccatccttggcatctgcctccccgtgcctcgttgccaaagatcagaatagagagagaggtgctttgtgcatatggttttctttcttttatagtggggggagaccgagagagagaaaggggtagagatggttttctttcttttatatttttcatgtgattgatatgtgagtcatacactaactcaaccaggttggccatagtcaactcatcacgtcagttaaaaccagatacaatactaccctaagattttaggtactctgatatttgtaggttaagagacatactatatttgatattgcgatttaaggatgcgattcaaactcgatgacaaaatgtacctaaatttgacttattcataaattgttgggcgtggcagggcaggccctgttacaagatgggccgaccgaggaggcccgagggtttttcggtcaggacaaaaacactccactcacatcctcctcatcacaaatattttattttctgctttattttttcccctaatgaatacctgatcatccaatactttaaagacatgtactgttggatatacttgtgctttctatactcttttttatataatacctaatcccttcttcccataaaaaaccaatctagtgttggatgtgattctttttttggacggagggagtacatcgttaatatatgacactgattagttaaaaatgataaaaaaaaaacaatcggagagagtatataatttggttagtaaaagcaaactgtaatgattatagatttgtgtttctacaacaacttggaagataaacaagcacaggatgacacataaaccagtttagctccactccggaaaaaataaaaaggacaagtttacaacaatccaaaaaagatttacagacagatccagcccagagaatcttcatctctgaacctatctaagctaggagtatctcccaatgccccacccttccctgctaaaaacctacacaagtcccaaatcaaagacccctggtatttaaaaagtgttgcctgaagaatgagtcattctttgagccaagacaaattgagtggtaactacactttttttgctgctacggtacatgaagtaaagtaacaacaagccggccagccaggcgatgatcagctgctgatcaggatgagatcagctgctgatcgatcgatcaggtgagtcctcctagctctccctgatctcgcggcacccccatgcccatctgcacctgcacggcgtctgaccaccgcgctggtgaccggtcgctgctgttcgacgacgacattgcctccgcccttgcctccctcaccatccgtagcacctccggtgtggttggccgcctcgccgggtccgccaccacgcaggccgccgcaatgctgatcagcgcaccgagcttctcctccgtgccgccagcggacgcggactccccgccggactccgtctcttcctcacgcactgcccgcacccagctcgggatgtcatcgctgtgcatctccatcaggtcctggaacggcgccttcccggtgagcagctccaggaggagcacgccgaagctgtacacgtcggacgccggcgtgaaggcatgggcggtgcgagtttccggcgctcggtataggacggacgtggaggaggcgagatcggcgtgggaggggagcagcgtgggcaccagaccgtaatcggtgaggcacgattcgaagtcggggccgaggaggacgttggagggcttgaggttgccgtgcacgatgccagccggcggcgactggtgcaggtgcaccagcccggcggcgacatcctccgcgatcttcatgcacgacgtccagtgcaggggcttccccttgctcgacgtccggctgctggaccctattgtgcatcataaatttgaatttggttaaactttattccattaacacggcatggctttttacctacaaaatggattaaaatacatgctctacatttaaaaaggatgtacacagcacagataaggcttgcaaattgcaaatgcaccatgaaacaaactttcaacaatccaaacaaaataggaaaaaaaaaactttcaacaggcatagcccgcgcttgtctgtgactgtgtgtgtgagggcatggcgctatgcagcattgtccgattgcctagtctcttgttcatacgcagaacggcagaagtatactagtagcaattatttactgcagctcagattcagatcaggaccacatgctcacaagcacttacctgcttgtctacatctgcatactgttgtccttgtgagaaggggattttgatgagagcctgaaatagaggaaagaccaagccacagtggtgctgcggggtctactgcctcagatcaagccacccattacaactttacaagaacagggataggccctgttctgtcgtgcatgaaagcatggcctttgactgcctcaactaatctgggggctttaagtttgcttgtgaatgaatgagtgactgcatgcatgcccattatggtggatggaatatttcaatgcagagtgtagtgaccaattgaccattgacccactgctttaaccaaaccaatattaggccaggtttagatggcaaaaatttttgttttggggtgccacatcggatatatggatacacatttgaacatttgaagtattaaacgttgtctaataacaaaccaaattacagattccgccaagaaactgcgagacgaatttattaagcataattaatccatcattaccaaatgtttactgtagcaccacattgtcaaatcatggcgtaattaggcttaaaagatttgtctcacaatttacacgcaaactatgtaattggtttttttgtccacatttaatactccatacatgtgtccaaacattcgatgtgatgggtgaaaagtttttgttttgggaactaaaccgggcctcagtactgctaataccaagttggtaaaaagttcagcgcatggatagaatggcagcagtacagaggaatgcatttttacttgcaagaaatgaaaactagtgcagctcagtgacacatgaacggaaccagccatgttgatgcacagttggctctgactatctgttcctattatccagagcagttagtataattaacttttcatatgatatgctctatcatttaccaccagttttccgggtcctaaaattatgccctgttttcatgggagatgttcccaagaccctatgtggcacatattggaaggttattttcttccattgaaaacaaggagcaatttttagtcaatgggctttccattctgaaaggctgaaacagaatgaggttcttcacacccatatcctcccaccagtcaaatattatacgatgttaagacaagagaaatattcaagtgaatctggttgttctatggtgatatatccatgactagagtagtaattagcatgaagatggtttaatcttaagtgtttttcacttcacgattttcccatgatcccatcaaagtcttgaaatggttttactactagagaagagaaaagggatggcacacagttatattgcgttgtacataacatacggaagtactagctgctggtactctccaaattactcactcctcctatactacatacaggcggggcttgcatgaattaaaagtggagcagtagggatctccgtggcacatggctggcttggcattcttttctagcagcagcagcagcttgttgtaaataaaaggacgggcaaggcaggcagcacgcatgtacccaaactttatggtgaagcatgaggaggaggcgaggcgtggaattgcaacaaggcaacagccaagaaaaagcccgtcctttttactctgctagcgagggaggggaggggagtaattgcaatgcacgaaagaagcatgcatcctgactgaacaactgtaagtatttgggatgaagctagctagccaacaggaaacagaaaagatgacaaccatgaaaaacatatctgtcttgtttctttggttcgtcatggatccattgatctgtaattttttttgttttgtgatcctggccttggcaggcagcgattttgtctagtgtacatgaatgcagtgatccagtggctagtagtacttaggtaggtagatcccatttctcacttgttgtgtgcattgcattgtggagtacaaggagatagcagagctaattatggagtactaacatggatgaatgaatcgtaaaaaaaaaaagacaaataataatggtaggagtagtaattaaggtgggggagaagggaggaagaagaagaagaaggttaccgtggaggagggagaagaggctgccattggggtagtaatcgtagacgaggagtcgctcctccttggcctggaagtaggccctcagcgccaccacgtttgggtggcggaggcggcccagctcctccgctcgccgcccaagctccgccgcccccgccgccggctcccgcatgcgcttcaccgtgacgatgaacccggtctccatcaccgccttgtacgtgctgcccacctccccgcgccccagcgtctccgccgacgcccgcagcagctcctccaggctgtacatctccgccacgccgccgcagaacaccagcttcccgatcccctccctctcccacgagaactcacgaccccccctcctctccgatgccaccgacgccgacgccgacgccgacgcattgatctcctcccgaggctgagcctgcggctgctgctgctgctgctcttcttcctcctctggcattgctcccttatccacgtcgccggccacgcgcttgttcctcccgcgccgcgacgccatcaccgccgccgccaccaggattcccagtaccaccacacccgccaccgtcgcgccggccacgatgcccgcgttcttcgcgcggcggctcctgttggagcgtggcggggggagcggcgtgaatgcggccgcggccgccggcgcggtcggagcggcgcattggatgcgcagcggtgggccgcagaggtcggcattggcgaggaaggacgatgcgttgaatttggtggcgaggacggaggggatctcgccggagaggcggttggcggagacgttgagcagccggagcgtgggctgcggcagcggagggaggatcccgttgaggcggttgtcgtcaaggaggagcgaggtaacccgcgggagcgtggtaaggaaggtggggatttccccatgaaggaggttgaagaagaggacaaggacggtggcccggtgaagaagggcaagggtgggcggaatccggccctgaagccggttgccggagaggtagagcagcttaaggttaggaaggccgccgggaagggcgtcggggatggggccggtaagggcgttggacttgaggctgaggacgcgcagctcggagagcggggcg

SEQ ID NO: 75630 - DNA, 4333 bp, Oryza sativa
tttgttgacgcgctcgcgcgatactgtgttggtttcagaattatcctgtttttcatcgggataccggtatatagcagccctcttttataaacaacaaaatccgggcattcatcaacagaaggaaacgattccagataatcaaccagagagggttaggatgcaatgctgattgatatggtctcaattctaccaactagacaaggtttacagcttcagggaaaaaaaaagcatcatcatttcatcaccaaccaaacatggcagatttctacattactcatctactggtgtatattggagaaatatgttacatgatgacatgtcataacaattgacataggacaaacttgtgacaaggaggtgagttccattttccttgctttcttgatgaaatggctcctggagactgctacctaatcaaagaggctctctacaccgggctgaatttttcttctttggcccgtaaaagaaatgcaatgatcaagtaagttgacatgatcaagactgcaacgaaaaatatatttgttgagttcaggggttacatgtctagagacctctagttgcagtaactattcatcctcaaagatcatgaggcagcaaagaggctccatgagttgtgtttcggatatgtgctctgataagcagaggttggatagcagtcacacttcaattccttctccggctcaaatgccacactcttgttgctcttttgttcaagttcatctgaatcctttagtgaaccttgttcttctgagcctttcttgcgcttttcagtatcttcgagtctttcggtaccttattttgttcttctgaatccttcgccgccttcatatcttctttcgagttcgatggcttttgactctttcaaaatttttggtggcttcggttgttttgaatcttttgacggctttgattccctggattcctttgatgacttcgaataccgggattcctttcatgactttgaatctttcgatgatttgccagactgtttagattaggcatcacagataacagtgagcaccatgacttcaggatcatagctaattatatacaacatgaaagagcacatagactagtgcatgaagttcaaagtagagcctttttcaattttcacaattgtatagtgcatgaaatggggaaatatgtaactaaattttgactcaggtaccttctttgtcagtttattgagatcttcaggtccattttcttcaataaacttatcaagtgccgtgaggaagtcatcaaatttaccggaaagaccctttttctctgagggatataccaaatatttactatctggttctttataaacacagatatcacataattttggtacacataggctgcaccgctgaaatatggcaagacaggccagcaaataaagatcaatttcatggatggccaaaaaggaagcctgcaaaaatataagatggagagaccaaggaatttaatcagtcaatgtatcatgctaaccaatcataaatttgtgcaagccaaagggagggagagatattagagcaagcatgaactaacagatctttcttccttaccattatgttgtaatcaccatccaaaccaaaatatgcaatgctaaaaatcacaattgcattattaaaaatcctacaaaccttttatcacacagcaatggcatgaattgaaccatataattgcagaacacttgtaaacttgtattgatatctctttacatttttgaaaaagggaggagggtgcacctgacagaggaaaggtgtatgtttccgtactatatctaaacaatgcatgacaagaactaaataatgcttgcagttgcagggtgaccaagtgaactcgtaatttccctgcattagaataggcaacatgtattcccccaaaaatgccaaaatggtcgaagcctgtttgttacttttttgcaactgtttttttcatgtaggcatgttagaacattgtatggtcatagctactactgtttctatgctaatgataagcatctagcgtacctggatttcacgtggtcgtgtagtcctttagtactgagagtgccaatgtggtgcctattttcagatctaaaaaatgtctattcacagctcacaaagaaaatctggcgggagattgaagaactgggtggtgagatcagggttgcagtatagtgcaacggtgagaagaaactcaccgctcacaaaaagctgggacttgggccgtgcagagctagcacggcacggcccagtgtgcttcgtgccaaattgggccgtgtcggcccagcacgccccactcgtcgtgccgtgccgtgccagcacggcctcttcaggacgcggcccaagcacagcccaatggcccgacgggcctattcgtgccgggccggcacaagcacggcccaaaagatgggagcaggccggctgcgctgagaagaaactctggcggcgacgcgccagcggtggcttgcggcttcgtcgtcccgtcgcggcgacgcggcagtgacagccacacccatcctgctcctcctcgtcggctcgtcgcggcgacgtagcccaccggcgcggcggcgtgagtcagccaacaatcttgccaaatgctagtgctggcctgctgggctgctggccttgctggttgctgctacgtgctaccgatgagccgatgaagaaaacgagctgctacttgctgctacctgctggctgcataggaaatttgaccgtggatgggtgatgactgatgacctcgtgctgcagcagccattcgcgtaccgtgccggcccaagcacggcccagtggtcgtgccgtgccgtgccgcccgtcgtgcccgttgtccaggcccaggcacggctcacgtacgggccgtgccggcccagcccatttacgggccgtgtcggaccgtgctttctatcgtaccgggccatcatgccttgggccggcttgataaagcatggcccaagtcccagctctaagcaaggggtaaactttgccccctcccccccaaaaaaaaaaaaaattggccaaaaacacatttcgcccaaaaagcctacttaaagataaaatactcagagagtttcccctaaaatataaaaactcgaatgaagttctcctctttatagaaaagttcttttaggacatgtttttacccaaaggaaacagcgttatgaggaaaagtacattcgagttaatgtcaagtagacagatgtattcgagccaacttcatccacctgacattatttttcctaatagttgtatccgagcaggttcctatggagtgacaaggcgccaagataatgggaaagtatattcgagttctctggtgcggccaagacagctgaaataacaagaaaagaaggaaaagtcttatcgagcagttgactcattcgaggaaaataatcgtggggaccacttcgactactctaaccagctggcaccagatgtcgcctagggaccactagcaaagtactattatacccctagggcctatggatcactaggggtaatacggtaactttatgtaagcccatgatgacaaagatgtaaatatttgtggtcatggtcaaacactataaaaggccgaccagagtcctgtagcaagaacacaatgaaatagagaaaaagtaccttatatacatcctgacatctacttttgggctcactctcagggtaaacgggaatctacactttcccgtttacccccaactctgttcgtgccctaaggtcgtgacagtggcgccgtccgtggggacgtaaagtctccattggagtgggcccaagtggtaaatgcgacgttctcagagaccgaaaactgtgccaattcgttacactgacacttttgcaagtgggacaatagcacttgagaaggaacttgagaaggagtttgaaagagcatttgagcaaagtgatattgcgaacgtaacaaaaacgcttgaagagaagtgggcggaacaagtcaggaaaaggaaactgcgaatccctcaaaggaggaagcggggaaaacaaccacaagtgaagtggaacttgccgaaatggcacaagcacaaggggctgttatgataagcaaagaacaatacgaaggactatagagagagctacaaagactccaggctttgcacagtcaagcaattggagcaagtggatctggtgatcaactggagacataagaggctgatggaaaacaaccaaacttggcagaaaacactcatcaaggagatactttagctggagatcctcaagtcgtgaagttagcagaagagattcctcaagcccaaattatcaaaatacaagttcccacccaacaaatccttcaaatgcaaaaccccacccaacaaatccctcaaatgcaaaaccccacccaaatccaaaat

SEQ ID NO: 75631 - DNA, 2534 bp, Oryza sativa
ggtggtactccgcatggatgcgattttgcttattttcacaccattcggcgctatacaaggcaaaactcccaatttgggtgtgttaactttatgccacgcttaaatcgcggttgtccttggccagttgtctctgttatgtggaccaaatggggaactcattggcagtcaaaatggttctatcataagattccagcagatctgaaaaccatggaaaaatgcccttttgtgttttcttgtaaatctttgagtgtcatctcagatccagctgttactttgtcaaaagactttgctgacattcgccctcgaattgaagaacttgtctctaaatttagtgttcgagacttggtcgaggagttcatttatcttggtattcgacctctttctgccaactggactttatctcttggtgaaattcctgagggttctagttctttgcttcctcctttcgagatatctgcgaatagtaagtgtttaccttgtatatgtattttttatttcaagcattatatatatatatatatgtaattcatttttttcttctttttttcttctctttttttcttttttttgcagcaaaaattgtgaaggacgtggatgggccaagcaagaaatatattggcccttataccaagaaagagcatggcacatatcttgcggttcagcaaggtagaaaacaaaacaggattctaagtgccctcggccaagatatgatggttcgagttcatcctgatttgaagaagaaaaagaagaaaaactcgaatatcaatccaaaagatgctgcatcttcatcttctgataatgaggagaatagcttggatggggagtctgattcaagtgatgaatcgtctgatgacagcggctcctctgagtcgagcgaacatactcacactgctccttttgtgcaagaaaactcgagtcctgctttgaagcgtaaaaagatgccttcaagttctcctgttgactcgaacttgaaaaaagttcgaattgctctggatagtgatgatgaggatgaaaacattctgtcttatgagctacctgctatcagtgagataagttcagttgagattgggaatgtttcgaacgttaattctctttcagctgcagctgattacctctctgctcccttgaacgttcttacttctgctgccaaagaggttgaggaacctatttgcattgatgctattgatgtggacatgaaccctgtcaatcctgtaacaaacagagaacttcctgaagttgttaatctgaatttccaatccagaaaaaacatagttgaagatcaagccacagaatgaccccttctcccgagttgataaaagatatacttggtggtttcagcgagcgatgttcgaaaaatggacaacttggttgatgggtttgcctgatttttgcgcggatggggagactagcagtcgaggttctaagttgtgtcttgatgaccttaagtatcgctcgtctcttcatcagcttggaaatgaaattgctcctagcctcatcactccggagcttgaaaaggaatttttggagcacaatgatcttatctcagcttggacggcttttcttcttctttctttttctctaactctgctggggtccattctgccacaaattttgccaacacttgtgactttatcgctgttcttgatgtgtatttcaagtcaaaaggcaaaagttccatagcccatttggcaattcttcctgctatttccttgttcgacaacacctctcctattggataagttgatggtactgttatgtcgtgagataagaaataatgtctcaattttcttgatgccatcacaatagaatatatcatcttttccacttctgtataccttgtttttggtccttgcaatgcttcggacataaaataaactggcatttgcttgttaccctgttcttgtactaagactgcgcttactgtcaccagtgtggcagctacatatagcaacaaaggttctcctttttgtggacttgacaaagttggcatgttatgaaggtaatctttgagatcgtcaaaatctttttggcattcttcgttccattcaaagttgtttacccctcttaatgtcttgaaaaagggtaaacctctttctgctgatttggaaagaaatctactaagcgaggccattctccctgttaatctttgcatttctcttgtatttttgggtggctccattcctattttgcacaattcctcttttggatactaaaaacccaagtaactttccagctctgacaccaaacacgcacttttcaggattcaacttcactgaaaacttcctcaagttctcaaacgtttcttgtaagtcttttccatgtgtaaaagctttcttacttttcaccacaatgtcatcaacatatgcttctacgtttcggccaagttgatttgccagaaccttgcatatcaatcttgcaaatgtggcacccgcatttttcagaccaaatggcattcttatgtagcagtatgttccaaaaggtgttatgaatgatgttttttcttcatcttcttttaccatgaatacctggtgata

SEQ ID NO: 75632 - DNA, 7292 bp, Oryza sativa
ggtgtcgcggcgccaggggaggcggtcggagccgtcgagggctgtcttgagggcgatcagcgcgtccgcgtcgaaggcggcgccaaggtgagagtgagacgaccacatgaagaagaggaggaagaggaagaagaggcatggcgatggcggggtgggcatggtggtggaatgaggagagctagggggcaccccgcgcgccccgtttgattaagtcctcactactgtactgtagtacttcactagctgctgctgctgctgctacagtttgtttctgcggcaatggacatgggcacatacataccacttccacttcttcttcttccctctctctctctctctctctctctctcgctctgataagagctaaacttaattaattgggaggggaaagcttaactaacaaagggaagcgggggacgggtgcgggtttaaatgctggagctcgcgttgcggtcgccatggccacgctgctctggagcacgtgaaggaactgagcaccgaggagaggagaagactagggaagaagggaaaagatgcaggtaactgggcctttaattgttagttgggcctgggcccttcccctggctgctctgtttactaaaagtcccacaacagaacacaggacatcgatttactaaccaacacacactgttatgtttattatgtgtctttactactgtactatctcctttttaattatattttctaaaaaaaattaacactataactatattacttataaaatagtacttcctccgtcccaaaatatagatacctagtacatgatgggatgtccagatttatatcactaggtaatatcccatcctatactagttagctacattttgaaattgcagaagtatctttttacgacaaacttactaacacgatgacttgtatgatttaacaatttaggccatttccaatccaagacattagacatagtttccataagctccacatcattaagaaactagtactagacactactcttccaatacaaacatcactattacatacttaaatttaatgctacttatctcatatgatgtcttggatgttgtgtacaaaccatgtctcatgcaaaatatggtttccttctattttctcatttattcacttgccatatcaattttcattctaggtggcaacttatttaatgttatggacaccatcctaatcattgggttaggaatggccttagagcaagtataatagtgagctataagcctactataaacttagggaggagagaggtagtgaaaaatcaagggtgttggctcttatgcaagagctagcttatcacaagatccaagacaaatacattaaatgcataattaagagatagagagaggagaagaaaatattgtagccaaccttatagctaatctattatatatattggctttaagatgggctaataataggaagtgagctctaccattatccttactcttagagcaagtgcaacaagaataaatgaatcagcttctacttaagggcatgttcactttatgccattttcaactttaccaaattttagcattaccaaaattttggtaacttcttatatagttactaaaatttgacagcaaactaaatgtagtcacttttttttaacaattttaccaaatttgataagtttgaaaatgacaacaaagtgaacagcccctaagtatgccaaaggaatgtagctcaactgtttcgacaacggggtttaagcgttagacttcgcatttatgctcaggtttacagctattttttaagtgatgatggacataccagccaacgtttctagagtgggtacttgtgcgtttgaatagcatttgtataggtaaaagttatatttaagttttttacttactagtacaatttagtaacaattttatttatattaagtaccatatttactccatccgttctataatattatttatttatataatattatttatttatattactatattatggaagagagggagtgctagtataatagtataatacggagtgactacagtggaatatactactactccatagtcaaagatatgcctgcatactcgtttcctcggggttctccaaagcctggcattaatttctgtgcttctgtcctcctgtgctccactccaggtctccagtactcccagtggagtattgaccgaccaccaccaccaccaccccatcccctcccctgcactcggtgctggagtaggagattcttctcgtgagtttattttcacctccgagcaaggttagccaatagtatgacaacgtatcctatgcacacactacctatgaatctatgatgcactcatgcactcagccaccgtagacccttcgattccaatccaacagatacaaatctaggtgcggcatttttgcagaaaaccgcccgcattattcacccaaatttacaggtaaacccctcgcttgctttcctcttctctagttcaaccttctccccagatcgatccccaattctctcgaggtaggactgggcgacggcagcatccccaatcgccccgttgatgcacgcgctgccttcttgttgaggtgcctgcatcatggccaccgacggttgcgtatccatccacacacagctgaatgttgagatggcctagctcaagcagggtcacggcccggctgacctccaagcagtgaccttgccgatggaggaggagaccagtgtccaatcgatgacaaaaacaagaagagaaattgatccagatcacaattcaattttcagcaatatttcactgtcaccagtgttttgcaatttctgtaagagagggaacagtctaacaatatcaatatattttacaccagatgctatattgacatctgaatccatgacaatagcacaaaacgactgttcgcagccagttaacacaaaacgccgcacctcaaattatgtataagacttgaatggagaaatcaaaacaaaatcttttgcattcagttaacagcaaagaagaaaaagagaaccataagccatcgattcatcctaattgatcatccttgacccaatcaaacatcgtgtgctaatgacctgaagagaaacaccctaaatgcgctgcatgccgtcagcgcgagccccgccgttgtgacgaccaccaccaccacgcctatatagctggcaaaaccaggccacgagcagagaacaaccatgtggctgcgagatacagcgcttggacagggcgccggacggccaccgcttgctcaccagcctcgataggaggacgcgcatgtaggcgagggcgattggagatgccaccgtcgcccagcacgaagaggattggggatcgatctggggagaagaatgaacaagagaggagaaaagcaagcgagggggttacctgtaaatttaggtgtaggatgcgggcggttttctgcaaaaatgctcacctaagatttgtatccgttggatagaaatcggagggtctatggaggctgagtgcatgagtgcatcataggtagcgtgtgcataggatatgttgcctaatagtatagccgattattagctccaatttatttatagttaatctaataaccaatcatataataattgtttactacactattagtatatggtcccacctgttatatacacattgcgtcttggagtctgtgctgcagctggctacaaatatgtagcccgttgttattctctctcatcttttatctcattaaaatattttcgtagctggctaataatttgctattgtacctgctctcagcccaccagctttcaaaagatttcatcctaatagtatcgtttggttatttacctgcagaagtattagcggaagtacaacaatcaacagactatagttggctctacgtccacgtaatgctaccttgtaatttttatccatattcactgcattagaaactatcacaaagagtacataaaaggggaagatacaaaattcattggctgccggatagatgaaagtcgtgcataggtatagtaagtgactgtttgacacacctcgagctccagctccacttcttctagagctagagcccagctagacagttttagcttcacctataaatggaagtgaagctctctcataaaatgaactaaatatgtaaagttaggtttaggtagcttcacaactttattttagacataatttttggagttaaatttaggagttctaccaacggatcccaagtaacaaatgattgctgattaatgtacaagctaggcttttgatgggatggattgtcttgtatggatatgtaggaaagggtgctcctagatgtgtgtgtttgggggtggtttaactctgaaagcttaatacttcctctgtttcacaatgtaagactttccagcattgcccatatacatgaatctagacacatgtatgtggacaatgctagaaagtcttacatcgtgaaacggaggaagtaagatttatcattgtggctgctaaaataaatcaattggtaaagatatactatgagcaaagtatcaaataaaataatctatgttagatttaaatttactactctctctatcataaaatataacattttttattgaatgggacacatcgtagtacaataaatttgaataggagtatatccagattcgttgtactaggatatgtctcatccagtacaaggctggtatattttgggacggagggagcactctactacaaccacacagctagtagtagtagtatgtatggtaacggtgcccgtcaccgtcagccaaaactcgactgcacagtaagcagcaggcagtccactgtgtgaaaatcggcccactaggcacatgtcggcccgtcatcgatgcacgaagaataggcccttcaggcccgtttactattatttttcacttctctctgccttccttgtcctcggctcttgctgacaaaacactggatctggaccaatacttctcttactttataagtttagattagatagtttcattagaatcctataattagaaaatctaataattctaaattgttaggcacgtgttatctatatatatacagttggaagtaagattattaaaagcagccagacaaactattctattaaagctgcgggtaaaccttttattcaaaaaaacatactacctccgtcccaaaataattgtatttctaggattcaaattttgtcccaaaataatagcaattctagagtactaattaccccatcaatcatctcttattcaaatttctctctattttaccctcaaccatcttcctagtattaaaagggagcattgatgccgaataagtggcaacaatttagtagtactccacagcacacaattattagtggagtagtattctacactgagcactggctccatttatggtgctatgccttgtacactgtgctatgtctatttaggtcgtgtttagttcacaaaagtagtttggttgaaattaaaatgatgtgacggaaaagttggaagcttgtgtgtgtaggaaagttttgatgggatggaaaagttggaagtttaaagaaaaattttgcaactaaacacggccttagctttgaaatgtagtgataactatttttataaatcaaattgagtattactacttgatacggagtacgtctcttgatataattattcaagttaatataattattcgagagaatatctattttggtcacttgggttccagtaaagagtgcattcttgatgatgcgtgattgatgaaatcgagcttatggcaattattcgagaacatagacgataaagttgatgggttaagaaatgctaatgaagaaagtttttacaaaattattgtaagagcttaaaaaacatgcctatgatatcacgtgattcataagtataaaaaattcaccgctttagttcatgttatatcaaacacacccttcgtatctagtaccgctctaatgcaagtgtgtgcgcgcatagcccgtgtagacacgtacgcacgtgcgcatttctcctttcaacccaagtttttggtttatgagctacatgcaactcatcaacctaacaccttactattttcttattaagattcagattttatctcagttccgattagcacacttttcaaactactaaacggtacgtttcgtgtgataactttataaacagaagttactttaaaatatcaaatatatacatttgtcaagtttataataattaaaacttaattaatcatgtgctagtggcttctcgttttacgtgcgcaaacttcatattcgttttcatcagttttaaacaccacatatagaatttttgtatgcataaaacttttatataaaaactttatacctgtagggaaactatatacatatacatatacatgaaatatatataaactttatacataaataatattaaagtgtaaatatttttacatagaaatatttaaatgaaaaaggtcagaaggcaaaaggagcatattttgggccgcaagcacgcatgcaactatttggatttagtaaaaaaaccacacgatgtgaggtgtaaaatggaatgttgacccgattcgaaaacaaattaggcaaaaatagaaaggcacgacgcgcattagcattttcaccgtatttgtcatttgtttcaaaggcaaaaaaataaatgctcaacatcaaatatggagattatatataaaaatgaaattataccctcaaatatgtcatggaaaaactaaaaggctagcgaaagttgtacccagacagctgctacataagctaaaccaaattcatagtatcatagtagatttttcaaaaataaaaagagaatatttttcctttcctttctttttttatgtttgaaagagggtgggcatagtaataccttttctttttgagaaaaccaaaataattttgatggcaacgatgggtattgggcgtgtttgcccccatataacacgatctcgatgactattttgattgaaagaatgagcttggaggatctatttgaacaaatggcctcaagtcgaaattagaaggagcactccttttatcccgattatagatcatgttttttttaaaaaaaaatctttatgtgtaaattttctagagtactttttttaaaaataactcttcaacttagtacaatagttaatacatttgttgatatatatataaaaaatcagataatccaccattcagttgaaaatggctaaagtctaaaatggcaattttatgtaaaagtagttgtttttatggaatgcattaataatgccacctgcaagttaaaattaaaataaaagaaacatagttagggacatttgagaaaaaacattgcatgtattaaagtaggagaatga

SEQ ID NO: 75633 - DNA, 628 bp, Oryza sativa
tccctcctcctccccttccccccgcccccggccccgccacgcgctccacatcccgagcggcgtccccgccggcccgccaccgccagcgacggtcgagcatgcagccgcgggtggctgcagggcgcctgcggcgggcgcctcgcgcgcgcgcagcacccgggggctcggcgctatgagcgccattgttcggggacccggcgcccgcgctgcgcgttggtcggcggcggcgatccggtgaggcggtgagcgaactgttcgtggcagtggcggcggcgggaagcctgagcttatccgtattgctgcgcttgcgtagagaggagaggagaggagagaagaggaggggtggagcgcccgccgacggccaggtggggtaggaagggacaaaagcgttggcgtctgggcgactgggccctaccggatcgcggaaatatctcgagattttttagtgggaataagttcacttcaggaccctcaaaagtgaccaatctaattcatgaccttaaaccgtaaaaccggatatcttcaccccccaaactattgaaaccggtgcaatttgactcccttggtggttttggatgacggcttcgctgacgtggcgctgacgtggcagtattgactcggtcttctt

SEQ ID NO: 75634 - DNA, 579 bp, Oryza sativa
gcccttggattccggtcaccgtcggatgtgccccgagcacatactatcagcggaccaaatgttgtaccaacgtgatcgaggtgtgggtcaccgctggcgtggcggcgatcggcttccgcttgccgcttgcgctgtgcgtgcgcgtagccgggccgaggggcaccaccaccattgttgcggcgagagtccttggtggtaataatggtggccggagaggaccagagagagatgttgcactgcatcccctctggccccctgcatcgtgagatgacaatgcaatgccaatgccattgccgccaagtactactgctctgctgctgctgctgctgctgctgctgctaccggggtcccccacccagccagcctgcagcctgcccctgcttccgtgttgcattgccttctcctatgtggatgggagatgaaattattcccatggctccctttttccgatttactctatatcgagtaaatcggaaaaggggagccatgggaatattttcatctcccatccacatcggagaaggcaatgcaacacggaagcaggggcaggctgcaggctggctgggtgggggaccctgg

SEQ ID NO: 75635 - DNA, 626 bp, Oryza sativa
tctttgtcttcagcacatcattttacaccttggtccttgaagccatcctgcgcacgcacgaccactctacgatgccccttgtgcgtcctgtggctcggctacctcgtcatcagcaccaccgacttcagctacatcgaccgcagctactctatgcatggcttcatcgaccatggctacgttttacccttcactttagctacatcgattacaacacaaaaggctatcatctgtgttgagcactctcctaggatttttctctaatataagcgtctgtgttgctcacgcttgtattgtgggggatgttagagtatatggtagtaaaatatatcttatgatagaattgatttgaatagactcgtttccttatatacctcctctaccctgaggtttaatataacgtgtctaatatttatatattcttctcacccgacactattcaacacgttggactaacaaaatagtataacaagacaaaaataagggaacgaatgaatgctttgcttgtttcttcaaaatgttcctttgctgcttgatctacagatcaattttgcaagtcgggtgccgatctagatcattgaggaatttataacaacgaaccaaaatcaatcgatgcgatttagctagct

SEQ ID NO: 75636 - DNA, 615 bp, Oryza sativa
aattcctgcagccccaactcaattttagaagttttgagccatttaaatggatttctagaagttaaaccgaatttattgcgcaattaaagctatttatggcgtcagccgaggggattaggtggcgccgacacgcagccccacctgtcggtgagggggagggcgcacggtggaccgagttcacgcgcacaccatctgcgggtgcaccacgtggtggccatggcggacaggtaggcggaggtggcaccgacgtggcgtcacgtgggagctgacacggggcggcaccgaggggccacgtggatggcccagattgccccaaagggggatcaggcagccatggcgagcgggaggcggcgaatgcggcggcggcctcgggttcgcagtggaggtggtgattcggtggcggattggggaaatggagcaaaggccggcatgcggcgaggcgcggcggagctagtggtggcggcggctagagcggcggtggcgtgcggtcgaagctcagcggagggtggcagagatggagggtagcgtggggagcacgggaggtggtgtggggagctcgggcaaatggggagaaggggagaggctgccccggggagtatttttgataggctcggg

SEQ ID NO: 75637 - DNA, 609 bp, Oryza sativa
cagaatttgataattcagaacgaaaaacgtactggcgttttcagagtccatctagaattcatcatgtatcccaaaaactacttttgcatccgtatccctaatttcaaaatgaaaccactacaaccaacgcgtttaaatttcaaaattcaccactcacaattctcattggatctctctgttatttgccagaatccgagccccgacagctcgtacttggccacacgaccgggaagctactgacacttgggtttccaattctaaaaccggcacgaaattagcataccatgcaagctctctcctaattactgcagcatttacgacaaaagcccttttccaaagtagcccccaacccagcctcacatccctgacaaagaaacaaacagaaaggcgagctaccttagcctttgctgcttgtcctcattagtacttcaccactgtaattagagctaggtcagttcactgcacaacatttatctttccccctactttggcaaaaaaaaaagttaattagaacactacaaaattcatgtaaaattttaaacttatcgtattccaaactgccatttctgagtaaaaaaaattaagagagagagaaatgaagtgaagtga

SEQ ID NO: 75638 - DNA, 13503 bp, Oryza sativa
tgtgttgtgaacaaatttattacttcattgcagatggtaagacattcagaagccacgtcgcccttacgagaaggagcgtcttgatgcagagctgaagctagtgggtgagtatggactgaggtgcaagcgtgagctgtggcgtgttcagtatgctttgagccgtatccgtaacaatgcaaggcatctgctcacacttgatgagaagaatccacgccgcatctttgagggtgaggcactgcttcgccgcatgaaccgttatgggctccttgctgatgggcagaacaagcttgattatgtccttgccctcactgttgagaacttcctcgcaaggcgtcttcagactcttgtcttcaaggctggcatggccaagtccatccaccatgctcgtgtcctgatcaggcaacgccacatcaggtatgatgatttaactactacagatctcctgtcttgtaaatgggtaaatatgaagctctaacctttatattacaatttccatgtctcagtatgttctctctttagtttcaattcccaagtatgcttctatatgatttttctacagcagcatggaagctgtatcattctctcatagtaatcgttcattgtatattcatcatttctcttgatctagcattgtgtaggcagagctaaaatgtcattttaggcacaacacatgctctattagctgaaagctgaaggccataatatattagtattggtcctgtactcctgttaacttcccatcatttgagtgtgcagatgctttcaagttagtctttttcgtgcatttgatactcttgttgggcttgtcaatgtcgcatttgagagtgttagtcttttcatatgtagatattacctgtgatgtttaactttgaacaagcaatttggcacgcaccacttgctgttgctgtagttcgttactttacatgatgttcctttacatcaatgttcctttacaagtgttactcttttcatatgtacatattgcctgtgatgtttaactttgaacaagcaatttggcacgcaccacttgctgttgctgtagttcgttacatgcctgctgcagtgttataattctagattagcgatgatgagaccatttggcaacttcacatgattttgtcctgaaaaaggctactgccacaacattctttaatgcactctaaagttactactattttagaggacttgtcgaccataagttgaacatgatgttgctattgctaatatttttttccaagttgatagcctttctgaagttcattcattaaagtttcaaaatcactgtgcagggtcggcaggcaaattgtcaacatcccgtcgttcatggtgagggttgagtctgagaagcacattgacttctcactgacaagcccattcggtggaggcccccctggtagggtgaagaggaagaaccagaagaaggcaagtggcggtggcggtgacggtgaggaggaagatgaggaatgagaacagaagtttgcaactagttgtttccgtaatgatcataaaactctgtgctgagtaactaggcccaaattctgtagcttgcctatctgggattcagaattcaagcaggttgtgcttcaggtgttggtttatgttaaccctttttggcattatgttaggtatagacttgtggttaatgctgttttatggattcgtttcatggtaatcctcatcgtaccagtgcgcttgaactagtgatactcactcgtaccaatgctgtttttaatgtttttatggattcgaagttgcaacatggattatggagttgttaagattaatttagtagcgtctcaggtaatatttacatgttcagaccaaaagatccaaatccaatcatacagcgcattttcctacaaatggcgttcgctagatagttcactcctatgttatcgacaaattttgaagaagtgtcatcaaaatccatcgaattccatcaaaaacctgttactgatggcattattcagaagatttttcctcctgttctttttgcgtttcaatactctgctcgaaaaaaatttgtcctcctattttttgcatttcaactgatatccccatcatcctgatgtgataatcagagcaatgtacaaaattctctcaaacattaatgaggttcagaaaatttctccttttgcatttcaaaatcagtaaacagcaatgattcattcactatgcatcctgggaagaaaagaaaagaggaggcagcggccatgggaccagtgtccacggagcaaactctggacgctgcattcgggcgtcacgccggtgttggctatgctgctgctacccgttcgctggagggacgagacgagctgcctcgacgacccaccgagccggagcccaaggaggaggctcccctgcgcgttcgcgggttcggcagtgacgatgaccgcggaggacggcgtgcgttggccgagtggctaagtcgatggtggcggcgggacgctggtccgctcgaacatcggctggtcatgtaggcgtatggcctcctatgcacatatagcaaaggaggaaaatgagcagctaaccattcatagtacgcaagaaaaaatggttgccagatttgctaggtccgcgtaacgtagaatacctgtcaggcaaatgggagcaacactgctattagagcatcaaattcaccggctcgacggcgatcgccacggccgcgacagtcacccggcgagcccggaggagcatgaggccgtggcggctgccctgaccgcgagctccatggaagaccgcgacctggaagaagaagttgaggcaggggttgccggagtcggcataggtggcggatcgaatcgttctcggtgcaggccttccatagcttcggtttctatccggagatcctcccgctcctccgcggcctgtccatcgccaccaagaagctcgcttacggctgccatggcgcctgcctccacctccgcgcccgtcgccgcggcgcccggccccgcctcagccttcacacccaccgccgctgctcccggccagccgtcgccgccgcgccaccgcgccgcccgtatgctgtaaaaaatgagagagagagagatgaggaagggagagagatgatgacgtggtcacctgacgtgtgggacccatgctgactctgccgttacgtagaacaaaaccggggtcaaaaccagcaaaggatataaagtgaaccgttttgttagttgagggacgtccgatatctcgttttgcggttgagggacgattttgtatattggatgacaggttgagggaccttcggtgtacttttttctttactttgtaagtttggaataagtccatttttgtctcgctcatctcttgcgcttgcgtgaataacatccctaaactggaaaaccgggtataacgcatccttcatctctaaaaaccagagcaaatcacctccctcggtggttttgctggcggtttcatccgacgtggcgttgttgactaggttgacaagcggactcaacgtggtgggacccacatgtcagtgtgtagctctctctctcccttatctctctctcccccggcctttcccttcaccccggtgcggctcgtcgacgtgggtcgagcccaaggcggccggcggcgcattgcgacagagaaaggtagccgtgcggcggcggcgatgcggaagcgcgcacggtggcgggcggcgcggacggcgcggtagttgactatgggtgaccttgcgcagtgggccaactatgcgcgggcacggcggatggtgaggccgggcacggggtggcgcggcgcgcggcgacctggcgcggcctgatggtggcggcacgacgcggtttgccagtgaggctcggcagtgcggcggcaaggcgcggtcgatggtggcctggcacaagcatttcgtgggcgcgacgcaggtcacggaggcctttgcggtgtggcgcgcggcagccttgtgcaggcgccggcgaggtgttgatgaaaaaatcgaacacaccggcctgggagatctgcttaggtcctgtacacgtccaaagattaatgagatacaggcgtgccagtcagtttaatcctgcaactgataagatttgtaaataatagatcaaacagccgatcggctgacaagccgatggagtagttccagccgatagtcgataatagccgatgccaataccagccgatagcgatagggtttaagcaatcggctatatgtccaatgtagataatgatataaaggcaatcggctgatgatgatgtaataaaataacaatataatccaatataaactaatcggctagcaatgatatgataaataagcatcgatacgaaggttaaagcacacatcggctagaggtccgatgtcatgaaatccacaagattagattaaacaatgaaacctttgttgtcatcggctaaatccaacttatatgtatatgcaatcctcatgagccgatgcaacgtccagataactcaccggctgaaaccccgataaaacccttattggcaatcaataagcaggctagagattatggttctaagcacgacttagtagatcaaaattaactgatgcagcactaagtataaaaagaaacataatatctagacaatcaagccgatgactgattttcagggtggtagatgcctaggctaatctaatctagcaacgcgatttagccgataccggcagaaaccctaaaacgagaagcagccgatagagctaaattgatatgctaagactagattaacagagacatatgataaataggtaggcaagtatatcatctaaaccagagcaatccaagaggtcgaatgtactgatgcagccttgaacgacgccgatgtagacgatacaattgcctgggccgacggaacattggacttatcccttcgccggagatcgaagacgatgcagccccgcgtcgggtgccaagtcctgccggaacgtaaaaacaaaagtagaaataaaaatggtggcgatgcgccgaattgtattgatcgtagagatcgattacatagaccccgggtgtacatatttatacccatgggttgatacaagtccttgtcggacaagaaagaaactacctaaagataaaaggaaaatatagagtccttatcggacactaaacaaacttttctaaagataaaagaaaactaacaaactattcctaattaatagataaactgccatgccgcatcctctttaaactcggtcacttaggaataagcttcctttagtagattgatttccttaaccgaatatagcaggaatccgactattggtgacttgataactcacatcggctgattccgagatgctgcagccgataatgattctaagccgatgacatctttgccgattaccaaatttcactgttaacacgaggccagcgagcatggcgcagacggcgatgcagccagggaggcgtgacggctggtcggatcggtgtcggtacggccggcgaccaacgttcgtcggcgtcttcttcccccttttcttttttccatttcttctcttctttgtttcttgttgctccggcaattcgctcgtcatggcgcaaccgtgcggcggcggcgcgtccaggccgagcggctagcgtcatgggcagccggtgctgcagtgcatcggcgtgtggagcggatgcatgaccggtttccatggcgccgatgctgccgcttttcctttctttcattttgcttttcttctttgtttcttgtcctctccggccgggcgttgtggcggagcgacggcgccgccaagatgcggacgcgaggtcgccgctgggcgtacaggcgcggggttcgctgccggtatgcaggtgcaggctcgctgctaggacggccacggcacgaccactccccgccgccgatgcccagctcctctccgtcagtctactccccgttcgtcgctagcgagcaccgctgctgcccatcgccggccgcgcccctaccccaccaaagtgaagagaaaggccgggggagagagagataagcgagagagagctacacactgacatgtgggtcccaccacgctgagtcagcctgtcaacgggtcaacaacgccacgtcagacgaagtcgccagcaaaaccaccaagggaggtgatttgctctggttttcagaaatgaaggaggcgttatacccggtttttcggttgagggatgttattcacgcaaacgcaagagatgagggaggcaaaatggacttattcctataagttttgggctttttcacagtcccactccgtgtctgagctctgaacttgtgggcttacactatctcttgctccttccagcccatctttttgagtttacccttcgattaacctactgaagttgcaggagtaatctgtacgacatttttaaccataccattatttaacaaattaataattatgtggttatatttagtttgttatcaaatattggcaatgtgtatagaattttggcaacattattaagccaatcctaccaaaattttagcaatgttgttaatttgtcaaatttttgatattgacaaattttagtaaggttaattttgacattaatcagaacagaccctaagactaaagagtctgtgatcgactgaagttgtgacttgtcgtgcttgttggcaggctggtggccttctctgcatcacgggaaagcctgccgcgaagaagagcctaaggatgaaagggaaaaggtgtaatgtctgcaactactgctactagctgaaacctgaatgttaaaattttgtgtacaaaatcatatacgagtaaacatctgaaaactgagggctgatttggtttgaagccaaaacttgccataccaaaatattggtattttgaacagtaattttggtaatgtttgttttgctaccaatacttaccaataccacacaaatgttgctaaaatattggcattggcaaaatcttgcccatgatttggcattgccaatagtttggcatggttgcaaaccaaacaatccctgaaatcgtcgtggtgtcgttacttcgtcagtggaccgcatgagattcggcgcgtgaagcgcaacttcctacgagagacgctggagaacgagctgccggagggcaccatcaggttctcttccaagatcgtctcgactggggaagatagcaacgtcaagctcctacatttggccgatggttcaacgataggtgtgtgagatcaacaatggctagcagatcacttgtacctctcttcttctcactaagagcagccatggcctgatgcattgatgtgcttttgttgaaggtgctgatcggatgcgacggcgtgaactcggtggtggcgaagtggcttggcctgccaaagccaatcctctcagggcgctcggccaccaggggcctcgccgagtacccggtacccctcccctgatggtgcgcaccgttgctagttacttctccttgacgagcagcaacaatggcggattaattcgctgatcaatctgtcacgtgtggtgtgcacagacggcgacgcggaggagagcgtggccaagatgcggagctacgtgctggcgaaggcggcgaggatcccggcgccgctgaggttccggtcgccgctcgcgctcgtccgcggcagcatcagcaggggcaacgtctgcgtcgccggcgacgccttccacccgacgacccccgagctcggccagggcggctgcgcggcgctcgaggacggcgtcgtcctcgcccggtgcctcagcgaggccttcctcgccgacggcgccgagcacgacccggggtacgaggccgtcacggtggcgctggagaagtacgccgaggagaggcggtggcgcggcatccggctgatcacggcggcctacgtcgtcggcttcatccagcagagcaccaacccggtgatcaagttcctcagggagaagttcttgtcaggattgctggcaaaaactatgatcgccatggctgattacgattgcggaaagctatgattctgttcacgagaaatcaagaacccaagaagagaagaaagaaattggcggtgagcgggaacagtcttaattagcacatggaacaatcttgtgatgttgttaaccaagcacgagggggcgagcttaaagtccaccgtacaatgtactagtaccacgtacacactcaccatggcagatgctcaaggcaaagtcttatgtacggttttctatgcctctgtatcaaagttgagttcagcatttgacttgtgggtatgtgtccgagacaagttttgttctagaaatttcgtggacaaaataagttcttggagtacaaggtaaacccaaccttggcataatttagacacaataacaaaattgattaaaaaaaaggtttatttagagtgcaaatagcacaaacagagttttttttaaccaaaacaagtagtcttgagatatttttttttcttttgattatatgattacatgaaaatacatttaccctcatttagcacattattaagacattgaggctagaaataattccacgaaactaactaaattaaccacattaggatttcaaacacagtgggtaaagtaatatgcccataaacttagcgtcaccgtttttcgctcacggtcaccagaatgtttagaatccgatactcaattcgcaagcctcataatatttgacacccaattcgtatatgtcttccagaaattaccaatttgtttggtgacattatctcccatttttctctttttccttcttttactctacgtttttttttcccttctcacatgattggagtagtggacagttttttgcactataacaggggtcaggccagttagcagttatcgagctaaaatcgtcattcccggtttcccaccgccaaaacccactggcgggtggcggctgcctgctggcccatcgttgagtgactcaaagaagccgatcaatctcagtggcgcagaggtagcaacagatcaagctgccataatcacatggcgtggttaatcgcccgaacatatgctgcaaatgggtaaaatattaacaaaccggtttgaccaagtggcttcatccgcatccaagaatcttatatggaacccatgatttaattaggagcaatttgcagtactgccaagtgtgaggaatccctgtctagtttgttatagtgcttatcatatagccgaccataagccagtgtacatgcatggttctgtggcatctttaatatgcgaaaaaaggttgtatactagctagataagcttgtagcccaaaaaatgaatcttgaagcatctgtagaaatcggaagcaaagtgtaacgtcccgccgccttcccccaggccgggcccgcttacatctgatagctttcataggtcacacatcttttctgcacactttgtcctcactcgtgtgcacccggaaagaatttcccggtcggtcccccatcccaaattgctccaggccaagcacgcttaaccctggaattctttggagattggcttccagaaaagaagttgcaacttgttgatatgagtattctattaatcctattaagccctagaccgggatgttacaccctcacccccttaagagagatcgacgcccccgtcgatcaaccctaggccaggaacgtcatctcttggccacgtccatgtgtgataccattttgtaacgtcccgccttcccccaggccgggcccgcttacaggccaagcacgcttaaccctggaattctttggagattggcttccagaaaagaagttgcaacttgttgatatgagtattaccctcacccccttaagagagatcgacgcccccgtcgatcaaccctaggccaggaacgtcatctcttggccacgtccatgtgtgataccattttgtaacgtcccgccttcccccaggccgggcccgcttacatctgatagctttcataggtcatagactgccctcacagaccaacacatatcttttctgcacactttgtcctcactcgtgtgcacccgggaagaatttcccggtcggtcacccatcccaaattgctccaggccaagcacgcttaaccctagagttctttggagattggcttccggaaaagaagttgcaacttgttgatatgagtattctattaatcctattaagctctagaccgggatgttacacaaagggctagcatcaaccctttaaacagaccaggttgccaatcatgtaagactgtgtattacgcacaccatagcctcagcaaaagaaaaggcttctcacggagtggattctaatctctcgagaggatatcctctcatgtatctttttctttcaaatttgatacaaatagttgtgaaaaattctaaaaaaatatttggcaatgtagagtatagtgatatctactaatccaaaaaaatcaaattcaaattcgatttacacattgagaaaccaaaagaaaaggcttctatcatcactgtcagtcaagtaacttaaccagaataaaacagagggaaatatgaatttgtcagctatttctgtcactgcagctctcaccattcaaatctagaggtttgaccatatgatctatcatggccaccaatagataaagtgaggtcttacaaactaattaaaaaatgcagtacatcactacatccacaaccagttgccctaatagtccaatggagggcctcggtgacagttgacttacaagcaagcaatagtttcttttcgtagatccccatcaaccaaacaaaaaacaacaaatctgagcactgggagagctccactacccccatcatctgaaacaaaaattaatcacctatttgcactgctaaattccctagcttccagacctagctaactgatacctaccagtggggaccacctgcaattccaagaatcaaactgtcatgggcgcaactagtggtggtgatttgtctgaggggagccgggggttggattaacgcgcgtcaaccgcctaaatccaagggggtgcaacatgattaccgacgcttctcgatccaatgaccctaggtaatcacgcgacctccccggccgtaatcccatgtgctccaggcagccgagtctcgtgacctcacgtgacgcttccgcctctagctctcgatcgatcgatcccaccactaattatccactcccaaatgattgtttagtggcccgtatcataagaccggccacgtcgtgcagctagtgtgacttgggagagacagtgtaccggccatttgccagatttgcttcctcagaaaaatagcagagtcggccgggtttgcagacttgcagagatcggaagaatctttctctttcgaaatgttgaggatttttggaaggaaaacaaaagggaaatggagatataggaatcgtggcatttaaggcggcacggtgcagcgtcgtctgtgggttgcaacatgcatcggcatgtgagtctgcctcgggaggcgcgcgctcgtcgatctcgtggccgccgcacttcctatttaagcaccgccgcgggtgacaccgtcccctcctcctcagtactcagatacattacccgcaccgcctaattaagcgctcgcatctgaagccatttcgagggacgtcatggcgcggagtgccttcttcttccactgcgtcgccgccgtcgcggcgtgcatcgccgcgacggccgcggcgctcagtggcacggccacgttctacggcgggagcgacgcctccggcacaatgggtatagtttagacatttgctaattaagcctgatcagttttacacacaccaatggactggtgctgacaatggcgtttgttgttgatcgacaggcggcgcgtgcgggtacggcaacctgtactcgacggggtacgggacgaacacggcggcgctgagctcggcgctgttcaacgacggcgcggcgtgcggcgagtgctaccagatcacgtgcgaccagtccaactcgaagtggtgcaaggcgggcacgtcggtgaccatcaccgcgaccaacctctgcccaccggactactccaagccgagcaacgacggcggctggtgcaacccgccgcgccagcacttcgacatggcgcaacccgcctgggaacagatcggcgtctaccgcggcggtatcgtccccgtcaatttccagaggtacgcacatactccggtcaccgtcgtttcgccggccggcggcgcacagaatcaagtagtgatcacgtacgtatacgtatgtgtgcagggtgtcgtgcacgaggaaaggaggggtgaggttcaccatcaacgggaacagctacttcgagctggtgctgatcaccaacgtgggcgggccggggtcgatcaagtcggtgcagatcaagggaacaaagacggggtgggtgaccatgtcccggaactggggcgccaactggcaagccaacaactacctcaacaaccaggccatctccttctcggtcacctccaccgccggcaagacgctcgtcttcgaggacgtcgcgccgtccaactggcagttcggccagacattcaccagcggcgtgcagttctactagctagcggctcgcgcgcgcgcgcggcggcgcatgagccgccgccgccgtcgcgcgcttgcccaacggcgagcggcgcatgccacctgccgccatttccgttcaatttttgcatttggaaaacttgtcaaaaagaccagcttatttagcatcattctgattggggaaaaaaatgtattcttagctaggggaacgccactgtggtttgcatggctgaggcgggttccaacggtgttcgtctggccgggcggcctgatcgatagcccgccatgcctaaccgcttttacgatgattgctgggaaggaaaactatttagacgactttgcttggacacgaggtaaggagtgcaggcactgatcgatccgtgtaatgctgaaatatggcgctcattggaaggcgcaaaccacatgcgagtttactgtttgacccgatgatgatctcaatgaaatgaattggccattggccctgtaaattgactgcagtatctttgtgctttcactgtgtattttgcgttgaaatttagctcatcctgcatgtggtgaaaccacgccgactcgtgtgcacgtcccgcgagtggaggtagagtacgggatgggggtgctaagaatcccgtcaaaaaaaattagttgtatctggatgttgattttcattcctcgaggggatattccctcattgtttgtatgtcatctaaatagttattaaatttttttaaaaaaaactgataacatagactaatatgaaatatatcacttcacaaacatgcaaaattaaattcaacttctacaagttgcaatgaaaataacaaattaaactgaaaatagttatcgcacattcacaactatagttgtctcaatacaaatttagacacccccaccaacttaagcttgatctaaagtagagtaaattaagcaagaagcaccctcctttattttgttcttattccgcccttgcgtgaggagcgttatggctatgaaagacctgctggtgagctggatgagagcatgtttgctactaacgtgcgggccaattttatagattcagattgagtgacatagcataggcatgtcacaaggtgacatagcgtagatctcagccctccaaaccaaatccaacggctgag

SEQ ID NO: 75639 - DNA, 1513 bp, Oryza sativa
cctgtcagcgtcccggagaaagggggaatgagaccgggccggcccaaagtaaaagagaccgagcgcgggagggactgggccaacggcccaatagagaaaaagaaggtaaagaaaaggataaataagaaaggatttttcctgggattaaaaattgcactttggtgatttttaattggtaaaaattatttccaaggctctgaaaattccactaaaaatcctgttaacatattgtgacatgtagaatccaaaaaaacaaaaattccacatgccgattccgattattatttgcatttattaattagggaattagctctaggttaattaagataatttcttcggacggtttatttagccaatttttaaagcaagcaaaaagggggaaaacttcagggcgtgacattagctttccctaaagtggtatgcttgtagtttcctctctcattactcttaactcttcagttttaccccctttttttttttggggggggggggtggtggtgctgtaaccatatccatacctaaattgcattaacatattacttcacgcgtaagcatatttcatttgttccttagaaatcatcacgtctcaatctaatttttcctgattttcatgctatatcattaccgaatgtttcggagtttcttatattatccacctaaaaaaaatactagatagctagtaattgctgactaattcagttcggcaatcttatggatatttctctataaattagatgaacctacaaaatgataaattctatacctttttcatcatacatttactaggatatggttgctgtttgtattttaatttttttctgtatatttgttatttgatctagtgcccttgcagtttgtgtagtatcttttcaacagggatttagaattgtgccctccttttagcaagttaaagactttggtgctcaaatcatggtttgtgcctcctgacctcagtgcattaacttggtttctccaacacgcaccacttcttgaaaagcttacgcttaatctttcaaaggtattattatattctgaacatgtatacctgtgctatctaggttgtgcttgatttatttactaaaatatttgttagattcaggtacccaacaatttaggggtaatggatgacagttacaatccatgggaacaatcatttgcagctagtcatcttcaaaaagttgaaatcgagtgcaaaaatgttgatggaattgttctaaaaattttgaagatcttgaatgccaatggcgtaccactagagaatattagtattcaatgttctgactgtgagttatctataaatacccatgcttcctattactcagttacaaagccagttagcactatccatagtcaaatgttgtaagtctgacttaatcacagtatgcaacgagtatttgtgagtttaacagtatttgctaagtcatacatgcactatctattgaaacttttgtgaatgctctcctatttttacttatgctgctgccaatttgtgcaagtactatccttctattca

SEQ ID NO: 75640 - DNA, 17287 bp, Oryza sativa
  unsure (1)..(17287): unsure at all n locations
gatggtttgtgttagagggcgcggtcccagcctgaaggttatattatactggctttaccataggtctaatcgtagttataacttttggtaatacacctatacaactaaaaaaaatagtctaatggatgaggatcaactctatctttaagtcgtgcccctggtaacaattactatgtaggacttaggggctgtttggttgctagtcaaaatttgcctcaatttaccacaagtatggcaaataggtttgaccaagttagtatagtgtttggttctagccacaagttagtcatgccaaactttcctttaacttgaccccacatttcatagatacaataatgtgtggtaaggaggctaagatgtggcttcaattttcttggccacaactttggcaacttagccacaaatgtttggctggcttaggtagtgttacacaaccaatcaaacagcccctaaacccaacagtttcattcttcaaatcaaacagcatgaacgttcctttgtcagactttcgatgagtttgaatcttatacaacaatgctgatttcatgtatgaaaaaagagcgacggcccgctcttcttcccccaactatatacatagccaacatggagaggtcatgcgtcatggccggtcgcagagtgcgccatagcagtgtgtgtcgatgtcatgcgccaacgaggtgtcattggagaggcagctcaacgaccggcagtccggcacagggcatctttggaagggtaagtgcaggcagccgtcaatgggtgcgttcaacggtgcccattgccaataagcacgcccgtgggagttctatgttactagactagtcgagcgcttctcttcataatattgagtgcagatcggctatcatcgtactgtcgtcgccaccaccacctattactagttactggccaccaacagagccaaccgtactaaaaattttgggagatcaaggatagagaaagagaagaaaaatgtacgaagatgaaggataatgttatcatttcgatgcctttttttttttactaaatatgcccatttaacgtggtgatgaaaatggcataaaaaataatgaaaattttatcaagtagcatataagggaatagctactttttgacatcacagaatgaaaccattcaagttccatgctatctcgtgaacaatgcctcttttaagttccaagctatctcgtgatctctaaactagcgagttgctttggtgcgagtttttctgtgtagatttgggctgaaagcctgcctgagtgtctggcccgtgagagaagcccaaggctggaaatctgcagcataaccatgggccataaatcacatgtagcccatatgacactgcatgttaacaatagcacatgttaacatgcaaaaacgcccgttcaaaaaaaaaaaaacatgcaaaaacgtggtacatatgtacacgcagcataggtagcactacttgctaaacttggatatggacggcacaaacccaacgtcccaacctgccacatttccctagtggcgacgggtctatttttttcgagacaacatgcacaaaatataaaatagtacgacgtttttattgatatagcataaaaaatataagttagaaaacagaaaaggacagtcacactaagcgtttacgtctgatcctgatgctgaaaaataaaaacaagcactcaacatccggaatgggtattctaaatgacgccaagactatcgctgtttgcctatcctaaaatccacgatgtagttttcacttttttctaatatattgacgtgcaatcttttttgcgcgttcgaaaagaaaaatgtgattttcatccgaagaaaccattgggagaatagagaaaaacaaaacctcgctctaggcggaaagcggcgtccgcaggcgtcgtagttgccgggccgaagacgacgggtgtctactgtcctgtacacatacgcaacgacagtttgccggtgccggtgccggtgcggctgccgtatcgcgtggctgcctctggcaccggcgcggccatcgaccgttcaattcaagccgcgatgaggcccgtgagcaggtctcgtgtgtttctctcccaagttgggcaaaatttctcagaatcgcgtggtcaactgctgatagcctgataaccgacagagtgattaatagcaccctgtacgtaacagcagtcctctcctcttgtagtcttgtagagtagaagtatagagtaacagtacaggagaaatactccgatccatatataacttctagcatgttcacatttcttcagatttgtattagctgttgggtagccatgcatgttagctgctaatcaagagtcaagacactgctgagttcaaataattaatatatttgacgaattcaagatgtacatacatgtacaattaatccaaaaaaagtactaacaaattaatttcccagcttgagatcatgcagacgaacaaattcctctccctgctaataactgaactgctggttgctggtgaatgtcatgccgaagctccaccagctgggcacgacgttgtagatgtagagcgtctggccgccggtggatgtgacggcgaaggagagcgcctggccgacgagccccgagttgcactgccagttggcgccccagttccggttcagcgtgatccaccccgtgcttccccccttcaccgacaccgacctcaccgacccgctccccgccacgttcgacaccagcaccagctcgaagaagttgaaccctcccatcgtgaacctgatccctccctgcctccagcacttcaccctacacatcaattaggtataggtgtttaagatcgacgaagataaagttagtgcacacaaaatgagaaagttattagcgtatgattaattgattttttattattacaaactttagaaatagatttatttgatattttaaagcaaccgttcatccgtttgaaattaacatgttagaatgtacttaagagcagtaattacggattactactagttgtaatacactgtaagtacttactgttggtagaggacggggatgatgccggccttgtagatgccgatctggagccaggcgggctcggccatgtcgaagtgagggcggggcgggttgcaccagccgccgctgttgctggggagagcccagttgggcgggcacaggttggtggccgtgatggtcaccgcggcgcccgccctgcaccactgcggcgtcgcggcggcgtcgcacatgatcaggtagcactgcccgcacgaccacccgtcgttgaacagcaccgagctcagcgccgccgtgttcgtcccgtaccccgccgtgtacaggttcccgtacccgcacgcgccacctgaacacacagagtcacacagcagcaggtctccgtgagaaacactgacaacgcaatgacagattcgtagcactccgtagttgatagagcaccaaaggttttcttacgtacccatcgtgccggaggcgtcggcgccgccgtagaacgtcgccgtccctttgttccagccatgcgccggcgcgaagccggatgctgctagcacggtgatcaccaacgacgtggcgaataagatcgcgtactccatctccgtcgagacgatagagcagagaatcgaacactgatcaggaggttaccgaggttctgaattttctgatggttttgcagtgaacgtggagggggttatataagagcaggaatgagaattatggtcagatcagagcagggaattgcagagaacatgccggcgatatctcagtcagcagtgcaagctaggctcacatgcatgcaaggaaaatgtaagccgaaccctggagatggaattgcgcgttcaatcaggtgattgatacgctgtaaacctgcaagctgggcatcatcatcagcacggcttagcattttctcctgataatcatgacctggaaaataatacatttcatgcatgtaccttgcatgttcagtaatccgtacttgccggcataaaatggatctacttagatattagtctgataatctatggacaaaaatataatttggaatgaactgtgcatgcatgccatggcttatcagcatctatgtggaatttgcaaattcttggtaggaaagaaactctgagccacatgaggccatgagggggccagcactgtcagcacatggaagatagctaggaggtggataaacaactgatcagattgattattaactcagcgcctacttagatgtctaatcatttggaaaaagctgactaaaagagtcagcagatttaattagccaccggtaccgcgcgcggtacggcgttgaaattgattacatttttaagcaggaaaaatgctgtcaagttgtgcactattatactgacttctatttgctctccctttgaattaaaccatcaggcgtacgaaaaatgtttttctttctttgggcaaagacgcatcatatgctacgatagatgcctctgcaggaactagttgcaaacttgcatacggggtacttgtgtgtagttgtgttggcatgcatgagcttgtctgtgttcgtaggatttatcattcatatccagtaaattccactgccagttctcttagtggtagagtccttagactttccttcttcccttccccactgcaaaccactaaatgattcttaatgttccctgtttttgaattattgaaatgattcctcaaaaagtttttggtggcaggttgccggtcttgatgtcaagatcgtcagaaagagggttacaaggacatacaccgagttcagctagattacagaaaggcgctggagctagaagaaatcagcaccttttgctttggacactggcaattagcggatcaaagcattttgtggcatccaagtagacaataacagtgtcagtgtaagacaaagtggtgaggactaatcgccatttggtgtagccatgatcgtgtcttccgtgtaaacataaaagtttctcaggagtcagcaggaaaatttccgcattccaaatgagaccctgatttatatcacggtagaaatgactggtagccgccagtaagtagtaactcatgaaactcagcatataatttcatttcccggtgggaacaatgtacatcaagaatgtagttttaacatcatctacgtacagaacgaatgatagatcggtcacaaacctcgagtgagattactagttcgacctgccttgccatgaatggacctgcgtagtactactactactatacacattacataggctactagtcttcactagctctctcctggtgcatgctctttccccactatgtaagcttcttcaatctgcagccttattatactgatcttgctctgcatgccgttgtagtgtgcctgttagtaggaaaactggaggttggaggagaatgactggccgaacttccaccacgccggcacgatgttctggaagacgagggtctggccgccggtggaggtgacgccgaaggtgagcgtctggccgacgaggccggcgtgcgactgccagttcgcgccccagttcctgctcaggggcatcctgtcggtgttcggccccttcacccacaccgactggatcgacccgctcccggccacgttcgagatcagcaccagctcgaagtagttgaaccctcccatggtgaaccgaacccctccctgcttcacgcacggcaccctacatacgtccacaaagaatcacagatcgtacgtagtaatgatgattaattagtgaatagttaatggcattggtttgacttaattatcatggacatggagagtcaaaccgtccaatattattgtagtatacgtacctctggtacagcaccggcacgataccggccttgtagatgccgatctggagccaggcgggctcggccatgtcgaagtgcgtgcgaggcgggttgcaccagccgccgtcgttgctggagagggcgtagttgggcgggcacaggttggtcccggtgatggtcaccgtcctcccctgcaggcaccaccgcggctcggcctggtggtcgcacgcgatctggtagcactgcccgcacgacgcgccgtcgttgaacagcgccgagctcagcgccgccgtgttcgtcccgtaccccgaccagtacaggttcccgtacccacacgccccacctgtgcgtggtcacctcacctggcctctgttagctaacgacgactctgaaactgtacctacttactggtgcgccaatgcgtatacgtacccatcgtcccggaggcgtcgctgccgccgtagaacgtggccgtgccactggaccagcctgccgtcgtcggcgcgatgagcgacgccgcggcgatgacaacgacgagcggcagaatgctcggtgtcttcttcttcttccacatcgccatgaatcttgcaggtggactagctcgccgagttgctgcaatgtagttagtgacagtggtagtagtaactatgaagaaatgcgagtgatcttaaataggagcgggatcaccggcatggaatttttgcctgcgctgcagcgcgaatggcgcatgtacgtacactgcacacactcagctccaattaattgcgtcgtcagatcggtgatctccttgtttcttcgtagcttctttgcaggcacactaacatgcaaacgaagaagaagattctctcatttctctccaccagatcgatctgcagctacgcgtcttatattcgatccgtaattaagctgatcacgctgccacttccgcatgttctctgctgctgcatgctcagctcacccaagggcaaggggaatgattagctggaactatttacgcttcttaaaccggctatcttgtgaattgtttagttgacagagttgacacgccatggaaggatttggtgagatatgagaggcaagcaagcggcagctatggtacttgctcacatgagggagagcggcaagccgggcgcaggaagaatccaagtgcgctgtcacacggatatggcgagaagatggtgaattatcaattatcaactcaccggatttgcagaagtcgccggcagcgttcacatacagtaaccagattgatgtcatttttaactatactattttttgataaagttgctaaaaaaatggtacgtttagtttgttgccgaatttagtaaatacataagaaatcctaccaaaattttggtaatattgctatcttgccaaaatttggtaagatttattttggctataatctgaataggccgcagattttctatttactttttcctaactttttaacttttaattttaaaattatccatttcaaaaacttaaatatatatcgtttaattagctaacgacattgacacatggcaacatttgtcttgccaagtctccttaatcggtgtggcaggataaaactgtcacgttcgttatgggtgatgtgacagtgttgttttgtcatatcatgtgaattaccatggctaagagatttagatcttaaaataagtttctgatgatttatttttgaaattaaaaagttttaaaaaaaataataaaaagggtaaaatatctccgtcctcgccgggttaggcagccgaaaggcccagatgattacatcggccgtcacgtgaagcccaattcacatgggtcgcagtgtcttcccgtcccaactaatacggctcgttcgaacactgaaattccgttctgaccgaactgggccgtacgttggtgacagtcccgctcaggcccaacttcaacgggccgcagattggcagcaatcccgttcgggcccagtaagaacatggctcgggcctcaggggttcggagttgggaaaagtacactgaaggtcgctcaacttgtcatcgagttacaaaatcgtcctccaaccgtaaaaccggatatagcgcatcccccaacttacaaaaccagtacaaactaggtcactcagtggttttgacttcggttttgttcgatgtggctacacgtgtagtacctcaaggttctgagtttatatctccataggagcgaatttaagagattgggttatttgcggggcaaagttttctatttcaatggccgtatatatccagttggatgtagaggctggataaaaaatatcgttctctaaaaaaagaaaagagaaatggaagatttaggtggggaacctctctcctatgattattcaaaaaaaaaagcctcgacaaacatttctttttttttctctctgttttagtctccttaagtctatggtttacttgttatctgacttgactatcacaagctcagaacggttgtttgacggaggcctagtttagttcccaactttttctttaaatttttaacttttctatcacatcaaaactttcctacacacacaaatttttaacttttctgtcacatagttctaatttcaaagcaaacttccaattttagtgtgaactaaacacaccctgaaactgcacatcatcacctgtgtactgaattctatttgtctcaaaaaaagaaaaagagaaacgaactgtcagtcacctgcagttgctgtccaccactgacaagcatttcacttttagttcgtgtgccaaaattttgaaaaatgaaatggcatattggactcaaaaagctacttcagcctgccgctgacagaaaactctccaatccgacccatagggcgcgcttgccttttgtctcagattacaggaatagtgatgtccccttctgcagagcaatgtgaagcatgagtgcatgttcagtggagtgttaatagatggaactcaaggagggaggagactggagcaggagtgcaggacacgggcatgctatgccgtacctccggcacggccaatggcacaggtgccggcacgctttgctgctgacattagccgtcctcgccgcggctgttcatcgggccgttttgttttgatactaaaaatatgcactaccaatttataggcaaattgcaaattgaatagtatgcgttagttttgattgagccaaatatttaacagtgccccctatcttatttggtcatattttagaagcttcttccttatacaataagaatttggctttatatcggtaacaatctaaatgattgctaaataattttatcctaccaatattttggtagtgccaaagtttacctagactttgacactaccaatgaattagtagggtaatgaatcaaacaagcccatcatctgtcacccagctgcagtcactctgggcatatggagacgagctaaggcctatggtctatggcggtggctaagacaccatcagcagcgatgagggggacgaggatgctgaccgactcactccacgctggaatgctgcgtcggagctccggcgaagcacgacatgaagcggcggtgaagctgtggctgccaagaggggtcggtgtttaaaactccgactgggccgacccgttaattttgatgggaataagtccacttttggtcctcatctttatgtctagtttgaaactttgaattatatctaaccacaataccggatataaaacatccctcattgccgatgcagtgatgtacccattgtaatttacgtttggaatctgtatggagacgagtattttcctacagaatttacgtttgagttatccatgccttactgaacatctatctatctatctgccttgcgagccgtgacttcattatatcagcctacaccgccttctgtcaacccactttatatcagttcacccagttaattaatttcaagtttctgtaaaaaaaaactgtatggttaaacttgtaaattcagctgctatacttttaatagatctcctcttagttgtactctctcttaataattcgctggaaacggctggaaactaacctgttcggtctaaaaataacttgcacaaaataaactaatggagtctgttgcgtattcttaaatttttttaaaaaaatcaaatgaggtcaggacaaagtcgatagtgcctggagctaatcgttctgttccaggaatatgtgctcaacttccatatgaaaacgaactaaaatcgagatcgagaggaattgctgttatgcacatctgtccggaaaaacttgtactataatcgtctgagagaacataaacggtttgtcgttgcatgattatagttaattagagtagattcttcagttgatgataataaaaaacgacatggttacctactactacttgataatacttgtcattttggatgagactaatatcaaactttatttttttttaactaattctaaaatatgtcttttttttcacgaatgcgcaaaataattatatgtcaatatatcagaaaaaaaagtgtttatttacacagtgcaatcaaccagaccggcttatgccaagcgaagggagaaaagacaaaataaaaaaaaccaaggaaaaaggaagatactactacgatagtaaacacaactctaatcaacggaaagggggtagagccacactacctgtcacaccccaatctggcaccgccgtacaacggcacctgataggagcgtgtcgtaggaaaaacggcgcgaaccgctccctacgaaaccgcgatctcagtaccagtcccaggacatagcgctggtacccacggtgacaaatatgaatcattacaatccttaaaataaatagaggacttatttaccttaacttaggttgcagctcagacagcccgagaatgcaaccgacgacacggacgaggcaaacaccaacaacaacagcagcagcggaaccaacggtctaacacccaacaccacaggcgacggctgggaaccaggacaaaacccttaatcttcactttacttcatcttcaacttcaggacggaggaactatatatatttatatagagcaagggtgagtactttcgtacttagcaagtcacgggaatttaggtgtttaatgcaagcttggaagagaggcgaggttgttttgcaaatcctttgtttgaaatcattttgaaatcactaagtgatttacttcttgttaagtttgggctgaaaagagacttgcgtctcaaatcgacttaagagatgcttttcaacaactcaattggtaatgtaccgacctcccgggttagatcattacctctcggctcccagagccatttcacttgattaatcggctcccagagcctttctcattttctcggactcccagagtccagctgcccagcagcaccacattccgcttccactcgggaagcctagtctatgatgcccgtagacatcccgaatcacacagattcgtttctgaccactcaggtcatccatctgccacataggctgattctggttacgattcccatcccacaacttttcacaaagcacaggcaaacaaatctacgcaacggaaaccacctcacatccgcccatgaccgtgggcacggctgttcgaacagttagttaacctccgcagaggggtacactttacccacaagatacgaccttattccgaacacccgtcggtgtcggaggttcgcaacaaggcctttcctaagccggcccagggttacctcatgccacatagaaggatcaaatcctcacataaatataggccattttagttttcacaaatcaaactccaaccacctcgatcggtaattcagcaagcttctcttccttgcttaccaggaacccggtttggctccaaccgaccccgccccggcgttccccaactattggcatgcgaggtttccctgaaccgactaattacttagccagggtgtcccattccaccttgtggttgcactttgattatgctcgatgagtttcccacaggaatcggtccttatatgcgaatacaggacagtgccacgcaggcacaacccccgcatcgtgagttttcacaattcattttatgtttaaacacaccgacaccacatgtcgggttttcaaggcttctcaaacccatttcccaagttttcgacaatcaacggtgcatgtgagatatttggtatacgcgctcagagagcacgaataccaaagtaccacaagggtggagcgacaaggaatcatgatagtacagcctacaggaattagtgcgactactgggtaggtccgtcggtttggcacgcaaaccgaggccaagtaagttatgtgtgtgactctaataatgcaagttgtaaacaaaataataatgattttctaattataggagcaattgatcaaagggtgacttgccttgctcaaggtcttcacggagcttcacgaatcttcgagaaaacccgcgatcggcgaaaatccgataaccgcaactatacgcaaacaaacaaaaaccaaaacaaaagaccaagaaaaagaccctatttagactaaataatagtgcgattaaatagatctcaattttatggaaatactggaagttgaacggaatcaatcagagctacggattgagagatatgaattttggaagtttaattggaatttttgggcaaaggaagatatttgtggaacaaggggaaattgatttatgaaatttatagaaataatattctcaagaatattattgtcaatttatagaaataatattctcaagaatattattgacagtcacggacgtgcgggaccaagggaaatgattcatggaattttggaataaggaattgatttatggaaaaggaaatggacggggatgtatattagactttttcgggcggcaagggcgcggcctaagggttgaaggaggctcggccgaccatttaggccggcgcgggcgcgggaaaggcggtccattagggcgcgcggaagggagagggagcggtccggtggactgagtgcacctcgcgggttccaggtggggcccgcttgtcggtgacatggcccacggtgggatgggcgcacgcgaggtgcggcgctagggtttcgggtgcgagtggcttagagcggtgcaccgggtggatggatggcggcgggcccacgtgcagccacacggcttgccgtggaccgcgcgcacgggagggaagacggagggagggggcggctgactggcttggcccggtcaaagccgaggtggcgccgacgtggcgcctacgtggcagccacgcgggccggcgggaggaggaagaaggggaggccgagatggacggcggacggcggccaagttcaccggagctcgtcgcgacgattcgagagagagggagtacaccggaacaatgggaaggacgagagggagtgagccaccggatcggatttgccgaaggggattcgatggcgacggatttcgacggtggcggccggcggcgatcaagagggggaatcgcggcggggcgacgataggtcgattcaaggaggagggagcatctccggggcgcggggaactcatttccggcaccggatggggcggaggactgccgaggagggctggcgatggcggcggcctccgggagcgggcggcaacggcggcaagcctatggcgggcggcggcgagacctggggcggtgtccatgcgtgttcgggggggctggccgagctaccacgcgagctagggagggagagggcgagcgaaaagagagaacggagggtggcactaccaagccgggacgggcgcagttgtagcgcccgttccgtcgtggcgcctagcgggaaaatgtaatttctaaaaaccttaattgcgaaaattgtttcttcgcttgcagtcagtctccgtgccattccggatctcaaatccccgacctatcgtcacgttcaaatcccgaatacaaatccttcccaattcaaatccctccgcaaaagtctattttgcctccctcaggttcgatgggccgaattcctctcggcccatctctctccccctcannnntntntntntntntncctncctntntaccccgctctgcccgcccgccgcgcgcgcgtgcgcgtgagcccgccgagccgagcacccttcgcccgcgctgcccgttgcttcccgcgcgcgcacgccgtggtggccgaccgcctggttgccgccgctgtcagcctctgccacgcctgccgcccgtgtcgccgctccgctccacactgcccccgccgtcatcgccgtcgtcacaacccggccccgccactccgcgcgctagcctccaagggacggaggcagagctcctcctcctccctctgccgcgtcgccccctctccctcctccttttctcaaagtggcaaggggcaagccccctttccctcctcctttttcccttttctctcccgccggcgtcatcccccccctgtcgccgttttggccgcgaccgccgagcgctagccctctcccttgaccgccctaggtcggttcccaaaccgacatcgccatcctataaagcccaggcgccctccctcccttctcctcttgtttgtcccatcgcctccactccattggcgccgcctcccgtgctctgttcgccgccgcctttcgttgccacgcgtgccggaggagccggcgcgttcgtggacgcggaaggggactccgggagctcgtcttcttcctcttccccggcccgaggccggagagatcactcccgtgccgtcggcctcttgtcacagcgccccgcctcgtctcggtagtgcatccctccgttctccctcctcgctccatctcttccccttagctttgagtagccgctcgagtagtaccccagtactagttggcgccgccccagcgccgcgccgccgctcgcagtaggctcgccgctgtcgccgcccgagctcggaagcgcctctcgtcgccggcctccctcggtgcgtttcctcctaatccggcgcaagggacggattcccggagtcgcgtagatgctctagctcgcccgaatcgatctcccgtcgcgccgtcgccgtttcccccttccctcgccgccggttgccgccgccgcaatccaccgccgtcgagccccgtccgacgaatccgagccattggcttgtctctcctcgtctcgtgcaaccacccggtgtgctcgctttcgcctgtatcgccgtggttcgccccgccgttcgcagccaccgtccgccgtctgttccggccggcgccttcttcaacctcccgccggcccgcgtggcagccacgtaggcgccacgtcggagccacctcggcacgaccggatcggctgacccggtcagccgctcccttcgttccaccctcccccgtgcgcatggtccacggtgagccgcgaggctgcgcgtgggcccgccgcacccgagtcccccgcgagccgcgcgcgtgcgccgcgccccgcccaaaccctagcgccgcgtcgcgtgctccctccgtacggtgaaccatgccgccgacaagcgggtcccacccgggaccacgcaaggtggacccggcccaccggctccctctctcctctccgcccccgcgcgcgctttgggccgccttcacgggccggccggcccgtcaagttcgaccgagccgcctgcgaagtctaatttccctccctctttcttttcttttcctttttttttcaaaaaggatttaaataaatccttttcctttagacaaaaaatccaataatcttagaaattcaatatcttcccaaccgtaagcccgtttgactccgttcaacttccaaaattccttaaatctcgagatctatctaatggcacgcctagaggtcaatagtagggctttattttcgccgtttgttgtgttgtcccatttctcgtgtagtttcggagcccgaagacccgcagtgcgaggattttgaggatcaagctcaagatctcgagcaaggcaagtcacctttgatcatcttgcacctataatttaaatctaagtatttcttttccgcaaataatgcatgaataggatttacacaagtaattcggccgtggcttgcgagataacctgccggccccccaatcctaattgctgcaattaccctccttgaattattgaacacttaaaccccctttgtcgactgttgtgcttcgatgcacgggccttcaagcacgcgcatcgggacacctctcctcaaatttaaaaatatccaatgatgggtaaaacttgggttttacaaaagacttggaaaaacccgacacctgggtcggctcttgcgaactaaatgaattttcaaattcgcggaccggggaacgtaccgggagtacggtttcccgctcttgcacttaaggaccgtttccttggaattacatccgaacataagacaagtgcgaccacatgggtgaaatgggacacccctagctgagtaaattgctaatcgggggagccttgatgccaagagacatgtggattcaacggggtggtgtcggggagaacccccgggcttcctggcacagtatggtctgggacctaatctggtgttagtctgggacccctctcgttggcatacggtgaacctgtgtcggctttcgaaatgccttgtcgtgaaagccccaaagtcaccagacgtggctgttatgcacgggctgggtgaccaaggctagtaacgtcgtgtgggtaaggtgtaccccctctgcagaggttaacaaactgttcgaacagccgtgctcacagtcatgggcggatgtgaggtgattcctagcgtagttttgtttgactactgcttgtgaaattactgctgtggaatgggttcgatgtttggaaaatcggcggctgatgggatcagccaggcccgggtggccgtttgaaagctgttggccgggtgctaaccttgatcaattcaaagactgatacattgcacatactccgaccggacgagacgcactgtctcatccgtgtcatttgagaagcactcacctagtcgtttcaaaaaagagtttaaataaaatcaattgcaaaaacaatagcctttcctttgaagcctgcattaaacacttaattcccatggctagctgagtactcatgtactcacccttgctctatataaataaccccccccagttgctgaagaagatgatgtggcccccgctgacgaggagttcttctaggagcaagtcggctacgatgagttttagggtttcgacctagttcccaagtcgcgcctgtgatgtttggcccaagtcttggtttccgctttcccttttgtaatgcagttgtgagctcgggatctgtccgcagcccaacatgactgtactcctattctataataaagagacctctgttgctgtgatatactgtcttcctgtgataccagcactgtttcctgggactggtatcgattaacaggttaatttggagcgtcacgggctagtttcgttcggggctagttcggggcgtgacagcagtggcgagcggccgacggctcgggagcgagctctccggcctcgggccggggaatgggatgaagagggatggccggagtcctcatcttgcgtccacgcacgcaccggcctccgacgcgtgcgacggcgaagagacgaaggccagagctgggagcggcggcaaggcgtcaacaatggcgcggtg

SEQ ID NO: 75641 - DNA, 1314 bp, Oryza sativa
  unsure (1)..(1314): unsure at all n locations
ggcgcgcgcgtgcacccgcgggtgcgcacgcggctgtcgagtggctcctcggcggtgcctctttgcccctctccccctccgtggccggcgtcaaccacggccggcgacgaggtaagattagggttagggtttcgatcttttcgatccgttggatcgtttgcttttcctttcttttggatttctttccccaaccaatctaaactctagggtggctctgataccattgttagggttgtctattggatcacctaggtttagatctagtcgggtggttctatttgcgatggatgattgaacaacaatagagaataaggaaagggtttagggatgtgaccggttgacgcgttggatgaagagcaagtcccagccatcgtcgttgtcgtcgctctgcttaacgtgggcgacgccgccgatggcggtcgtgacgaaagcggtattgaaagacagtggtgatcgtaggggatcccgcaaaggtcgtggcgggggggtggagtcttcccgtccctggttgcgccccctcgatcggttagggtttatggggtggagtggcgncgtngtnnnnnancnttgttctttgtgtngnnannnngtnnngtcctccacccctctttatatggcacagtgtgacgggggcccaccagccattggactgggcgcccccgatcagggcgcgggtcaaggcccccttgagccgttgggctcaaggggagggagatccatctaacattctcccccttgatctcactatttcctttagctttttctattccatcacagatttacatatagagtatgtttcatcgtcacggttaattaccgatggattcgacagccactatacacatctctattcagaaacagatactttaacttttgggccctatagtccaggattcataaggcttcccttaaaacccatgcatgctacatgttccttgaacatgttgggaggtaggcctttcatgagcggatccgcgagcatcctttctgttcttatgtgctcgagactgattgtttgatcctggactttgtctttcacaacatagtactttatgtcaatgtgtttggcagcaccacttgactaattgttgtgagagtacattactgtggattctttatcgcagtataactttagtggtttctcaatactatcaaccacctttaaaaccgggtatgaacttcattagccagttcacctgccccgtagcctcatggcatgctataaactcggcatacatggtagaccctgcagtggtagtatgttttgagcttttccatgaaatagctcctgctgccagggtaaacatgtatccc

SEQ ID NO: 75642 - DNA, 2188 bp, Oryza sativa
cccacacacggaggatccatagctcatacggtgttttgggcaccgatgcattctatgcattgtatgcattgttctaaaactgagaactccaatggaggaagaactacattcttaaccagtctctcaattctccccctcgaaatatggcataaacacaagtgccataatttcgatgagacatcagaagttcgctttcttttcttttgtcaacgaggacacaacattcacattctcagaaagaaataaagctgatcttgcaacacaagaccaatacattcattattataccatagttcacatttgccatttccaaaatggcaatcatatctatcaaaatccaatttggatacacttattatcaagtttctttgcaaagaaggaacataaaaacgtctggaagtaaaagtgtgaagccattcgcgagttctaggcgaagatctccagcctcaacttttgcttcaactccattggcaactctaatggatctttcacttctttgcatagtcctcattgaacggaatccctttaaacaattacacacatgaatagttgctccagaatcaatccaccatgtggatctagaataaccaatcataatgagattctttacaaatgtaataatgttctcacctttctttgccatgatcactgtcaggaagtcaggatgatctttcttggaatgtcttttcttgcaatgtagacactgatcttgtctcaactgtaaactgttgcttctgaggcagatgctggggctgtttttcttttgaggagggtgacctgtggctcttttccttgttatctttgacaaggttaatggagtcaccattggtctctttgtgtctttcctcctcttgcacacaattagagatgagctcttcaatattccaattctctgtacttattttgtagttgacaacaaggttgtcaaagttctttggcaatgaggacaaaaccagatggaccagaaagtcatctgagatgcccaaatctttttgcttcaatttggaagccatattgctcatcctaagaatgtggtcttttacaccacctccatggtacctctctgtaacaagctgctttatcagctgtgtcgcataaaactttgaagaaccactaaactggctctttatactttcgaggtacttagagacagtgtcatactctgggattgagcccaatatggttggctcaatcgtgttctttaccgcagccaaacaattcttgttggctgaagaccatttcgcatgctcaatgtcatacgacatgatgagggaagcattgtccctctctctcttttgccattcagcatctgactctttttcacctctgaaaatttcagcaggttctataggacatggggtagtcaacacccagtccacctctcccaagataaaagcaaggtcgagttctctctttccattcttcgtagttatctcctttcagggtcggaatatctttaatgtaacccatcaaggagtagccacctaagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcatcaatttcatctatttgcagcggaagatctatatacaattcatataaattttggggggaaaaaacaaaactctgttgtttacgctctgtaaaattctcccgttggttcaaatttaaacagagataaaacatgttaaacaattcaaaattctattgtaatttgcatgaaaaatacaaaatacatgttcagaagcatttctcacatttatctattctctaaacaattttcacgttggttcaaattgcttagaaataaacacaatcattaaacatattgaaaatgcttccttcggccgagggacttttattaaacttcctttttttttattcggccccgagggacctaaaatgaactttttcggcctttgccagtcggcccacggccgccttgcgcgcgggcgggcgccccctcccctttccccaggccgcaacctgggcctgggccgggaaagtggctcgccgggcgctcccacatggg

SEQ ID NO: 75643 - DNA, 1406 bp, Oryza sativa
tactgcataagaaataacagaaataaaaaaaatataaggaaagatatgagagatgtagtctcaagaatacataccccactgcaggatcagctgataactccaagtgcgtagcttccgacaagccttgaagacacatgccattggtgccgtaaccagcaacaacctcatcagcacaaccaaaacaataatcatcatcatcatcatcacaaccaccagagacactcttctgacatttgtcctcacaagcttcatcgaatctaacaattgcttgtagcaaggatggcatgctttcaaggaacggagccctaccagggcagtaacttagctccaacgaaactagactcggaaaacacaaccaaatgtggtattctatagaaaattgacactgggagaggcacaatgttttcaaggatgaagacgacagtttatcgacatagatacagcaagtatccatattcagattcaccagcgatgggcagcccgacagatcaagaaaattatcatcgccactaataccttgaagctctaacctcgtgaggtgctgagagatgagagtcatgttaagcagctcgacccaatcgatcaaactgattcgtagcacccgagcttggcagcgcaaagctcgctggatccagcggacgaagagctgctctttttcaggcaagaactccgggaaattgatgttgatactgcagtaattcagaggcgcgctgctgctgcggagcgtaaaaaaagcgtccaccaagctgatgaacctgtcgcccggttcatcgtaatcccaccactccacagagaggcccggtgcttccttccagaggtggagccagcgccgggcgagcacgcacgtcgccaccgcgtcgtgcaccgggagcagcgacagcacgaggtggagcacctcgtccggcagggcgctgatgcggtccggcgccactcgctccttcttcttcatccccctggccgccgccaccgccttcctcttccggggagccaggggaggcattccgtcgaacggttcccgcgcgtgtgggtggaagtgtaagcgcggcgtcgcatcggctccgccgaatggcaccgaaatgcagccgcgcgcgcgcgtcgaacgccggaacggcagcgagatggagtctgggagatgagtttggccttgtttgctcgccgcctcgatctccgccgcttcggtcgcctcgccgcgcgcgtttacactcgcactcgcggctgcctgcctagtcgcctcgcctgctagcgcttgcatgcggacgctttgaagccagtgctagctgtactcagggttcacagttccgacgaaaaccggccgaatttcgcgaaatttcgatgtttcaacacggctcggaattaagtttcgattggaatttcgaaggttgaacagtagatttggtcgaaattca

SEQ ID NO: 75644 - DNA, 3550 bp, Oryza sativa
gtattataaaataagggtgtattatagtttgttacctcagccagcggaaacagtgtgaacatgacatgtaattagaaagactctatggctaacattcaattcagctatagcttgcgtgatggctagcagaaacgacattcgcgtgcgtaaatgatcaagagcatttctgctgttcggaacatttctgttattccccgcggacaagtcacaactacttctgttcagttttaactactcgattggaaacttcagtttcaaggtacgacttacagtttctgacgacagtagagcttagaccagcaaaccaatcatgcatcattacgcgttagtcaatctctcggcgtttgcagagccatgtgcatgcgatcgttggaacagtgttcgcatgcttcaataatgcataacgacaatcattccctagcttaattaattggtatgcaatccatgcctctctgcagagttcagacctcctagatcttattactactatttaagcaccaccaatgccgcacacatccctcacctccaaatccattcttcccaacaatatctagctgcacctgcgcaggagacctagctatagctacaggaaatcatggggaacattgtcctgcagctgctcgcgattcttgcactctgcattgcaccggcgaggtccggctggctccagggcaccgccacgttctacggcggcgccgacggctccggcaccatgggtacgtcgtcgtcgtctactccatttcctctcgcatcgcattgtgtcaaccattgcacggcaatgcatcatcatgcataatgcaagacacaatctgatggaatatatatgttggaacaagtgcatatgggatggtctcgatgggattaaccgctgatgtgcatatgtgtgcaaacaggtggtgcgtgcgggtacgggaatctgtacgaccagggctacggcatcaacaacgcggcgctgagcacgccactgttcaacaacggggcgtcgtgcgggcaatgctacctcatcatctgcaactacgacaaggcgcccagcgggtgcaggatgggcacggcgatcaccgtgacgggcaccaacttctgcccgcccaactatgacctcccctacggcggctggtgcaacacgacccgccctcacttcgacatgtcccagcccgcctgggagaacattggcatctacagcgctggcatcgtcccgattctctaccaacagtaagaataatactatcagtagagaccaccgtaaaagcactctaaaacgaagaagttgtgtgtgtgtgtgtgtgtgtgtatatatatatatatatatatatatatatgcatgatatcatgaaatagttaacacgttgtggtgtgatggattatattgaagggtgaagtgctggagaagtgggggagtgagattcaccatcaccgggttgaactacttcgagctggtgttggtgacgaacatggccgggagcgggtcgatcgcgagcatgtcggtgaagggctcaagcacggggtggattcagatgtcgaggaattggggcgccaattggcagtgtctcgccggactggctggtcaggcgctcagtttcaccgtcacctccaccggcggccagaccatcgtcttcgacagcgtcgtgccggcggggtggtcgttcgggcaaaccttcagcacctaccagcagttcgactactaagctatatatgttcagacatcaggaacatcaagatcgtcgtctgaaatgtgaatgtctgatcgatcgagcattcatacttcgttttcatttgtaattaagctagagcgctctaagatcgagcattgtttattgggatcattaattcatttgattgttcagttgctaattgatggatgtaaattaagttgcaatatatccaaggcaatcattattaaatgatatgaaattgctactgaagattgcattccacgagtattcccgtatatcatgaaatgtgtacgtgctagctagtagtagtttcttcatcatggatactatacaaatatatctctttgtactatgcattgttgatgcgtcttaatatacatttaattaatgtactctctttcatctagacaccaccctttgactgttggaattatatgggcaagcccatgtagttagacaataatttctgaaaaaaaatctcaaaggcccaaaaaaatgcacgtaaaatttagtaccatcttactgattctagaagtatgagatcgctttaaaagcgtggtgctctctatatgctactctctctccgtcgccatggttttccgcgtccaactttaaccgtttgtcttatttgaaaaattttgaaaaaaattaaaaatataagtcacaagtaaagtattatttatgttttatcatctcatagcaataaaaatactaattataaacaaattttaaataagacggacgattaaaattaggcgcggaaacttatggttgcccttaaaatgagacggagggagtactagagcaatatgcatggaagaaaactaaatccggacctgttacgctaccttactgtttgtgtgtgtgtgtctgattgagctgcaaattttcatctgtttgtgtgtgtgttttcttttcttttcaaaaaaaaaatgtttgtgtgtgcgtctgattgagctgcaaattttcatcctttgggcttgctcacgcaactacgcatgtaggccttcgggcttcggtggttcaacccaaaaccaaatttccatccttgggcttgctcacccaactacgcatgtaggccttcggtggttcaacccaaacccgtgtgacactcaaacaagccaattaaaccatttcattttcaagaaatctcttcggcctttctttgacaacttgtttttgcgaacatttctttgacaacttgcataacatgtgtgatctgtgtgtgttttccggtgcctcgtttcagtgttttcgcggatgcgaccctctaccggctggtctccagtttcacttcctatcaattccaagctttatatggttaaaccggtaattccagctgctacaattttaataagttgaattactaaaccacattcgacattcgataggaaaaaaaggaggtaaaatcttacaaacttctaaccttcatatctgcttcgccatccgtgctccagttagccaactctaacgaccttgttgaactctagcggacaacaacgacgatcctaactgtttaggatccggattggggttggggtgataggggtgggaagagggggaagagggggagtccgccagctttacagagatggccgtgatcggcggaagactggtagtaggtggtggaattgggcgggcaacaaagtagcgcccccgaaaccgtggggatgaaggagggcggtgggctggcattggctgcggggccaaaacaaagcgactagttaagaggtagtgggctagtggctaatggtggtggatccagtggtagggagtcgatagaaacaaggaagatcaccttgttgtcaccgacttcaggaggagtggacagagaggggggagggggggcgaagccagtcggagggccaagggagaggggg

SEQ ID NO: 75645 - DNA, 7754 bp, Oryza sativa
aataaagggagtagctatgtaggtgacatgtatacacctagatacgattgcacctagctataaaaaatactttcccgtggcagttccacaggaccagggcatcaggttcctgttgccatgcacattttagcacgatttcagcaaatttcatgcagcacgttggctgtagcacattcattcctgaacacaggatatggtgcgtctgtcgaggcagataacagaatattcaagatgagaaaattttgtggatggaaccacttggctccaagtctatggtgtgaaccgccctgaacattccggttcaaacaaaacaacggtagcgtcccgagaactgacaccgcgaacagctagccatagtttcatcccagattttaattgggctgtttgttattccaagggaaaaagatagagcaataaaggatcggtcggcttatttccgtgcggctgcaagcctcctcgtcctttttggagtcaaaggcttgtataagcagaggctcatcaggatggttggcttgataagtctggcgtacacaggttgtttctggcaagagcccaagagcagatcggaaccgacttaacagaacagcttttctgcaagaagaacgaactgatgaaaagatcaagggaaagaggggaggcgccaatgcgccatgccttggacgtcacactgcacgcaccggcaaaaaaaaaaaaaagatttagttgtgtttgcgaaattaacagatagtggatcgaacagcgtttgatgttcaaaaaacagtgccgatggagacgcggggaatcgaaccccgtgcctctcgcatgcgaagcgagcgctctaccatatgagctacgtccccaacgatggtaatgtgtaacaaccagtgtatgatactttaatccatgcaatttgttgtttagaaagtgggatcgcggtagaagaatttggacagtcagatattttccgtatcttaaaacgccaacagcatctctaaggcaccacaattgacaagaacatctctgaactaattttttagactaagggtcccctttgaatcgcatgaatgagaaagtataggaataggaaaaacgcaggattttaataggaatgtaagtgtaaacagaggattgcaaaacacaggaatggtcgtttgattggaccgcagaaaaaacgcaggaattagaggagagataaagactcagaggaaagtttccaagaggttttaccccatgttagaattcctccaaaacttgcatggcattagacaatccataggaatttcataggattccataagatttattcctttgattcaaacggctatataggaaaaattcctataggaatgaaaacctctaaaatttatatgaatttccttcgaatcaaaaggggcctaaaattactactccaactacgccaactgcctctgtgtattgtcgaactccactcaaccctacagtttggatggcttggggaagatgtccggcgtgaacttttgcgccgcgcttatactccccttgatcttcaatttacccctgcaacaacgcacgaacacgatatcatcacgacaactcataattccttttttcctaagcaatctctgaatcaaatcaagattgaatcaaacagttctttccaatctcacattatgaacgccatctgagggttcagcttgccgctggagatggccaggaaatcgtcgtccgtgaaggagaaggtcgcgtctggcttcccttcgtacggccctgacagaaaaaggcagagcttattcagtacgacgacgcgacagacaaagacaagagtcgacggagatcgatcgccgggaaagctctacctttggagacgacgcccttcttgagatcgacgacgaatacctcctcgtcgaaagcgagcttctgagagaaaatccacaagtgcaacgccgcacgtacttagttaatctcacggaaattcatggtgttctagtcgattgaccgagatggttatattaccttgggagagatgttgagctggtaaacgaagccgatcttttcgacgagctccttgccggcgccggaggcgaggtggacgcgcaactgctccagtagcgcagccgacttgaggttgctcccttccatcgcgtcgcgcgattcttggttcagattttggaagtttgattgaaggtgagagacggagttgtgttctttgggctttgatctggaaggctttttatgtataaactccatccaccttgcagacttggggacacagaactcggttccggaggccttgtcatgttgttagtagttgcattgaactcttaattaactttcactttcatgcaagattggaacagttcaggtaaggtactattgtgaaatcagatttaggaacagcgatgaacagttgcagaatctgttcttctttatttatcaaccatcctctgtaagactgtaacgtgaatgaacacaactttgtgggctacaagatcaaaccaaaacgtgatagtacaagcgtgccattggcgaaggcattgtcgtctacgttacaaggacggggagagatcaccggagcaagcaaaccacccccagtctgtgctcctactcctcgttctcctccctctccctccgcacggccccgaaccgctcgaccaggatgtcggcgacgatcggcgccagctcgtcgcacggcacggacttcttgtacacgccggcgaggtgagagtcgctgccgacgcggccgccgacgaagatgtcggccgcctcgacgatcttgccggcgctgtccttggtgaggcagcccatgaatccgatgtcggcgacctgcacctggccgcagctgtttggacagccggtccagtgcatccgcaccgcccggggcaccgacacgagcttctccacctgcgacgtcaccagcagcgcccgctgcttcgtctcgatgatggcctggccgcagaactggttgccggtgcacgcgacgaggcccttgagcagcagcgacggctgcggggagaacttctgaagcagcggctcggcgagcagcgcctccaccttctcatccttgacgttcgggatcacgatgttctgctccacggtgaggcggagctcgccggagccgtactcgtcggcgaggcgcgcgagctcgaacatgtccgccgcctgcacccgtcccacgggcacgtgcaggccgacgtaggacagcccttcctgcttctgcgggtgcacgccgaggtagtccctcctctgccatttcttgtcgatgaggtccttcggcgccgcgcgctccagcacgccgttcggcatcctcttctccacctccgaccagaaaacctccatcccctgcaattgccaacgccgcaattaattgataagaacattggaacatacgtaattcagacaatggcgtggaaaaaatggctcacaagttcgtcgatgagccacatcatgcgggtcttctggcggttgcccctggtgccgaggtcgcagtacgcctcgagaacggccttgcacaccgggatgatgtcgtcgccggggacccaggcgtcgagcggcagcgcctcctcccacctcttggggctgatgaacccgccgacgaggaggttgaacccgaacttgccgtccttcaccgccggcatgtacgcgagatcgttgatgtgcgggtgctcgtacagatcgtgcgacccgatcacgcacacgttccacttcctcggcctgccaacaacacgcagcaacaacaagtcaacaaacatgtcagagatcgacgacacgaacagcacgagcatatcaagttgattcgattactgacaggttggtgatggtggggttgccctggaagttgctggtgatgtaggagaggaggttggtgtaggatcgggtgtcgacgatctcgtcggggtcgatgccggcgagcgggttgccgacggggttgcggacgttgtccatgccgctctgaaggctggtgaggccgacggcgttgagcccgtcgaggatggccggcacgtcggggagcgtgacgccgcgaatctgccagttctggcgggttgtcacgtcggcgcagccatccttgccgtacgcctcgatcacgctcgccaggtacctcgtctgctcgctcgtcgtcacgccgtttggcagcttcagccgcatcatgaaccgcccatctgcacagcgtagagccgtagagcggccgttagcattttgggccaaattcactctgggcccccaaaacactagtatatgtttagcaaagagtctaattaaaggaccacgagcccacggctccagttgggccaggtgacggaagagaattttagccgtgagagtcagtatattccatttcattggtgtggctaagatagttgatcttttgcttttctagtttgttttaagaacatatatatatatatatatatatatatatatatatatatatatatatatatatatatatatagctatatgccattaaaaaactatatagtatataccgcaccaaccaaccaatgacagccaccaagtgagccttttcaacctagtaataaaatgtaaacagaacatagaacaaaatggatatgtaagcttatgtacatcctgcagatgaagtagaattgtaagggaccaaaatgactttcgtttttctttttggttcaatcagtacaaaggccacacatcagatgctggcgccaaataaagtactcatactattacttatcaaacggttgtgcgaacattatgttacttgttagagcctgggactgtggctatatgtggcacatggagatgaagtgattggatcaaaggtttccatgtttgctcaatataaatagtcattactcacgagatcgtaattaagctataaaaatcacagcaacttaatcagtcttaattatgttgctgaatgtgcatcttgaaaaaacaaatcagcagaatatcttggcgaattaattgaggtaattcttcctcggcgcgacagatcaactaaccgatcgaaagcaagaaaatgtgttgaacagaggagcaaaagagaggcatacactgatgcttgtggcagtggaagaggccgagccacttgagacgcacgtcgatgtcctccttggagagcttgtcggcctcgatctcctccatgggcatcttggcgagctccttgatgccgccctccatgaacaacgatatgggctccttccccagcttcaccttctcctacgggttcagccctgcccggtacttctccttgagcacctagtaccgcccctctcgctgctccacccgcggctccagccgctccgccgacacggcatcgtccgcgaccggtgtcgaggaggacggcgcggacacggtcaacgactgcacggggcgggtgcggacggcgggagggcggcggcgggatgctgccacgtgtgaggacggggggagaaagcgctgtagggaggcggaagaggccatggctggagacggtggtggtggtggtgcgctgttgcgatgagggtggccatgggtgcggcgcgtgtggttgtttattgcagaggagggagggggcacgagggcgctgttgttggctcttggcgagttcaaaagggcagatgctgcgagagatggcagccacgggaggaaaatttacaaacatgcccgtggcccggcgggtactgttcgtttggttgtgctggtacggaataggagctcgggtagacattaacatcattttgtcttgtgttgctatcaaatggtttttttttcccggtgtttttcatttttggaaagcaatggtggatccataaatttttcaaagcttggacaaaaaaacctatggcaaacggttaccgatatcagcaatatggaatatcgacgttttattatacgtcggtaagcctaggcagctaatagagctgtcggatagttaatgttgttatttgtaaagatttgtatcctgacatagtgtacattatgtatcgtagcttttgttagttgatttctcgtctaacaaaccgagagaccaagtcgtaaagggcgtggtccgccccatgcctaaatcacacactttctaaactgtacgccatgattggtgatacattggtgatactttttaggttttgtttggcaaatagagtagggaaataatcccattctccaaagagtaatattgtatcctaaccatccattcttcaccctcatttaatcctaaccattcatacatttcccttttccaaaccccctccctcctctcattatccatttgccaatgtacattagtcccccatattacaccagcttagtagtatctatctatctatctatctattatatactaaaagtccattaaacttcctaaaatcactctcaagttaacatgtggcatcctaaaaacactctcaagctgccacgtggtgcgaccagaggagataaaggacccacgggtgcaatccatgtatttgcgttgttggactccaaaattcagcaaaaatcctaaaaatttaaggaaaaaatccacgggtgcagccatgtacgcatgtggctgctttccttccattctcttctttttctacggtagttaatagattttttttaatcagtagttaaaagataaaatttctaataaaccgcttgatctaccaaataaaattctgaagtcttcaaccttgctgtttttcctctgtacgcatgtgccctttttcctctgttttttttttgctgtggttgttataatcggttgttaaaagataatcaatgcccttttatggtgacgaaatttctaattaactgattgttctataccattagatctaacaaataaaattctatatattctccgatggctccaacaagtatgcatgcactcttctttgcctttttttctgcgatagctaaaaaatatatttaatgcccttttatggtaaaagaattttgcatacatgcacattgatgtcccacatttatagtaaaacacactatgtccattgttataatatttttcgctcgattttagaggcaggattttagaatttttaatacacatttaccccataccgagttgtacactcaacacagttatctttacatcccaaattttagagatcaaaagcatttcaaggacatagaacatagatatctaatattccaaatgaaattgcacgcatgacaaagcgttgtatttgagtcatctaaggtgatcacgaccgctgcagcgctatagctttgccacatatcaccacgtggcagcttgagagtgtttttaggatgctacatgtcagcttgagagtgattttaggaagtttaatggacttttagtatataatagatttgagctaaactgaaacaaattttgttgaatccaaagcctattataaattgcataaatcatttgaacttttttgcttgaagttcaatatctattctttaaaaaaattgaatttcttaaagtttagaactccaaaacgaagatttgatatgtattaaaaagaacatatagattagatgatatatagttcgtaggaaccaactccatggttgcgacgtaatactttcctatacttcatggttgttgtaagtaattttattttagaatttatatattgcaagtataattagcattcaaaatagtcacaaacaatttattgacaaaaattaggttgagaataaaagtaggaaaagtcacgcatacacaaatattcatatgtgtagagtagtatttcaagcaatactccctccgtcccataatataaaggattttgagtttttgcttataacgtttgaccactcgtcttattcaattttgatgagctactgtgccagtagttcatgatgct

SEQ ID NO: 75646 - DNA, 12796 bp, Oryza sativa
  unsure (1)..(12796): unsure at all n locations
ccttccacgcgttcgttgggngtttagctcgttccatttcttctcccccaaacccccctcctctcgtgcgcctttgtctcctctgttgctcctccccccccccccgggcgccttgattgcagtacnactaggccagnacntcatcacaccaagccctagcaccgcccctcccgtgagcccttccttcggtgaacccggtcactaacaaggtgcacctggtgcaccggaccgcgccccctttcttccgcgcgccctaatgggccgccttccccgcgcccgcgccggcccaaatggctcggccgagcctccttcaaccctcgggccgcgcccttgccgcccgagaaaatctaatatacatcaatcatccatttccttttccataaatcaattctttattattccaaaattccataaatcaattcctttggtcccgcacgtcagtgattgtcaataatattcttgagaatattatttctataaattccataaaccattcctcgtattccaaaaaattccgataaatcatttcctagtccggaaaatcccatttgagcttccaaaattcatatatctcgatccgtaacttcgatcgactccgttcagcttccagtatttccgtaaagttgagatctttttaatggcactattaattagtctaattaggatctttcttttggtcttttgtctagattttcgattgtttgcgtatagttgcggttaccggattttcgtcactcgtggttttctcgaagattcgtgaagctccatgaagaccttgagcaaggcaagtcaccctttgaccaattgctcctataattggaaaatcattattattttgtttgcaacttgaattattagaatcacacacttaacttgcttggccttggtttgcgtgccaaaccgacggacctacccagtagtcacactaattcttgtaggttgtactaccctgattccttgtcgctccacccttatgatacttcggtatccgtgctctctgagcgcgtataccaattatcccacatacaccgttgtttgttgaaaacttggaaaatgggtttgtgaagccttgaaaacccgacatgtggtgtcggtgtgtttgaaaataaaatgaattgtgaaaactcgcgatgcgggagccgtgcctacgtggcgttgtcccgtattcgcatataaggaccgattcctatgggaaactcatcaagcataacaaagtgcaaccacaaggtggaatgggacaccctggctaagtaactagtcggttcagggaaacctcgcatgccaatagttgggaacgccggggcggggtcggacaaaccgggttcctggtaaggcaaggacgagaagcttgctcacttaccgatcaaggtagttggagttgatttgtgaatggctaaaatggcctatatttaagtgaggatttgatctttctatgtggcatgaggtaaccctgggtcggcttgggaaaggctttgtcgcgaacctctgacaccggccagtgtctggagtaagttcgtgtcttgtgggtaaagtgtacccctctacagaggttaactaactgtttgaacagccgtgcccacggtcatgggcggatgtgaggtggttcccgttgcgtagatttgtttgccagtgctttgtgaaaagttgttgtggtgtgggaatcgtaaccagaatcagcctatgtggcagatggatgacctaagtggtcagaaacgaatctgtgtgattcgggatgtctgcgggcatcatagactaggctttccgagtagaagcggattgttgtgctgctgggcagctggactctgggagtccgagaaaatgaaaaaggctctgggagccgcctaatcaagtgaaatggctctgggagccgataagtaatgatctgacccgggaggtcggtacattaccatttgagttgttgaaaagcatctcttaagtcgaatcgagacacaagtctccttttgacccaaagttaaaaagaaagaaatcacttagtgatttcaaacaaaggatttgcaaaacaaccttgcctctcttccaagcttgcattaaacatctaaattcccgtgacttgctgagtacgaaaaagtactcacccttgctctctctctctctctttatatatatatatatatatatatatatatatatatatatatatatatatatatatatagttcccccgtcgtgaagtgaagatgaagtgaagtgaagattagggttttgtcctggttcccagccgtcgcctgtggtgttgggtgttagttcgttggttctgctactgctgctgttgttagtgtttcctcgtccgtgtcatcggttgcattctcgggctgtctgagctgcaacctaagttaaggtaaataagtcctctatttattttaaagatttgcaatgattcatatttgtcaccgtgggtaccagcactatgtcctgggactggtactgagatcgcggtttcgtaggaagcggttcgcgccgttattcctacgacacgctcctgtcaggtgccgttgtacggcggtgccggattggggtgtgacagatgttatgtgatggaaagttgaaagttgagagtagttgggggtgaactaaacacggcctatgtgatgtggaagactacaactgccccagctcacaacatgcagcagctaattataagctctctctcttaagtaaaagtccaagtgtttgattctcggtcacactttaccacagtttattatgtctaagattagataagtttgattacgttagcagctatttgattgtgtccacagttgtaataagattctcttataataaattaggtctcacatatcattgactcgaaaaaatgtagtaagattctccaaggtttactaagagcaagtttaataatataaccaactactcatttcaaaaattgaaacatcatttataaccaatctagtagtctacttatacattgtatctaatccactcacatattggagcacgtgctgcaattaactactccctctgtcccaatatattacaacttagatggatctgactacgaatctggacatatggtatgtctggtatgtccagattcggtatatctggtatgtccagattcgtagtcctaggatgggtaggttgtaatatattgggatggagggagtacaaatatgtagtctgctttttttctctctcctccacataaatagaaatatgacgtggcaagatgtacggactgtttacgtcaccctattataggtgtgatcaagaatttaagacatatcaacttaaacaaatactccctccatttcgaaatgtttgacaccgttaactttttagcacatgtttgaccgttcgtcttattcaaaaattttttatgaaatatgtaaaattatatgcctacataaaaatatatttaacaatgaatcaaatgataggaaaagaattaataattacttaaattttttaaataagacgagcggtcaaacatatgctaaaaagtcaacggcgtcaaacatttcgaaacggagggagtactataatactagtacatgaacagaggtcgcaatgccacgattgggttttcatctggaagaaccgggctccaccgaaagtgtaattcttcgcctgggtgctctcaaaagaacgactaccgactagcaaaatctgttgaagaaaaaggttgtccaatcggcaacatgcgacctctgcaatggagcgactgaaactgccttccatttctgcatacaatgctccttcgcggttgcattctggaactccttggaaatccacctgcacatcacctctatgcaggagcttcacaacctggacaggcccagccggatcccgaccaaacactacgaactcttctaccttctttgtttctgggggctgtggaatcatcggcatgacatcgtcttcaggaatcagaacccctccaccgctcggcttatatcaaaatgcctagaagatgtgaacctctgggtggaaaggctagaatcctggaaagaaattctttcctccttgctgcactccaatgtaacgaattaatcatatgtactgtttctctcttttaaagaaattcagattgggaagctttcccgcgtgaccggtctaaaaaaatatttattgataaatgatgataaaatataatcgagaaccaaacgcacctgcaatgcgatcaggtgttttagcttcagctcgcacaagcacatgcaagaaagccggatttcctactaaccggcacctttttgagggctccatctctcaaggccattaaagtgcctatgggctcaccggccaataacaaactgctgttatccatccaatccagtgtcccaaagcaacattcaagctagcccaacaaccaggcctccaagagtagcaagttgagcgtgcaatccccggcattctcgactataaatacccgaccagaaacacacccagcttcatcactccatctcgccttgtctcattccaagtatagctgcagcctgcacgtactgtactgaggacaatggcgagcaaacgcttcttgtccctgtccctgctcatcctcctcctcggcttctcctccagcttggcagccgggcaagtcctgtttcaggtaagaggtcgccatgagttgggttgcaggctgcagtgaactgatcgtgttttgttctgagcctgagagaatggtgctcttgtgtttgatgatgatgcagggcttcaactgggagtcgtggaaggagaatggcgggtggtacaacatgctgatgggcaaggtggacgacatcgccgccgccggcatcacccacgtctggctccctccgccgtctcaatctgtcgccgaacaaggtccggtgctctctcgagcaccttcgtcgtcgtcgtcgatccatattgccggcaaaatatatccaattggcttgattgctgatctgcaggctacatgccggggcggctgtacgatctggacgcttccaagtacggcaacgaggcgcagctcaagtcgctgatcgaggcgttccacggcaagggcgtccaggtgatcgccgacatcgtcatcaaccaccgcacggcggagcacaaggacggccgcggcatctactgcctcttcgagggcgggacgcccgactcccgcctcgactggggcccgcacatgatctgccgcggcgacccctacggcgacggcaccggcaacccggacaccggcgccgacttcggcgccgcgcctgacatcgaccacctcaacaagcgcgtccagcgcgagctcatcggctggctcgactggctcaagatggacatcggcttcgacgcgtggcgcctcgacttcgccaagggctactccgccgacgtggcaaagatctacatcgacgccaccgagccgagcttcgccgtggccgagatatggacgtcgctggcgtacggcggggacggcaagccggactatgaccagaacgcgcaccggcaggagctggtcaactgggtcgaccgcgtcggcggcgccaacagcaacgccacgacgttcgacttcaccaccaagggcatcctcaacgtcgccgtggagggcgagctatggcgcctccgcggcgaggacggcaaggcgcccggcatgatcgggtggtggccggctaaggcgacgaccttcatcgacaaccatgacaccggctcgacgcagcacatgtggccgttcccctccgacaaggtcatgcagggctacgcctacatcctcacccaccccggcaacccatgcatcgtgagtagctaactcgatctctagcaaatattctgaatcatcctgcaaattgatcgatgaactgatgataaattctgcaaaattctttcagttctacgaccatttcttcgactggggccacaaggaggagatcgagcgcctggtatcgatcagaaaccggcaggggatccacccggcgagcgagctgcgtatcatggaggctgacagcgatctctacctcgccgagatcgacggaaaggtcatcacgaaggtcggaccaagatacgacgtcgagcacctcatccccgaaggcttccaggtcgtcgcgcacggtgacggctacgcagtctgggagaaaatctgagcggtggagaggcacaattagcagattttatttacctgcaattttttccaccctcgacgtataacatatacatgtgatggcaacgagttgtatgctgtatctgatctgaactatgtacgcgattgtccacaaagtactacctccgtaaataaagtgaggatatggaacatgcgtttgcatgcatggttttacaaataatggtatgcaataaaattttcactgcttatgcatttttgcttggtttgttttactaataatggaatattttattttactcatgttttgtatggcaacgttgttttagcacactactacaaaaatcatctttcgtggcggccattttggattttcgctggcggaaatcgcagccgccacaaactaaaggccagtgaagatcacgatcttcactagcggttttcgaccgccagcgataattcatttttgctggtggtcgtcttaagccaaccgccagcaaagatccattttcgccggcggctggcttaagacgaccgccagcgaaaatgaattatcgctggcgggttacagtgtgccagccgccagtgttaatcctggccaaatttttttaaaaaaaacgacggagcagagcaaccgctccgtccgtcctccgtcaacgctccaccattcaaaaatttcataaaaatttatcaagcattcaaaaatccacaaaaaaatacatgaacaatttacaatcaacaatttccattcactcaagcattcaaacatcacaaaaatcaacagattaacaaaaatttgaagtccgccaccgagccccgtcgggctccaccgcctccgccttaacgacgccgttagtgagccctgccggcctccaccgctgtagagcagcgccgcaacctccaccgcggcccgcgcgcagatctgagagagggagagggggtggtggcggcgggggaatgggagaagggaggaagacctggatccaccgcctcgattcgccaccgtgccgccgacgcgagccgcctgcccaccgccgcctcgacctgcgtgcccgcgcgccgccgcctgctggatggagtcgcctcgggcctcctcgcctccgctgctgagctccgccgcagctgagccccgccgctccccgcgcgcactaccaccaggtccgccatgtgcgccgacgccttctggatggagttgcctcggacctcctcgccaccgctgccgaggtctgccgcagtcgagccccgcccctcccggcactggatccgccgcgtgcgccgcgtgcacccggccaccgctctctctacagcgaccctctctgcagcgaagggataaggaagaatgagtggtgaggagtgaagggataaggatagggtggggagagattttttttatagctcgagtaatttttttgctggggctatgtggtgaacccttttcagaagcggttgtatgagtggactgcttgtaaaaaagaccaacgccggtgaatatctgccatttttgctggcggtgtattaagtgcgccgccagcaaaaactgtaatatctttgatggtggcccgcttaaatcaaccgccagcgaagatcagttttcgctggcggttcgaaacttcctaccccttgttatattttttgtggcggttttcataaatattcgccatgaaaaatgatagggtgacgctgtgaaaaattaattttgtagtagtggcaatgctagattgtcagctcacatttcccaattaatagtcacagaatttagaaaatgaattagaaggtagaaacttcaatagttacagaattcagaaaattagaagataggaactaggaaaactagtcttttttttcttccaagggttcaaaccaatgaacaactcataaactgcttatcaaaatctccagctcaccaaacataacccataccaatggaggtattagacaatcctcgagaaagtacctctatgcatctaaagtttataataaaatttttggtatcttaatatacttagcacctagaattaccaaattttatactagaaaatatggtaccttcagatattttcgattcttaaggatagtaatattacacataccaatatgatagtgcaagcaaaggctaaaaaaaactatataaatgatttatttaaaattacataaaaaaatcaaaagattaagaaatgagtaaatttcaaaaagccacaggtattattgttcgagttgcacaaaatcaccggagtttcggcatgtgttaagtaatcatcgatattgtggttctaaggttttacaaaaccacaatgtttaccaatctagtttagtactgctgcaatatgaaaaataatgaacttaaagtactacaatattcaaatgatgaattaaaaagaactcatatattcgatcattgtttggaactcatatgtatggtagacaaagaaaattttgtttacggtgtgaaactataaggtcataatacacatagttatgtgaaaaagaccaaaaccctgtagttttatgcaatttactctagatcataatacctatggttttgtgaaatttactcttcttatagtatatatgagagcttgtaacaaatacatgtctataaacaatctcaaatgagaaaacttttaattacaaagttgaagttctcatcgaggattgtaacattcacacgaaatttgcattcatctgacttcatatgtaaaagtttgaaaaaaaattaaatctgaggtttttccatttttagaggttgatagctagaaaaaaaaccgcatgcacactaatcgatgccatttttaagaagtctacttgtgaaaaactattttccttattctttgaaaatgactaaaatttaaaaatatttaaaaatttatagaaaatatcatattatgtgtgcagatacttcaaactataaaagacgtgcgatctagcaagtacaatatctccacacatgatatataggtttaatagtgttcttgtccctgttttcaactgcaaatgtaatcacacccctattttttttaactttgtgattatacccttatttttttaactgaagcttgtgtttgccccaatcccatcaagtcctattaaatacatgtatgccatttgcatatttgcctctacttttttttagaacttttagattgtgcctatattttgacatgattttcaaattttcaatactaaaacataaggtcaaactaaaacttgacatgaagtttgaccctttttctacatgcatttaataccgttaagagggcttaatggaatgggggcatacacaaacttcagttcaaaaagtaagggtaaaatcaagggataaaatcatacttgaagtcgaaaatatgggtaagaacacaatagcccaaaatatacatacatggttggaaaaaccggcaaatcttctcaatcttttgaattttttatgaattataaaaataaatcataaatcatttttaactattccttttgaagcttttggctacgcatcaaattttcgtagaagaacaatactgccactcgagaagtaaaaagaacagtaacaataattcaccagtacaatcgaaccaagcaaaaatgcataagcattaagcagtgcaaattttattgcatagcattattcgtaaaaccatacaaatgtatgtccctgatcctcactttatttacggaggaagtacttcgtggacaattgcatccgtaattcggatcggatacagctcgttgccggcacgtatatacgtataccggtcagggtaaaaatcgcaggttaaatctgctaaactgagagtctcgtcatcgtgcgctcagattttctcccagattgcgtagccatcaccgtgcgcgacgacctggaagccttcggggatgaggtgttcgacgtcgtatcttggtccaatctttgtgatcaccttgccatcgatctccgcgaggtagagatcgctgtcagcttccatgatgcgcagctcgctcgccgggtggatcccctgccggtttctgattgacaccaggcgctcgatctcctccttgagaccccaatcgaagaaatggtcgtagaactgaacaattttacagaatttatcatcagttcatcgatcagtttgcaggatgattcagaatttctgatcgagttggctactcacgatgcatgggttgccggggtgggtgaggatgtatgcgtagccctgcatgaccttgtcggaggggaacggccacaggtgctgcgtcgagccggtgtcgtggttgtcgacgaaggtcgtcgccttggccggccaccacccgatcatgccgggcgccttgccgtcctcgccgcggaggcgccacagctcgccctccacggcgacgttgaggatgcccttggtggtgaagtcgaacgccgtggcgttgctgttggcgccgccgacacgatcgacccagttgaccagctcctgccggtgcgcgttctggtcgtagttcggcttgccgtccccgccgttcgccatggacgtccatatctcggccacggcgaagctcggctcggtggcgtcgatgtagatctttgccatgtcggcggagtagcccttggcgaagtcgaggcgccacgcgtcgaagccgatgtccatcttgagccagtcgagccagccaatgagctcccgctggacgcgcttgttgaggtggtcgatgtccggcgcggcggcgaagtcggcgccggtgtccgggttgccggtgccatcgccgtaggggtcgtcgcggcagatcatgtgcgggccccagtcgaggcgggagtcgggcgtcccgccctcgaagaggcagtagatgccgcggccgtccttgtgctccgccgtgcggtggttgatgacgatgtcggcgatcacctggacgcccttgccatggaacgcctcgatcagcgacttgagctgcgcctcgttgccgtacttagacgcgtccagatcgtacagccgcccaggcatgtagcctgcagaagcattcaagcaattcaacgacctgtgcatgtattttgccggcaatggtgcgacgacggaggggatcgagagagcagagcaccgcaccttgctcgccgacagagtgagacggcggagggagccagacgtgggtgatgccggctgcggcgatgtcgtccaccttgcccatcaggaagttgtaccacccgccattctccttccacgactcccagttgaatccctgcatcatcatcaaacacaagagcatcactgcatcattctcttaggctcagtacaaaacccgatcagttcactgaagcctgaaacccaactcatggcgatctcttacctgaaacaggacttgcccggctgtcaagttggaggagaggccaaggaggacgatgaggaccgaaagggacaagaagtgtttgttcaccatggtgttcagcacctgcatgctgcagacacacttcggagatggatgattgatgaagctcctgggtgtgtctggtcaggtatttatagtcgagaattgccggggattttgccatgctcaacttgcaacttttggaggcctggctgggcttgaatgttgctttgggacactggattggatggataacagccggagtttgttattggctggtgagcccataggcaatttaatggccttgagactttgagagttggagcactcaaaaggcgcaggtcagtaggaattccatctgtcttgcttgtgcttgtgcgagctgaacatgaatacctgatcgcacacagagcatttgagagcagaggaaaagaatcgattgagaatgtacgcaaaacgagctgagccattaacgtataattaattgagtattaactattttaaattttaaaaatagattaatataatttttaagtaactttcctatagaaaatttttgcaaaaaatcataccgtttagtagttcaggaattgaacggtgcgcgtgtaaaacgagagaaatcttctctcttacacttgctgctgaattggtacatgttgcgagttgtggcgaatatgtattttttttcacctaggtgcaaccgcacccatcatttacatacaacttaaatgtacataaaaaaatgtagggcttgtttggtttaatacttaccaaaatgttggtagtgacaaaacctaggcaagttttggcactacaaattttttggtagagtagagttgtatttggttggaggccaatttagaaccaagcttttagcataatatagaaaatatcaaattggacattggcaatgccaatgatttggcttcaaaccaaacccgtcttatgcactgttcaaactatcaaaatatttgtagagcacgttttggcactaaatccaaaacggcccataattgtactatttttgagaaggtacctaaaggtgccacaattttctagtaaaatttggtacctctaggtactttatacctcaaggtaccaacaattttagtgtaaaatttagatacttcaaggtattttctcaagaactataaaattcctctataaaaaaatagtttgaaaataattggtagcatcaatcacaatggcataagtctatacacaaacatacacaaccatgcaaggctgaaacagatatataatcagataaataaaaaataaaaaaacaatattgtgaacagtacatctccagcacaaatagaatatgtgtatttctgtttctttactggaaaataaatttttgatgtgcatgtttgcatagtggtttatatcttctttatctatcttaacattttttttatgaaatatttacatactccctccgtcctaaaatat

SEQ ID NO: 75647 - DNA, 86082 bp, Oryza sativa
accctaacgacgatggtatttttgggacaaaatcatttgtacgatggcatttcttggaaatcacacttgtcgatgatatttctgggacttagacgcttgtcaatggcattttatggattatctattatatttatggatgaaaagagtagtgtgatgaagaaggatgagagtgaatccgaatcttccgccattcatcaaaccatgtggtcaaactggtggccaacgccttccttcccatacgctgaactgctacatatggcactactctgctcgtgttgccgcatgcacatgtagcgtcgctgcctgtatgtgcttgtcgatcgctcacctagtccagataaccaacaggagatagatggcgagagatgtggctacttaaaaggccttgtttggttaatgagccacagaaattattttccacatattcaaagacacctttaaaattctaaccattcgctctctctcttctatttaatattaatccttgatttttcttttcaggaatacgcaaaaggattgtgcacctttgtgttaagactttaagagaaataaaatttacgcaaacggcaaaacaaagaaatgaagagggatttgggaagaaaaggaggaaaaggaggaaaaagaggacttaagcctattctcgcgattacaatgggacgaccaaacgacctagcacgctaagaaggtagcgttggcgacaggggatgggcgagatgccaaagggcagcctcttgcgccatgcctactaccacctcggaccagggccaagaacagttgttgaacacgcggttgttccgttccttccaaatggaccacgccccaagggtcacgaccgtgtcgaatccacaacgatgctccctcggaactttgagtcggcgggagcagtgccactcgtggaaggaaacatcgctagagaggaagcaatgtgggagcccgaggctcgagaggacggtccaccacagctgtagggacttggggcacctaattagaatgtgatcaattggctcatcctgttggtcacagaagacacaacaggtaggatgcggcaagccacgtttctccaagcggtcagccatccagcagtggcgatgagcaaccaaccatagaaagtagcgatatcgaggaggggcgaaagaacgccagataggtagatgccgggatggaatccttcctcagaagaggacaagataggccgagtgggtggaatacgaccccaagtctcatctcattcatttttcaattccaatcctatctctcatttttctattatctaaacatactgtaggggtgatttgtacttcctccgtttaatattataagactttctaacattaccaacatttatatatatgttaatgaatctagacatatatgtgtgactagattcattaacatctatattaatatgagaaatgctagaaagtcttataacctgaaacggggtagtagatattatagatacttcaatttgttttttaatggatatagctaaaggaagaggtgtgggcattaccaatgttcggtaacaacctactagtaaatacatctatatatttattaattttacaaaaaaaattatggttaaaatgatcctacgtcttacgtttttttaaaccaaacggttaaaatcttgtttgcaagaattttcgaagaaaatttagtaaagcacccctgctcttttagaaactaagctcagcgcaaaattgctcagaaatataaattcctctctttctctcttcaaattcctctctttctctcttccacaagctgtgcgacggcgtggtggcgagaatgcgaggcgccgcccacctcgcgcgttccgccgacgagcgcgtggacggcctccccgcgccctagccttctcccctgtgcggccgcggcggcctggccttaccctcctcgcgcgaacggcggcaggtgagcaggttctggagggtgccacgcggccggacgacctccttcctttcccttcccttttgcccgcctgaatccctcacgtttcgaatcgaatagaaatatagaatagcagctcgtgttctttctccccgcaaaataaaataaaatagaataaattattttgtggggttcggccgctgaatgatccccattccccgtgttaggtcctttactgttgattggatggatgccttcttgccatgataaatcgcgtctcgtttatgtcatatatgtggcctgttttcattttgttgttaatgaaatttggaatgccgcttcaggaaaattagtaagattagtgttaatgctattgtgttatccctgtcagccagtaagcaaaatctagaatggtatgatgttcttgaaggtagtaacttttttttttcttttcaaagaatgttcttgaaggttacttgatcttactatgcagagaaatatagtagtaccgtgttcttgattacagatggtgtgtctttgcttcaaatttgtaaatattctagttttgtttggacctgagactgtagttgagctgattctgcctatgcccatttctgaaagaagctatctggagtaatctgttcgttagtataaaagcagcatgggttgcatttttctgtgtgaagctgtctatggttagtgcaatagcataactggttgccttttttgttttcgtgaaggatgagttgattcttcttatgtcatttttgtgtcaagtttgtatggttactataaaagcacaattggtttccatttttgttttcgtggagaaggatgagttgattcttcttatgtcatttgtgcgtgatgctgtccatggttagtacaagggcatcattggctgaatggctgtcatttttcttcccaggtgaaaggatttgcgtccacctgcaaaggcagcaactggagataccgagaaatgggaggggcacttaacaagttcacaagcactctggaaactgctgcgttatcactactctgggaaccgtatgatattcatgattaacctctgcggcaaatggatttgaagcattttccacgcaggtcagcaaactgaatttcgaccatcgcactattcattttattgaagaattgaaagttgttgggcacttagactaactaagtgaagtgcttaattgctgattatcgggtgtgtgaatctgcagcaacgagttgaattgattaaattcataaaagataaaggctgcaattgatcattgtaattaagatcttgtgtgcatcttgtctcctttaataattcactaggtgaggtctctaccttttcagagataacataagatatgacatattgcacatgttctaccattggcccatagataaccatatcgtatggcatactacaacttcaaaaccctttttcacaacactaaagtagggaatagggtagagaagaaatatgttatagctacacatttgatttcctgaatggaggaccatggtgaaacaacacaacaacagaaatggataaacattgcaaaaaggagacctgtttgtgctcataaactagtatctcatgctatacgcacatgaaaacaggagtgaagaacacagcacccaccctgacgtggaaacatgcttttttgacttaggatggaagacatttagtacatcaataaaaggcactttgctatagcaatattagactgtctggattgattctatttatctacaaggatgatcttaccaatgtcacgtaccaattgttactgctaattttctatgctgttggaaaggaaaacaaggttcatgtaggcatcgtatagtgactatatttaagtctctgttaaactgtaagcaattcaacatagtactatttgcttatcaaattagtggactgtgctagtttttctaatgtcacccaagcacagtagcaacgattttggtctactttgtagatttatatcaccaaaggaattgaaaattcagaatttggggatccaaaacccagactcttgaaatgtgaacaggtgcatatgtcatgactttatggagccaaggacccatatgcatttcttgtggttatccatgctcagaagaatatatcagtcagagaaacattaagacaaagtaagacagaagagtcagttaattttgtttaacgtggcttcaaagttcaaaaatattgtggtattcctacttcaactgctctgcattagtggtgttctgcagcttgtttctatagcatgtaaggtggatacctgctgctagttatcaagaagcagcctatgtttgaacagttctcctagtgcatgcacaacttcaaatcaacccctaagattacttatttgagaataccaggatctaacttcactaaagaggcatcaactttacatatagtgcagcatgaggaatccgatttcaggaagccttagtaacatatgttcgacattagggataaatacacatatattcttcaagagcaccactgctcgacagtgctaacattctatccttcaaatgctgtaaacaggaaggaaacagcctcagccttgtagcttaaatcccaatgatttgatggcagcggtcttcacagtaggtatcttggtgaaacagtgctctctggtctccaatagtctattcataaaacagtgctggcttgaaattgacacatctgctctctctctctctctctctctctctctctctctccactttcttcaggttattggtaaaacaattagcatgttgtatgaaccaaccttgcaatgatgaggtttgtcttgaggaatagcagcagtactgcaagtaattcaatatagacaagcatgcaatagccatatttccagctcaaactttatggatgtatataattatatagattggtgtgctccagcattttgtcatcagcttctgggcatcctcttgctctaaacactaaagatgatcatgtgccttgtttatgttctttgtccaaaaaggcatgtacgcgaactgtcaactacaatatattttattattttacctgtcaacagtctaggaatatgcgtttctgtagaatatgcattggaccttgatcttcctatattatttcatatctcctatgtagcaaaataaatgattttagactatggcaaataaattccaaaattacctttgatatttggaaattatgtgttgttatcctatcttttgctaactacaaaggtacaagtaaaatgagctcacaaagtgccaattttagtgttgctgtgctctggaatataattatctaagagaatctttaccagttctagtagtattttttttggtggctccagataagtggttattaattatttaacatttttataactagtaaaattgcagattaaatactatcgcaatgccaaattaaacctaattttactgtgtaaaaacacttgcagatgtatagttcttcatttcctcaaaacatcaaatgatgcatagaaggatatggacataattggttggtctattaggtgatataagcgattttgatctagggcaaatttttttcccatagataatttcctaaggtgttgatatgattatatgaatatggctaaaactagggcacgatgcatgacatacagtttcccttctattttcctaacaaatatgaacaataatatgactataaccgagatcattacaaagtgttacaatgagcatagtgcataattgatattagcgtgaagtgatttgatattatctctttcctgtgtttcaaatacagtaattacaatataattacaaactagcaagagttcatgttgcatgtttacttgctgtaaaatcttagtaatgtgaagcacacatgtacttcactacgtaacgatggaaaatagtggtaagaaatcccaatgtgtagtatatttgtattctgatcagtgtgtaagttggttgccctgttgaatgtatatggagtaagtactactttcctgttgaaattccttcatccaaattcattctaataatggtctagtggctctaaatcactgagtaatggatttgcgagatccaaaatctccaaaattttcaaggaagaatctgtctctcttagcttgctccactgccataagcagatgtgctgcaaaaaatcccatctttataaatgctctttggtcacttttttttatgttgttcttcttaactgaattgtatggtgcaggatccagtcctgtaaatataaacatgaaatatcatcccacacaaattcttactttccatggaaacactttgcttagtctgtagtttctgatagctgttgtttctccttatttgtttcattatttatgttactagcaatatgcatttaggaatatgcataagaaggaacatgcaaaaaagctgaaacagtgcaaccattcttgcaactatgagaatagtgaggtgatgattttgccacctcactttgttatcagatttgtgctctgtggctattatttgttttgcatcttgttgtcatgattcgccaagataagaactttactgacactaaccatttaaacaagtatctatcatttttttttgagaaagtacaattggatgcacacacccacacacgccacactaacaccaccagacgtgtgcatttcctctgcacacgcttcacacgccacctagagcgcaggcccacgcatgctcactaaaagcacaagtgcgtgtgtacttctgacattagtgggtaccaacgtcaaatttaggatttgaaccttggtggcctaggtgcacagcttcaccacctagccatttagccatatgcaagcttccagtatgtcattttaatatactgttccaggttaggattctcttatcactatccagctgagataccaataagtcattatctttgctccaattatacattttattcctcttttcagcatctactgaaagtagtggatgggaccagctaataaaatatacaactataactgaaaaaccacgggaagtagctactagaaagatttatccatccttttctgcatgaagtggaataaaggtagaatttcctgcccaccatgcatcttcctttttatcatccagttttcatttggtttcagtgtgaaagcatagggatgccactgtttctcttctttctttttagtaggatgcctccttcggccatttgatggttatgtcttatttccaatctttgctgttagctttttttctgacaatctttcaggatatgtgagatgtggcgaaaaggagcagatagtagagctcctttggttcatcagatgatagatctgcctgagcggtccaggccttgtggtcttgcatgttagatacccctagatgtttttatccatctgattgtctttgagaaatttattggtctgatttagctagaggaagggcacagctctaactgattgaacagtggtgttgctaataatagatattacacatatgaatttgattattgaaaatacatacattgttgttggtagatgtacttttatttaatttacttaccattgttctgagttcgtaacttcctgttgttcctatatttttgtgaagtggctttttaacagttggcttattggctagtgactttgtaagtcactttcattacctctctcttttctttgaacgaaccagcagagtgctaattcatacattcaaaaaaaaaggagaatgaaagtgacttacgaaatcactagccaactcactttcattctcaaatacatagaaaataaatgattctccagtcgttatctgattctgttatgtgttttgtgcacaaggttgtggccaagggctgctacacccttgtttttgttttgtcaagtatccgtttctgttcaaccagtgcaagtccaagcataacaccggaatgacatagctgtaaactcgttgaaaatggaaaattattatactgcaaggaagttcaactatgttagttgtgatagttggtgaccctgagtggacaagtactggctgattgtataattttttgttcccctgagaaatggaattccggggtacccattgtaaggaagaaaaaaaaggttcatttgtatttgggattactctgtcctggcgcagtgttatcctatgaaaaacaaatatcattgttgggcgaacaatttttgggtgcttgttcatatttcatgtccatggtaattttcattatttattttacaggatgttagtcctatcatctttgattttttttcatggttgattgtataaatcctaattgaaatatgccaattttgtcatctgcatagcatgcaacctcaattttgttcaatgaaatcaactgagttgtacggaggcagagtttggtggaaggttgccaatggtttgtactctgattatctatataattcaggaaataggataattactttctgttaaatactcaatgcagaatttcaacggttgatgtcattctagggaggcatgaaaatctctcccgaaactcatgtttagtataagatatcttgtaaagtttaaatttgctagatttagtgaatctgtcctccttaaaacattaagtggtcatcagtcactaacgaactttgtcggcttgcgttgtgtgacattcagataggctgtttcccaactctgttacagttacttgcacacactctggagtatttgaattgtagaaataacttctttgtctataaataatgtaatttcataaaatatatattagcaatataatactgttaaaatatttatttattacatctatacagttgcttcttcgggaacaaaccttgttctaggtgctactgttctacaaacctctgctgtgcagtgtcacaaatattcttaaatatctcttgctgtctaggatataaaccacagaaaccaaatgaaatacagagctcagcaacttgtagcattggtactcgagttattgttcaacagtttcatgaaagaaaagtactctgtccttttgttatgctttattcacaggagggcattatcaatgtagaataaaggttttgcatgttataagaaaaatccttttttcctctatatatacaccccccctcttgtgcatggctcattgtgtctcagctctctccacctgcttgaactgatctctaaagcttagccatatatggagtattcaaatttgcgtcgccaaatcatctttatgaagaaaaatcttttcgatcaggtttcatgccttcacttttgttcctttgagaaatgagatcgtaattaattagtgtattgcactagacactagttgatgttttattgcttctcagttcctgagctgcaatattagatgagatagttaactaggagagagagttagtttcttcagtttttgtcttacatgtaagtatataacaaagtttgattgcacccttggacatcccctgagggcacactgaacccctggagaaaagcattatcaatcaatggtcagatatgtggtcatgtggagcttatatcattcatgcactctgtttcaattgtgaatttcatttgcaacagcataactcagttttgtagtgtagtctactagtctgggatgatgcaataatgctcacttagcagttggcacccatcttatcttatctaaaagttatacaactttcttttacatcacatatgcatgcattatgataatgagtttaagcagatcgtcaaggatgtaatatgccatagacaatagcaaaccactttcttaatttcctttgtactattccattgagaatatacaaaaagtcaggtctttcaacctttagagagtaatcatagagtagcatcaatttgatgatacattagtatctcctaggcaaatactagatttcctttatacttaactagggtgaagcctactccctccatcccataaaaaaccaacctagtaccggatgcgacacatcctagtactacgaatctagacatatatacgtccagattcatagtactagaaaatatcacatccggttctagattcgttttttatgggacgaagggagtaagtcacttgctggaacctgactttttttttaatctttgactaattatatagatttacccttgtaaattagtacacttatttgtattatatggactgcacaaaagttttttttttggttgtgtatttcatgcttctttcttttgcctataatctacctcgtggttttcctgcagggttaccttgatgaacagtttaatcagctggaagaactgcaggatgaatcaagccccaattttgttgaggaagttgcggctctgttcttcaaagattcatcaagactgttgacaaatatagaacaagcaatgtaagtaatatgtctgcatccacgatatgaatagataattgattttttgtacaatgattacccatgatttgaaagacatgacaattacatttacttccatttcttttgatgcagtgataaataccctcaggatttctacagattagattctcttgtgcaacaactcaaaggcagcggatccaggtataaaactggggcatatgcccagaacacagagtgaacaatattcttttacaggtctcatcagtgtaaaatcatgtcttaggtcttaaataaccaatataaaaacattcaaacttaagaatgcttattgatgtgaaatgaacaaatattatttgttaatatgaatgttctcaccgaaagcttgtcatctttgcctgctttatgtgttcaaaattcgctaaagttggcctgtgtttggcgcagcattggtgcactgaggatgaagaatgagtgctctgtgttcaaagtaaactgcaatgacaggaatctggaagggtatgcatttcattgactcgtccaacttgttcttcacatactatccaatcatcatgcaatttcctcacatgatgtgatgaggccatgttctctttcagatgccgcaggtctcttcagaagatgaagagggagcatgccactctgaagcagaagctggaatcatattttcaggtatgttgtactacatccttgtctctctctctttctgtttaccttattttcagcattgctacatggctaaacaacttggttatctcctgttccttctgctgatgcagttactgaggcaagttggtccccgtgattatgcagtgagctcaaggaagtaagaagaacagtatgagttccaaggaaaataaagaacatatacatagcagctatcagtctcttgaaaattctgtcgctgaaaagtttttgtgccaatcagatactcataatgcttaatggtgcctttttgttgtgtttggattgcatctgtagctccataatccatatatactgtatgaagttatgtaaagccctgcttatgcacactctccttgcctgtctacaaagtgccatgaacttgtgttattagtcagtaattgtagcagaaagtgtcatggtactaatatgagcttttaatgtttgaaactagtaatatgtaaactagttttttgggttaattaattgcccaggtgccatcatggaaaactatttgtttgtactttgtatactcaacaaacgctatagtcacattcccagaaccaaagacacttaaaaacactggtttttcatctcttccactaatattcataacagtgtttgagctttaaccatcaatatcattttgaacgtttcgatttctaaaatcttaaaaacgttatggctagatttgtcttcagaagtcctaaaaatatcataactttgctatattcttcataagttttatactagtagtaataatttaatcataaaaaaatgattatctatagaaaaagaaatgagaggacaaaaaaaaaagaaagagaaacatcagaattgcagagggccaagccaatcatgggcttggtccataggcccaagagacaaagcccaatccatgggcctgggcttccctttccctccgttttatctactccgatgcacgcacagcttatccgattccatccattcctcaagctctcactcctctctcgcttccatggcgctcctcgccgtccacgccatggccgcgtccccggccaccttcccctcctcccaccaccacgccgccgtctcctcctactgcgcgctccccgccgccgccgcattctcccgctcccgctctcgcgtcgccgccgccgccgccgccaccctctcggccccgctcactccagttcttgaaggtaactgacatgcctacctaacctccctgtctctgttttgttcgtcaattcggattagtctggtgtgaaattggctcgatgatcttatatgaaactgcttttcaaatcgtattgcacgaattcaattgatacagcaccaaaacatagattgaaacaaaaacctcgcagtttgaaccaattacgattccaactcaaattactccatttggtgtgaccagtttactgcgggagaggggacaagaagaccaagaggggaaaaaggttcaaccactcgtacggaaatgtgagtctctagcacaaaaataaaattaataaaaaaatcatatgcttattgcttcctgtgctgctgtttgctgcaattcttcagacttgccatctgctgactgctgtttgctcatctcaggcgaggccgcgcaacaagaagaagggaactggccctgcacggctgttcgcgccgcctgcgcctccgaggaaggaccagttcgacgacggcgaggtcaccccgatcgacatcgacgatgacatcctggaataggttgtctgaatttccccccttgaattatggtttaccttgagcttaccttttgtctagtctgtaccaaacactgtttcttgaaattaattacagtacattacatggtctcattctacataatgtagatgcctatgatttctttccttgtaatatatatgaatggtgctgcttagagtcattttttatgcattaccagctgaagcagaacataagtacagatacaatcaccaaactttcatgttcttgctagaaaccagggaagatgcagtatctcttttttttttcttttctagctgtgtccctgaattcaagcaccttttgacatgcttcgaatttgttgtgatgatctgggaagcagttcttaagaatcaactaataaaccagtccatcagatcgggtcagaaatctgccccttttttgttgttttgtctgttgactctgttatgcgcttgagttttgacacaagaaattgttttgatgatctgcaaaacatattcctttaaagctggacaacaaaccagttcaactggtcagcttggtggtaattgtatgttaaaattctgtcattttttgttgtttcgtctgcaagtttgttgtgagctgctccccccgcccacaagggtaagcaactatctcgcccgaaatatactacaattttggcccaaactggaagtgtaaaccctgctacgcaatggctttaagaaccctaaaccctgaagcatgttttgtttgctaccatttcaagccatcacaaattttggtaagataacgaaccaaatatgttcgagtatccctaccttaccaaaatttggtaacgtacgaaacaaacccgccatctgttcaaaaatttggtgaagtaacaaaccaaacattttcccacagtcctaacatttgataagttcacacctctacagcatataaaaaatagagggggataaatagagcagttgtcagttgtcacttttactcaacttctgttactgttatctctccgaacctagaggcaacatcacttgtcttccactggactgaaaccagggtccagtgtgatgccaacctgctgcaaggctgcaacctattacaacaactgaacctcatgaaacaagacattttgcttttcattttgatgcattttgatttgaagaataaggttttaccctgattctgttaatgaaaccatcatttggattacagagtttgcaaccaatgcactagatttttatattaagaaatactagggttcattctcatttttttcaatcaacaggacaacatccatagtggtaacttgacaagatgagacaaacaatgcacaaaacatatattcttgaaaaaggaaaaatagtaacaatacatactcgatgttgccgtgcaagtttctagtactacttatatgtaccttaagcaaacattgcatattaatggaaaacatgtctcagctattttcgcaatgcagaggtggttctgaataattctgatcctccatatacattttggcaatgcggtatcttttttgagacagcagttaaaatttcatcaatctagccaccaaaaaatgtctcctcaaatcaatactcagagaacttaaggaaaaagaacatgaagttttttggataagccagatgcacatctgcactacacaaaagttgagccctaaaaatctcatatttagaccacctcatgagcccaaagctccaaaagcttggggttccgagttgcaattcctactatgagttccgctcaaagcataagttataaaacccaaccaagaaattgtattatggtcagttgctgaattgttcagattgcgtacagcgtacattttggtgtaaaaaggtgctctgctacactgccttttgctaagttgctggagcatccaacagtatagattcacttaactgctctttgttgtgctcattccaacaaaatcatgaaaccatgggttatcgcaagtgcagcaaggcatcgtgtagtggagaaaaggaattcagtgtgatttggttttcacattgctatctatttgctagagttagtggaataattttaattgatgagcatgataccgaggaggatttattaatgctatatttttcagttacaaattggggatttttggcccacggcaatacttgagatctcaatatataatgggtgcaatacatgcatgatattaggactgatggatgataaggttagtcaatggtgttttctcatggacaaaagatgctcaggtttttttaggaattcaatcattgatggatgggatttagatagaacttcatcaattgccatgtaaatctgagcttatgctttggtggaatcaacttgagcagacatatgagttgatggatgggatttagatagaacttcatcaattgccatgtaaatctgagcttatgctttggtggaatcaacttgagcagacatatgagttattattgttaaggagggagaaactattaaaccttgatgtggtcaatttcggtttgaactatctttcagatcatctaattgagctaaggaaggtggtcaacaacagttatcagatggcagctgccctagacttaagtggtgccgaccctgcacggttgaatcaaggactaataagccgtatggtgtattagcaaaacaatgataatttgtgggtagcgattttaaagccaactagaaaggtagcccgcggattcgcgtgggcatgtatcgtgggctgcgttgagaacggatcatattaatcagatagcctctgccatctttcggaagtacgtttcctcgacaaatattcttcatcaacatcactttgataatttctctaagttatatactatataatatttaattcatcagtataaccaaatatctataatctttatcattatataaaaaatagtagacttagtttgtttagaacatgtttaacaaattaagtgcatattaaaatcaaggtggtttttattttcattagttttggggggttggtgaaaatgtaagacctagctaaactcattgttccttttcccctaccatacggttttctcacagctcctagtcattgtgtcctacaactgagatgtggtcgttgcacctatgaaggtttccttgtgattcatcgtgattcatcgtagtggtgatctcatttttgtcaagcttagttagtccactttccatgtttttggtatagcctaaaatctaaatggactccaaagttaatgcttcaagtgtatattcatagacgattaatgctcatatagttgattcaccttttgactggtctatgcacaaagaaaataaatagagttaccgggaaggtgtagaaagccacaaccacacgcttgaatatatatatatatatatatatacatatacatatatatatatatatatatatacatatacatatatatatatatatacatatacatacatacatacatacatatacatacatatacatacatacatacatacatacatatatatacatatacatacatacatacatacatatacatacatacatacatacatacatatacatatacatacatacatacatacatacatacatatacatatacatacatacatacatacatacatacatatacatatacatacatacatacatacatatatatacatatatgcatacatacatgtacatatacatacatatatgcatacatacatgtacatatgtacatacatatatgcatacatacatgtacatatgtacatacatatatgcatacatacatgtacatatacatatatacatatatgtatacatatatgtatatatatatatatatatatgtatatatatgtatatatatatatgtatatatgtgtatatatatatatgtatatatatatatatgtatatatgtgtatatgtatatatgtatatatgtatatgtatatatgtatatatgtatatatgtatatgtatatatgtatatatgtatatgtatatgtgtatatgtatatatgtatatatgtatatgtatatatatatgtatatatgtatatatgtatatgtatatatatatgtatatatgtatatgtatatgtatatatatatatatgtatatatgtatatatatatatatgtatatatgtatatatatatatatgtatatatatgtatatatatatatatatgtatatatatctatgatatactaaatttgcattaagaaccatctaatgttaatttgatggtaacatagtttagagcaaatacacgaaagatcatttagcttgctcgcattatttcagcacatttaaaaaattcacgaaataattggagtttgttttctctaactatgggcattggatttgctatgcattggtagcttggactattcatattttagttagttctatttacttatatagtgtctatctaatttagctatgcaagtttgcaaaaacaacatatgatgatgcaacatgtggtgttggattatttcataattcttttacggcaattccaatgacatgtaaaagggcaggggtgttcaccctaaaaaaatagttttatagttatactattgatttaatttagcttgtttgcagactggtgtataatgacgtaatatatgcaaccaatttgtttaaggtatttcaattttatttgtatgatgtacaaggcatgtgggttgaatatgggcgaatggcatactttgtatataagaaaatataagcatatggatcttaaattcttggtttaattataaatagagaaaaaatcagacgtgcatcttaaatattatggtttttctattatataaattattgattatatatttattgtttaatagctaaaaatagggaggggacaggtagtggtatgtgcatatgagtaggagaggaggtgcatgcgatttatttttctaacttttataaataatggaacttaaaactgatgatgatagctttcattttgttcagaatttataagattatttctgatttttaggacatgacacatggcgagtttagagcgtttgtagaatgtcacgtggtggcttgagaatgtttgtagtatgtttaatgggcttttagtatataatagatagattggttcaatttgtattttatggagatttttctattttctattttattttgtacaaatgtaacactataaaaacttatatagacatgtgataaatagtgatagtgttacaccttatgtgtcattttttagaaataaatccaataatcttttatcttcaagcagtaagattgatatagactatcattgtttattaacagataaattatatgggatataaggctacggatagattgagataggtccaattaatggatttaccgttttgagttatctatatttaaacataaatataatcttcgtgaaccaaaatgatatatttcttctactacttattatttaaatcttattaattaattctctgtgtttcatgttgttctaatataagctacgtgctattaatcaagtgttttaaactctatatgatttccctaaaaaatgtgtctcgagtgtccaatagctagtccaaagtaacatatttctttgacttgttaaatatagttaatttgggtcttgaattatgcaacaaacgtacgtgcagtgcataaaaaatatatgattttagatcgtatagtcatataatatgttttcactctaccacatcatcaaaataggagagataggaacagaagggtcatcaaaaataagagagagagaggaacagaaaggaaggaggggccaatacatctacgtacgtacgtacggtagcatggcgtgcgtactacacgtacaggtcggaaggagaggaacgtgggcctttcaatttttttattttttatggtaaaaaataataggtccaccatatttaaagaaaaaaaaatctaatttattagagtgccatatggcagcttaggagtgtttgtaggaatttttttgtgacggcttgaaagcgtttgtaggatgtttaatggacttttagtatataatagatgttgaaaataaacttagatgatttttttttcaaaattaacttttaaaatccaaattttaggcaaaccacgagggcctccatcgctagctcctctccctccccctggaaagctatcactgtacaggggaagagcaggacatactagtaaggtggatactcaaatatacaaatggtcttaactaatctaggctataaagattgtaaaatacataactttgcacacataaataacttgtcaaagagctgtatgtttgtagctggagtgaagtatgcatagagcaatacatgaacaatacactgaataagtacaagccaaccccaaatgaatagtttgagggctgggattaaaggttagtacactacactactatatactgtattgtacattttacacagaataaagcatgtgtgctttattccagtagcatcttctataagtaatctcccatcaagaactggagaaatatatacatccaggaagatgggcctactgcactctgcagcagattgttcctatgctatttgtttatcagtggtccttccttgatgacctagaacctggtctagatgtcttcagtgcctctgcaaatttgtgaatcttcttggcatcttcaggaaccgtggcttcaccattgccaaggtgagaactatgcccaaaattactcactctcccctccccaaaagacacactcttgaccccaagatggaggtttcttgcatctgcgatttccttgctgagatgtcgagcactttggctgtccatagaatgccaacgggagccgtgattatcatgctgttgattgccagaattaccaggttctgtcatgaatgaagaatagctatcaattgactctcttccattgaactcgtcaaatgaacagctcgaaatcgatatcctcctctccagagtaggaatggttttgttctccttttcttttcccagtaccaatttccgaagcttcgaaaagaactttttcttcttagggttcttgtgcttgttcatcagtgagacatcgatcgacgcgtcgtcgggttcgcctaatgatgatgctcttgaggaagagtactctgaacagaactctatatgatcaaagtttttctcatccggaccagcatttgcgtactccattatcagttgcttggccttctcttcagattgggggcttagtgtcttgctaagatcccttgcaacatttttccctgatggagcatcctggttcctgagctcgtaacgcaggcaagcgttgatccatttcagatataccaattcctcaacatctgaaaacctgtcagtcttgagctgttcaacctcttttgccagcttgtcattttcttgcctcaaatgatcagcttcctgcaatgcttttacctgcaaccaattttacttgttcagttcctgacagagcaacacaagctgaagtaaacactgaaaaatgagtttgaaaaatcagtagcgcttatgagaaacaattgattgctctttcaaaccaaatatcaagaacagcgtttccttctgacgagtaacaacctctatctgaagattaagattgattagtaagtgccagctacaatacagttcaagaacagtaaatattcacctccatgttattgatgggcttgggtacagggggcaggcgtgtgagctccaatcgcctggcaagatgtgcattctcctgctgcagccttgaattgacaaccctaagctctcttgcctcattttccaactcctctagcttactcaatttttcctcaacctcagcactgaatttcccctcagtaataatctccttacactgccaagaatcggccatttcctgaagtgaggcaattctctcctttgcttgttctgcatcctgtctcagcttcttcttcaacagcttgcatttcattctagctgcctcaagctctgaagccagctttgagctttcagttaactgagcctgcagcctctcattttcagactgcaaggattcgatcttcagcgtgtatagcttcgattcgacggtgttgatcttcagctgattctcgagctcccgcaccgcgacatcttgctcctgcaaaccatagctctctagaagctgtagctccagggtcttctccctttcttgaagtgatctgaccatttctctaagctcaaaaatttccggggtcttcgttgcatcttcttcgcttacccttggtgcaggtgaggttgcaatgttgcccatgtctcggccgaattctttgagaactatttcgttgaattctgggaggaggaattcttcatcatcatcaagagttctacattttgggggcagtggtactaacgcggtggtggtcatcgttgtagtggtagtggtagtgtggacagagtttccattgatgattttggccttggtatcctccttcacaatcaaaacaaaagagggtcaacataaggagaagaaaaatggaatacaatggtaacatttgaggacaagttgtattttgtcaaactgctggaatagaaacaagcagtatgagactaaaaaaatagagaagaaaaaaggttgaaattaaaaaacaaaagcaaagtccacaccccaaatgcatgtgatatggacagacttagagaatttataatataatgaggaaaatatagctggattatgaacagttcaagaccatacatccaaaactgaaccattctaaatataaatggaagtatgaaaagtacattaatatatacaatttataataattatgtgcaaacaagattcttacattcttgaggatcctcagctcatccttgagccctccaccacccttcattccatccgaatctgcaaaaaaacatcaagaaacgattcatcaccaaaattttctaactaggagtagcaatcagcaacaaacaacgggttcacaattccggaacgaaattcccaaaaattcagattgaccggtgggtccgaatgttcctccggcccaaaacgaatcaaatttatttgaaattgagccaaaatattgttcatattccaatttttcgttgaaatttcattttgttttccatctgaaaatctggaatttcttcccgaaatgaaaaaaaaacgttgaacaagacgcctctgctgttgatacctgagcgaggaggaggaggaggtaaccggagttgctgccgtggccgccgccgcgagaggagcagcccggcgacggagagcgcgacggcggcgccgaccctgaggaaaacaacgcgcaagtcctcgctcctccggccaccgccgccgccatctccggccaccttgggcatctccctcttcacctcacctcaccaccaccttcttcccaagaatccaccacatgcagactgcagcaaccaaccagcaatggaaggaacacaaataatctctcctaccttgatcaccaaaaaaaaaagataataaaaaaaatccaaacatttgagcaagaaattgagactttctttttgactgcaagaagattatggccaagaacctgaacctgttcttggaggggctgaaacttgcatcaagaaatacgagctcgctccagccccatgaagcttgcaggctatatctccatggcttcgaatcgaccagaccggggaggagattaacccagcctagccaacaaagtctctgaatttggttttgggatttgtactgcctgagacaaaatccccaaattaggctgcctaagcagcagctaaaattgggggtgtcaggcaaggctccggattcagctcacggccatcgaaaacgccaagaaaagcaaaaaagcaagaaagaaagcaccccaaagctagcaagaaccctccaatctctctcaatctctctctcctatttctgtttgagcttgtttcctttctgtcttggcctgttcttgttcagaaggcaggacaactccaaggaatctggctttgttctctagccaagatagtgctctctactcgtgcagcttgtgctgctgcttttcttaactggatggacaattggagtgttggacatggactcctctctctctctctctctctctctctcttccatccctttcttgctgcttcgacaattgattataggttattaactctgaccagtgttgttgtttacttggccatgtccatttcagctcagttttttgaggaattgctgccgttgggaggagggtggaattgatgggtggatgagacgtggattgttgctgtgggcgtttgacgtatctttcatgtgatttcgtcagaccgtgcgagaatttgccagcatgctcgagctggctacggcctacgaattgatgaaggcgtgttttgttattagtggctggttgtgttaatcacgtggttcatcctctttcagagaataattgcgcattttgcgtgtaagtcgtgcctccagcagagtcttttacccctatgccattaagaaagttgaaggttacgtgtatgccataaaaaagttttgagtctcctgtatgccatgacataaactttcgtttacccgtgcgtcactttggatggaatcagcactaacggagactaacggaggtttgaaagatctattttgcccttgctctatttcagccactttggatggaacatttagaagagaaatcggcggcggcggcggcgacgcccggcggcggcggatagacgaggcgaggcggcggcggcggcggctagagaggtggcggcggatagacgaggcgcgtcgccggataggcgaggcgaggcggcggcggctaggctagggtccgaggcacactggagaaattgcacgggagaggattagtagagatgaaaatgcttcaggggcaatttagtcattttcatacgtgggttccacatgtcagagctcattcgctaacagaaggtagatggaatggcacacgggtaaacgaaagtttgtgtcatggcatacagtagactcaaaacttttttgtggcacacgcgtaacctccaactttcttaatggcataggggtaaaagactccctccagcagggttcacaatcgcgaccctgaatcgaaatccgctcatgagcagtatcatcagatactgtgaaatccatcgaaaattgatgatactgtgaaatccatcgaaaagctgaaaaactgatgtaatccgaataaattgtgtcaaaatttaaaattcagtttgaatactttttgtttgaccgaaaaaccaagtgaattgtgtttttttggatcgaactacaagaactaagccaaccagagaggggtgaatggttggtatgctcaaaaaccgaaacttttaacggaaataaaagttaccctcaaattcgacggagatcagtctgaccgaagttgtcctgctggtctgaccgcgcctgtgccgtcggtctgaccggtgtagatcgatcggtccgaccaccctgagatcgcctgccatgcctgtcgacgtcgccggtctgaccgccttgcgcccgcaggtctgaccggtgcttgccgccggtctaaccgccggtatgccgccgaaacccgatgaaacacagatcgaagaactcttaaagtggatgacgactttattgattctctctgtgtttacaaagtgcaccaacagcactccttacaaaaatctcgactaaacacgaaacccttattcaactatcaactcaattgctttcaaaagcgatactgggaagccttacgctccccctctatttatacccgaggcaagcaacctaaagccacgaaccaaaatcatactagaaatcctaatcaccctaggaaaccctctagtagaagaaataaactttacataaccaatcataccaaatttggactccttccaaattcgactccgcatcccatacgcacacaatacctccatcgtataccatatggaatcttcaccaaccacgtgtattgaactctagtcttagtatcccgcatgatctctgaccaccacggacgtcgtcttatccccaagctgactcccggtccatcaccgcaaatactctcccggcatcccgagtcacctacacatagaacaaacaaagaaaccatattccgagaccaaactatccccaacttgactcattagtagctaacgacagtattacatacgcatagtatccatctagaagccataatcatgaaacaatcacggatatccaaacaaataacccgaaaccgaaaccgacatagagtcggccggtcagaccgcgggctgcaccggtctgaccggcagcacatgcccggtctgaccggtccaacaaacagcagtactcacatgtgaaatccaatcatctccaaaaccacttcgcaaataaattccaaataacaaaaccaataatctccaatgccaattgttcatcacagaataacaattaaaaatacctttgattttacatttttgactgatctagaaagtccggatagttgagttgtgatttaaattcatttgcacataataaaggctagcttatgccaaaatgaagcggaggcttgggccggatcattatccttttagggtttcaccttcatatatatctcttgtaagacgccgttcgacgttctaacctcacctcgatatagtgaagatattttgctggctggcgccgtagttttttcttctgttttaggagagttttccaaaatccagtgtcttctgtgattgatctattattttttatcgtttattttcctatcgtttccaaacacggatttcgtgaaactggaattgtgaacactgaccttgagagatcatctaagtttgactgttaggtggtacagatcaccgatcgagtgatgggaacttctggtgccagtaaagtaaactggattttgtttgtggtacaaaactaaaatcgcaaaattacgatgctgtagaatcagtttgcctttactatattatattattgtatgttgcggatggcttagcaatattgatttggaggaaaattttttaaaaaccatccataagtcacttaaagttgatattccatcccataagttattttgttgtaattgcccacctctactcagttccgttgtaaaatccaccttagtgcgtatgtgtttaactgaatcaacatgttttcataaattataagccatcaatgtggtgtttaccaaattaaatacttttaaagtataatctggatactttttcggagattccacaaatagaaatggtgatgagagcttaaatgttatcgcgttgagattcgctattcagctataagggatcgattcaattaagcatgagtgcattaaagtgtttttttacaacaaaactgatagggaggttgatatttgcaacaaaatgatttatgcggtgaaatgttaaatttcaagtgacttctgatgtgtgttttttttgttgtccttttgttttctgcaattttcccttgattttgtggcagctccatcctttgctttttagccacgaccaaagcttaaattttaaaacttattttagagttaattttgattgttatttcgtcataaatagtttttcaacaccagtttttaagctctatagcacacgtataaaatttttactcataaataacaaattattttgagttggcattacgacttatcagttgtagtcaaagcgattggacttacatataatgttctcatattctttaaccgaccaaaatcgcgctttacataagaactgttggaagttctttgtagtttgcttcacatcaacccactaacttaggccctgtttgtttcagctcagcttaagattattgtaatctaaaataaaatattgagttagattactataaactggattataataagccggcatagaataagctataagctgcttgtttctcagtattattagatgtttgttagttgttagccacccaataatctaaaaagcacctttaaagtggattactagattatagaaatctggcttgtagattgtaataatatatcataataagctattatttgtttcagcttactcctaataatcttaagcggaatcaaacagggtctagagcacttgcaacgcgtttggttgggggaattgttatggggaacgagagttattaaatctattgtttggttggagggcatggaagttctaggatagattgggaagaggggtttaagagcaaacgcttaccttttgagataaatcttagtcctatatcatgacttaaaattcaattcccacccattctttacatgatactcatctttattaccgaacaaaagataaaaatgaaactcccataaccaattccttcaccaactctctcttttaggtcctctataaaaaggaacgggaaaaacgtagaaattaaagtagattatagaaattgaaaatatggtaaacagagagaaaaactctttgattacaccacaagagacactcaacaaagaaaagtttcacaagaggtctaaccgcttgcttattttcctatgaaattgacggtagaaatgcaatcctatgaaaaattttctatcctcttcttatgaatcaaagggctttatagaaaataaattctctaaaattcatttgctaatcctcaatttcaaaggggctaaaaaaagccgttgtggattgtgaaattggtttgcatcttggagcatcatcactcacgccgccgcctactccttccgtcccaaagaaaaacaaaccatgggtttccgtgtacaactttgactgtccgtcttatataaaatttttttataatttatattttcattgttgttagatgataaaacatgattaacattttatgtgtgacttttctttttatttttttaaataaaatggacggtcaaacattagaccagagtttgtcttttttttttttcggagggagtacgtaggtactacagtcccagaagaaagtggatcctctcaagaaagaagaaaaaaaaataaataaaagaagacgaaaaaggaaatcgtcgtgcggcgtccgctcgtcgtcgactcgcgagttcggccgccgccaccgccgccgccgccgccgccgatccccatccatcccgcgagcaagcaagggcgcaggcatcctggtgagcgcccagcccatcctctttctcatctctagaaccacgcactttacttcttattcttctcgaatttgcgtaaaccctagcttctgttctagaaatttgccgcaaacaacagtttgtttgttaaaaaatatagtaaaagtttgcggattccccccattttagatccgcccctgggcttggctagcacaacattttttagtgggggaaggaagggaaaggaatcggtgggtggatcgatgcgagcgttcgcgcgaaatctggcggccatcatccctctcgcgcgctgcaatgcgacggcgacgaccgcggcggcgccgtcctccctcgtcctcaaggtcggcgacacgctgcgcgagcggcggcgcttcacggatggggaggtggaagcgtacgccgcggtgagcggcgaccgcaacccggtgcacctcgacgacgccttcgcccgccaggtgggagggttcggccgcggccgcgtcgtgcacggcatgcttgtcgcctcactcttccccgccctcatcgccgcccacttcgtacgccgcccctctcgtctctctctctctcgctcgctctcatgcctgccagatggtgcaccggcatttcgtcgagcactgcatcggcatgacgtgctggcctggcccttctagtatctgatgctgatgctaatgcagcctggagccgtgtatgcgaggcagtcgctcaagtttgcggcaccggtgtatgtcggcgacaaggttcttgtgcaggttcaggcgctgcacatcagggcctccacaaaacacatgtatgctcaattcatcttttcatttcctagtcatcaagactagattgtttggagtgaatcatcttctttctgacagtgtcaaattcggaaccaagtgcttcacgagtgacagtgatgacctcctagctgtcgatggtgaagctatggctgtgctcccctcgctttacctcagacaacaactgaaccaagtgcctcccatcgttgattaaagactggaagcatcgtcaggagtgggacaatatgtgatttatgttcttttgggtctgtagatgctttgacaagataggaaggctatatgttgttttgctgttctcggtagtagctggctcccttgttaagctggaattcccagccttctgtacttcatcaaacctttattccgtttccaatagaacctggggtaaatcccgttataaaaaaaaagggtacatcactgatggtagcactggctagtaactctcagtgcactccattactctaaatagaagtcccatggtttgggtcctttgttgttaaaacatttataatgtctcatgatttagtcagacagcatcttcaaaactgagcttgcagagcaatttgtttggtttgtgttgctcactttagtagaagatgatgtaaaatctgcactcgtgagcgcctgctcaacacacaataaaagttcttgacatattgttcaagtcatatgggttttaactataacatgtcaacctggttattgaacttttgcatcatgcaaagagcaacataataactagaaagagcgagtgtcccagctcctcagcattatgccactcagccgctgccactggccaccatgccttgtgcatcgttcctaggtctttggcattatgcaatgcctaccatgactctgttggtggaaatgttgatatactaggaacaccattttgaagtatcataaattgaaagtgagttagcactcagcactcaggcacatatgggcattggatcaacgccaaccaggaccagaaacaaaagtctagtgcaagtcagctagtaactgaacaggtagtttttcatctttttacaatatttttctttctctgatctctgttttttcttttcctggatgattggtatttgattgaaatgtgaaatatgaaatcaatgagttcaaagatggcctggttttatgatttagattaacttgaatcaatcaaatatgaaggggaacataggcattctgtctgtctttagcaaagtaaatatgtagttgcttgtttgtatgtcagctttgagcccaaccagctttattcttgccatgcttttctcaataagtctcaagtatgagcattatgagacttccaatttcatcttaataacttcactgataacatgtaaattgacgataggttcaagcctgtaaatattattaacttcattgagagaggcaattgcgctgcgatgagctgctctgcctctaaattctgagaacaaaccaatagcaagaacttagcaaaaagggcattgcctgccctcttgtgctaatccattggtaatgttgctactgctactgctaagtactatactgcctcactagaaatagagaaaaaaatactccatgtgacaaagctaaaactagaataatactatcacatggttttctatcattggtattcagttattgcaactgaagaatgcgaaagttggtatcatgttttagtggcatgaaattaactattacgcgtgataaggaggtggtgttaatctcgtatcaggaatatgtcaggatgatgttaagcatttaggggctgtttggtgcgttgccaaaaattatgtcccttatttggtttgtagccacaaatttggcaatgccaattattttggattggttaagtttggtagcaatccaaacaaccaactctaccaaaatttttggcttaccaaatcttgctatagcaaaaaattggcaaggctagcaatggttgagaagaaacaaacacttagatttttagcttatttccatctttcaattgctgatgttctgggtatggatgctgcatctgtggcataaactaaatgaaatcctctttctcgtaggcctcactcgtgtgccactgcccaaactggcagatcttgataggtggctttgcaatctttggccccctgaacctgtccttctccatggctggggccaccaccacctcctctcccctgcggaggatggagtctgtctgccgccacctcctcccagcatcaccgcctatcctttaccaggtacggctaccttaagaggaactactgcaacttatcctctctatagcctgcagtcccatcgagtacctttctaactagtgtttcttgggcttcagttttcttgtgttctaatttttatgttgttttctgcacagaatccgttaggtgccatcaggctggagtcatctccagtgattattggggggatggtgctggacatccatgccaagccatccatgcagccgcatcctggaacgactgtgcctgggatggtaaaccacccatccagctctttattaacttcttagcttgagcaaactgcttatttgctggtatgcaagaaggatggcatatgtgtgtgattgaatggatcagcatgaccaataatactattcaatgtaaactagtgttgaattcattatatgaggaagaaggttctgcaggatgatgtttgggttgtgatatccataagcttggtactgtatgcatcttattcatacagaggtttaggccataaatcttgtgagctttaacttcttccatttcaatcatttatgagaagttgaagtaggatgttttttttaaacctttttaatttttaattgtaaaaataaacccttccaaaacttattttcaagatctgaaccttttggccatgccaaccaggctggcgtggcaaaacaatactgtcacgcctgctacgggtggtgtgttagtgttgttttgtcatgccaggcgggctggcgtggccaaaagcttcagatggaaaaaagttttgggagggtctacttttaaaattaaaaattcaaaaagttaaaaaaattaaaaaatcaagtaataatgcatttgaatttcctaggttaagtacgtcagtgggggagtagcaagaaatattgccgagtgcatttgtaagcttgagactcgaccattcatgattagtgttgttggaaatgatatggcaggtatttcttttatctatttgtgaagatatagtttttttctaaattggtttactcattttgaattactctgtccttttctgctctctgggtagttatttgcttcaatactttccattttttctactgcaggggatttccttttgaaatactggaggtcggctggactatgtacagatggtaagtgtgaagatattcatattgttgtatacatccttgaaattacagtctaatccttgttatgtttgttaggaaaggctgtagtttttcatgtgtagtgagataataggctcattatttattttatttgcattgcgttactggttgaatatctatagatatgggcctacttttgatgcaacaaccaatgctgaaattacaacagcaacatatttaaagggtatttttttgttctctacaaaatatgtactcctttaaaagcctctagtggtggtggcagtgaatctgccaccccactattgcttttgtagttctgtttggtattcaaggggttcagataaaatgaacttatttcttataaatatatactcactttggtcataaatttttatgtttaggttaagattcagtcaaacttttgaaactttgaccatcaataatttctcaaatggcaaaaatggaaaatggtaagcacagcttgtccttgaaaattactatcataatgtcaaaaactttttagaatttataatattttaatataagattgatggtcaaaattttagaagtttggccaaatcttttcctaaatatcaaatattatgaccggagggagtacatagttttccttctgttagctaacactgttgctaataattacataggaatactgcagattgatgacgtaacaaccccaatagtatcaaatgtgtttgatgggagcggtgaattaattgctggcgttgcaagtgttggggcagttgtaagaattttgcagcacattgtgtagtgttcgatctgtatcaacgctaatgttgacaagtaatcactgtacttatctccatttctttttgggcaggaaaaatttctctctcctagctggatatgtcagttccgtcttcatatctccactgcacctctactaatgcttgatgcaaatttatctcctgattcacttgaagccgcctgcaaaagtaggttattccaccttatttctttacttaggcagtgagctcctaagcttatgtgataggctgatatagctgatactagtatgcatttgaaccaggtagaataaataaaggggttacctaatttgcatgcatgcggtgctggatctttgtgtttcctttccaacaagggttgcagccgacaccactttttcaatataatagcatctgtgtggctgcacctaaccttcccttgcctgcaaacaaggatcttttgttgtcttgtgccaaccgatgagaaagtcttctgccagaagaaatgaaaaagtaataatgtatacaagaaacatttttagagatatgctgtttgcaggctttttatttttagctctatgatataatcttacaaaaaaaacaagaaatcacgaccttacgatttgaaatttttcatctcaagaaaatcatgagctttcagcttgattccaaaaccttttagctcaagaaaacatgagctttcgacttcaccttgaaaaactttcaactcgagaaaccagcagctttctatatccatttggaaactttcaactcaatttgagtaatttggaggttttaactcaatatcaggaattctaagcatctttgaaggctagaatgaaaatttgaagtaagaaaatcaggacaatctctgcaacactgtggaaacgtgaaacctaaaaatttcaaactttcaccttaactctgaaacttttacctggaaataaactttcaaactttcaccttaactaatttaattttataactttcgaacctaataatagcagaaatctgtaattctatcaaaaggggaaatgagtgagaagaatgttcttgtcatgcactattggtgttcctaaagagatttgaaaaataggtgcctttatgttgaacctgtcaatggaacaactgccccgcagcgctcgacatcagtgtggctgatcagcagggtacgaatgagtgcctcgcaacaagcttggaatacagcagttttgagtttcttatctgattaggtgtcaatattcttaacatctaccctattatacttcctctagtcaaaactcaaaaatatttgcggttcccagtaccacataaatttaactggacggggtactaatgtatgcaattctaattgtaaacactccctaattttatagaattgtattattattgaactgcattatctctgactctgagtatactggtgcactactcatgtccctcctgaccatcgttttgaggagcttccttgacaaaaatgagaaagacagtcctgtcaattattacaccattatgtttttgtcctaatctctacattgcatcaaaaagttgatgacatgcatgctattttcttcttttttttccccagtagcacatgaatcaggagtgcctgtgttttttgagcctgtctcacttgcgaagggttcaaggattgcaccaattgcaaaatatgtgagtgcaaaggattgaattggtacttattactatgtatcatgttaaggtcttgtcacttaataatttcctggtgattcagattacttacacttccccaaatgagattgagcttgtggcaatggcaaattcattatctcctcctgagaaatatacttttgtcaaaatggagcagtccaagaacaaagccaaagctgtagagtatttgtttgaaatgctcagcccagcaatgtttttcctcctcgaaaagggcataaagtttcttctggtgacgcttggctcaaatggtgtttttgtttgttgcaaagagagcacaagtttgatggaccagcgaaagtctgaaatgatgtctttctcaactccactacttcaaaaattggagcgatgttttccatctaacatgcttgtagatttgcctagagaaggctcttccagaacatgtgtttttcattttcctgcagtatctgcctcagtggttagcctcacaggtgctggtgattgttttgttggtggagtcatttcagctctatgtggaggtttgggtatgatgcaatctgttgcggttgggattgctatagcaaaatcatcagtggaatctgaagctaatatacctgataagttttctgctgcaactatcgcaggtctgctatagtaatttgttttcatcttgtatagtgtacttctgaaatttcagattagatcttagtgctgtcaaatttattttattgcacaggtataactccttgcatttccatttctcatgcagatgatgcaagaagaacattgctatcagctaaaatgatgtggtgcaaataaccattggtgttatctcgtgaaagtcttggtgggcatgtaatttcctaataccgtttgttgattaggctatatatatatatataaggctgagtgtggattcaggtcgtgggctggtgacaacttagcaagtttaatgtagtagattaaggagcacggcaggtttctaaatttgtttgcatgtacctatgcctttatacttcgtcagtttctgtaggctagtgatgatgccacgtttgcatctgtatgataatgtcacatcagcgtcacgtaggatctcgaaaatggtcgtggcaatcttgaaccagaatgatatattttgtggtactaggagttctggtggatatcactatataaaaacaatctctgtgagacaaatcttaaaactaaaaagacaattctcttagggagtagggaaaagatgcattattttcttttctttgcttgtgatgattagttcatcaagttggtaaagtagcttgggaagtcatttgatacgaaaaagctaaatatgaggaaaataaaggattggtgccagaggactcacatgtatgtgtgtgctcatagcaagacacccttagcactttaagcataagcatttcccaaatttgatttaaaatggaacatcatactatatttttaatcttatccttgagctatgttgagatagatgagtttcaaggagttaggagcgggaaggcgaaaatgctaataaacggtcatccgcgtgcccgctcccctgcgtggcacgttggcacgcgcggaggggaggggcggggggacgcgcgcgtgggagtggacatgtgtcccgctggtttctgatatctttttttctttggttttttccttctttttttttggtttttcttttttttatacatataggatacaaagtttgtatacatgtatacaaagtttgtatacgtgatattatttctaggtttttccatatttttttaatacgtacgtatataaagtttgtatacgtatgtatacacactttatgtataaatttttatacataaaaaaaacgtatacacattaaaatatatatttttatatgtatgtatatatacgtataaagagaggagagagaggaaagactagagggaggagggttgtcgtgtagctcgtgcgtcatgcgcggcacatggatgaccgcgtatcagcaccgcctgcgggaaggtggccatcatccacgaagttgtgggtatccctttactctatacgacattttccttagctgaagggtttgatggctttaaattgacttcgccaaaaggcctcatctccaaagcccagctagcgaggtgtccctctcagtgtagagcagagttcatcacctcgctcttgtgagagagaataaggggaagctctagaggagtgttggagttgctgacactctttccactcttgtacctcgatggatgtttctttttataaaagtaagtgttcatgctttcttttggtatttactcttcttgtataagtaaaatatatgcttatcattgcaggttcatcgcttaatatttatgttaagtactctagtactaatactttggataaaaaatgaagttcttggccaaggctagagtagtaattgataatgcaaacgtagtgtttaggttataggttacatttatttgttgtgtgtttcatgggctatagaggtaggcgacaaatggtaacagccttgatcgtcttttgtagtcctccacattccggtacgtcattgggctgtaggctggattcgcttggcagaccaggggaaagtcggtgcctgaagcaagtgatagagttttaccttaacttaattgaagaattttaacccatagaaaccctccctactctccgcctaccattttgttgttgttggatgaacttgatttcttgatgttatacacatgttccttgtgattcgatacccttggaatactctgaggtgaagtgttacagcgttatccgtgcgcttgcggatttatttgtgatcgtaacaaataccaataagcatttctggtgtcgttgcttgggaatagttgttatattatctttgaacctagttctccctggtatcttttctttttatttcttcttttcttttctttcctgccatggagtagctatctattcaaaactcattctcacatttgactggctttataaccatggttcaggggcaaaatccttctcggggtgcgacagtgaaaacccctaccatcatctacgagagttagcaattgtgttcatgcctgacaatctcaggcatgacgcaagaaactttgaagtggaagttgtttccgttctctctcatggagagggcggaacaatgatactctcataccattaggaaaacaaacggtgaatgggaggaactcaaaagtaggttctatcttgcttttgtcttgttaacctatgttgtctccctacggatggaagttctcggttttcaatagtgcaagaaggaatctattgaagtagcttaggctaggatttcattgttaactcaatttgacccagatttgtctatactcgaccatgttacaatatttcggtttgggtctaaacaaggactctgcctcatatcccggaggttcgtttgcacacaaaaccacaacaaatggaaggaaactcttggatcttgtccatggaacatcttgttcgtccacaacgaaacatctcctgctccgggtactccctatgaacctctagaagataattttctcaaggaaattgtgagggaattaactatcatcatgagcgatgaatggttaagagatgtagaggtttcttccgaagtaattcggactagctccctatcgtccctaactatccaatgtctcgtgatggaggttacagtgaatgttctcgataatcccactgccggtgctaacatcatgtccacaacctttgtattaacttgcttaggtgacaagccccaaattcaagttcttgattaatcatttatctacaattgagttgctatctttcgtgttcttgcttgtgttcttcaatacgcacgtagggattagtcttcttggcaagatctatcgggtttcgacatggttgatactagaggagaagtggtgctgcgattgcagagttcggtgttcttcaatacgcacgcagggattagtcttgttagcaaggtctatcgggtttcgacatggttgatactagaggagatgtggtgctacgattgcagagttcagatcaacgaagtcagctcgtgttgccatcacgagccattagtacgaaccgacaaaacctttcggagttcctcaagtcctatcatagaagtttatgggattctacgtggagtgcctatgaggaacgagaatgtcgaagccaccctagacttccacgtgttcaaagtccctgacttcgatcttctgatcgactatcccatagaaaaacttctataatgtgcctaatccagattgtgcctaaggagttatgacggtcgttgaaaatgccaaaaacaaattgatcccacaacgaatcgtcatgggatggaggatgtgcctagattacagaaaacttagcaaggcaactaggaaggatcactccccgtcgccttccatcgacgagatgctagagcggcttacaaataatttcttctgtctccttgatgactattctggctatcaccaaagtcctattcatctcgatgatcaaagcaagaccacatttgcttatcgtcgaatgttgttcgggttgtgcaatacacccatatcattccaaaggtgcatgatgtttatcttctccgaaatgacgaatgaaatcatggacgacttctcagtctatggaaaaatcttcgatcattaactcgagaacttagacaaggccttgcaatggtgtaaagaaaagaacttgatgcttaattggagaaaaaaaatgtcatttcatggtcaagaggggatagtcctaggacagcgaatttctgaaagagggatagaggtggagagagcaaaaatagaagtaatgaagcaactttcatctctcaacaatgtaaagggaatccacagcttcctaggtcacacaaggttctatcgatgcattaaagtttttttctcaaattgctaaacccctaacttatctgctagctagatatgctccctttgaatttaatgatgagtggttaaaatctttcaatttgttaaaagaatctcatcttagcgccaatcattcaacctcctgattggttgttggcttttaaaattatgtgcgagtttagtaattatgttgttggggtcattcgtggttgaactaaaaacaggaagcactatgctattcgatatgctagtcaagcatgatagaaagcaaagtcagcctgctagatgctgaaagagacattagctcaattctactccctcctttaactaagtatataaaaaaatttagcaacatctaaaatattaaattagtttcattaaatctaacattgaatatattttgataatatatttgttttgtgttaaaaatactactatatttttctataaattggtcaaacttaaagaagtttgactagaaaaaaaagtcaaatgacttgtaatatgaaatggagggagtagaaatctgataactcgctcttttccacgtcaacatgaaggcaggagactcggagaagttctgaacaagagacattctttccccaccatctcatctctatgattagctcaggtaagtttataattctatggtgtccagatcctacaaagaatggatcaataaaacctttttatgtacaaggaaaccaaatctgagactgcacaaggttaacaaatggactataagcatgcatctgtaagaagcaatgtactttgtgtacttcgcttcctctgacgggccgaaaaagaatcaactcatcccctagccttcctttttatcaactcccaaaaactcgagttgccaaaacctctgatgatcaattcagtgatacaaatgccatcactgccaaaatatggttgggtcattgctataaactgcacgatcctggatctctaagatagagacatgccaatcgacaagtcttgcttggatgcatttacataacacaagtcctgttgggaacagccaccagctagtatcatccctgccaaaagtaccaatgcttgtgtgaaaagaacagaggcagagtttttgaggtagcaacagttatggtagagcagtagcgaaatgtcatttggttttcagctaaggttacttacccgcccaaattccaaggttgcatgcttggatgccttttggctgaagacttgtaatgcacaagtccacacgcaaaggccacgatctgcaagggatgaaccaagtgtgaatagattaagaagatccataatggaaaggattaaacttgctattaccattagcagaaagaaagatgcattgcagctgttgtaatgtccttaagaaattgaaatatagctactactgcaatgagtaagaacatcaacataattccatgcaactagttcttccaaacatcaggatttgagctcagaaaaaagatatctaaaatgcatgtattttggtacattacaggctcaaacttcgactcaataagacacatggacttcataaatgtatgctcaaaagtatatattaaaagaaccaagcttgatgggacttgagaatgagtcaagggtttgagctcaagatcagctccactgtgctcgagaaccctggataccttgatgagcccaggctttcttgacacatcaagaagtgggaaaatactgcctaactgaatacactatagcaaactgtaccaaataaaccgaaactgtgtgttactgttcttgtgattgtggatgtatgagcaatgataatagccaaccaaattatataatttccccttttttggaacctaaagcatttgaaatgaactggtaatatcaaaatataagtacagtcaaagatgagtactcacaacattaaccaatgatgtaatattccacagcgcatacacacgagcaagacctgctgaccgccgtggtccatgactaaatagagcatttatcccagcaggaaagggtgccagtatcccaagaggaagaacaaacagcactaacaacacatcgatcatagaatatgaatatagctggagaaaagtaagcaatactaagctgaaatctgcaagaagcaatatagagatcaccaaaccaacaagatcctgcaggaaagaaaaagaaccttggtaagttcaagattgtgtagatccatcataaccaaactaggggttgcaatgatgtcaggatagctgtgcaaaatggaagtcacctgatgcccaactggtttggtattgtgcaatataagagaaagagggtaaaataaatctctcttgtccttgagtgtccttaagttgtcaatgtcgagaactctgccagttattcttttaagcataacagcatcattgttccttgagtggtctagttgagaatcaacatctgtgttctgaaatctgcacagcatggtacggatcagtgggataaattttaatatgataagtgcaaaatgtgcagagctaaagcaaatgactcactgcgcatgataatcaaatttcattctagagccaccttgaaggccactactgaatggtcccacagaatgaataactagaccaaattgatagtaacctagtgctgtagcttggaaccatgcaaggtcaacacgcacgcggtatgtgttcaaagcaggatttgcatgagtttcaagccatttgagtacaggaagaaatgtggcttttagatttccacgacgagccaaacgcaactgggcgttcaatccagcaacaaggcggtgccatattgatgaaggtacaccctgtaaaaatatgttcatgttatatgctaataaaatgaattgttcacttagtgatccagtacagcttgaaatgtttcagaataaacctgactaataagacttgtgaccacactgtcactgtgaagtgaaaatggagccatgtaacttccatcgcctccaaagattaatgacattggcaacctttgatgaagacgaggggggaggtcaggccttttttcatccccaccaagaaagaaatctaaataacccagcattaaatctggtgtagcagcaacctatcaaatggaaaaccagaaagcatacctcaatccatgatgtgatgagactgataattgtataaaaattcataatacaagtgcagttctggttcttgtactggtacagttgcagataatgcacacagaatcaacacagcaatatttgtaactcaattacattcagtgttcccagaaaaaaaacaaaaaactccataaggcaacaagggatgggtgcccaacctcgtaccacgtaagcagatgggtaggctgtatgatcgctacaaggtgggttcaataataccacttaccactttttagaacctttgaacagactttttcttaacagtacagtgacaagatctatctggttattttggacgtctaatgatgctgtacaaggtacatactcttatagcaattgaagattaactaaaaagcttgaatcaaatgaagaacacttaacatacactagatgactgagaaagtaaggctaaacaacataatttcaagaaattccaagataattgatgaaattgattgtcgagctcataaaaaaccactaaagctcataccagggatttggcactgaaaagaacataccttcagcccttcataaagagcacgtgaacggcaagaccgtaaacatgaatgatcatattcagatcgaacaaattcacgtaatctttgtaattttcttcttctgcgccactgttgccaagaccatgccaaggggtatgaaagtatacacaggatactataaattgatccttcccaccactgatatgctgcgagagcatttatctcatcgacaaacttgttaaatgcatcctcatacctaacaaaaatacgataaacataatcttaaatgagacaggtaaaatttgtggcaaaaaaagcaaaaccagtaaagataaggaaaaaagaatgacaaaagagcccaaaggctgaatgcatgttgttcaaaaataatcttgatttacttgtggacagatctacgtacacaatctcagaaatctgctcaggtggggtgtgtggtagatgccaaggttcactgaaggtgttgggacccatgaaatacatcctgtgcacatgacagtgagattcttcggccctattggtttccagtacctaccacatgaggagagatttcaacgaaaaaccagaacaatcacaccacagcttaaagaaacaaattaggaatgcagaatgttctgctacctcattgagtgattcgaggaagggaaaagagtgatcaatttgggagctatgttgagttggtgctggtccaggcaactcatcagtgccaacaaacttcatccgagcgatactcaaaacaagggctaataaaaaaagaaggcctgagagaaacagaccaaacaaccaaggtccaccaaaagtgtatattaactcttcaagagcagtaaaacagtgaggcatgcggtatctatcggacacacatttgtatgggcacggggtttcagtaacacctcctgtcaaaaacaatatctaaggttagaacattaaggtaaactggccgaaacatttcatatatcacatgtaaagctaacaaaagttgaagagtttgaaaatgctaaaacatgagagaacagaacttcatactctcattaaaatagtaaacaacaataattatatacagcaacaattccgtctagccattagtttacacaagacaatcagttaaaagcaaggcacttctagcagctaggccgcatggaactttgtggtatgcatacctcgtgtccacagatttattgcaaataatcccattagatataggaccattgacagcctataattctttagaaaatttaaaaccatagacccaacgacatatgtatttgcagattagacgccataattctgtcactaaatttatttgatctgcacttgagacgcatacaaaaagaaacaatagaaatgacctcggatgcttatgtagacagcacgatgagggagctcatttgtagggcatggagaacacaaggacttcaaagacccagtaatgttcttatatgttcctaaaggacaggcctgcatcgtgccataaaaaccgttgcagcaaagtgagaaaataagtagtatggcaggttggactgaaaaaattgaagtgcaactatgacatgcggctatgttgataagaagacatgttatctgatttaaacaaagaaacaataagctacaaatatatcaataattcgaaaatagcaaacacacttttgctacaagttaccttgcaaaatgtgccataaagaccttttgggcaatcttttcctgtcactgttccattttcacccggaaaaccttggccatcaacggttcctcctctgcacaacaaataataggcagtatttttttggtcaaaaaggaagagtcagcatactgtttaccaatcttactgtacatggctgcccacaccacacagaatcaaggctctggaaaatgggaaggtgaggaatgggggttgctcctagtttgcttaacctgctctactaactattactccttgaaatattccagaactacgattaaggaaatgtaaggacatccaccagcaaaaagcatcataaacttagaactttaaatataagaatgcagatgtagcagcactttagcatcatgaacagatctagctagtaaaacagaaggaaaaaaatagaacaaacagagaaaacatcagaattaagatgcaccttgcaagtattgatccattaactgttgcaaagggaatataatcatctccagtgggaatgtcagaccagtggaagtgaatccggccacctccacctccgccactaccattacttccaaccccaccagcgctagaaagtacagagccctcctccaaggacaatgccctcacaaatagaagaattgtgcccccggaaccaccaccaggtccttcatttgcagcatgagtcaccgcaccagcaaaactgccaccattcgcctctattgaaccagcaagggagagtagtggaagagattgctccaaagaacccattactggaaatgtgcagatgaaaggcagtaaaaaccagtactactaagagtaacagtgactgaatagaggatgataattgacaaagatccatatgctcgatctctgttacctattataccaccaccagctgttgaagatgatgtacttacattaccactaccactgccaagttcacatggtaaatcagcactaccatatgcagttccaccccctgcatgactgccactgtagaaagcatcccctcctttaccaccatgcccacccccaccactaaggccactgcttaacattcttcctcgtccaattccacctcggcagcctgcagcagggagaaatcaaatctaaattctacaatagtttacagaaggctgcattcaaaagaaagatatcaaaagaagctatatgttactattaaatgtgtacatagaaatactgaagcttaatgaaatctccattatgaaaaataggtatactgaagcagtaactattcaaacaaaaataattttcaatgctgatgattcaccaattcacgaacaaacagagaattaagacagcttatctcagatcagacagctataaaataagactggtagatgtaagactaaaaaaatgccatatttttctagtctactcagttggagctgtgcacaagatttattcactgctataaacattatagcgtgtcatgtcatttgaaatctcgagtataacagggcaaatggataatggccatcagtgacataagcataccgatttaagcctaggtaggcttaccatatgacaaatttttgaagtgattattgcaacattgcagcaaggactagagaatagttatcatagccataggaagctatcattaaactaaataaggtttcctttcgaatatttagttaatcaatagtttgtgattgcagatcgaaagcagggctgcactgtgcaatgccacaatctggatacgggtatctttaacaactcctgtaagaagttctatctcacagcttaagaaattatgcttccaataaactgttttatccagagtagaaacaataaagtgcttctcgaaaaccaccacaatgctgaacagaatcttaatagcatttatggcaaagaagaaaaagttacctaatcctgttgcactaatggtcccagatgatctcacagtgacatttcttgctctgttgaaattaataacagttccttgcacaaggccagaaacaacaatgtcttcaacacggcatatctgcgtgtcaaaagctaaccatttgttacatgttaaatgaaaaggcaaaatctaagataaagaatatatatagatacacactgcacggaaagccttgggaaattaaagtgtgcacctgtagggtaaaagacaatgaagtgttcaggttgcaatcctcaggaggatgaaagatttccataggacaactctcatcttcacagttcagctttggggccctagtgtagagacaaaagctcagaaaccgttttaaacttcatggtggaatagcaaaaataaaagcaacacaaaaactgaaggtggtagtatttacacatcatcactacttccatttacaagtgggccttgtagaacagctccaggtccaacctaaaatggaattacttatcaattagagtagtctgaatgatcacgaaggatcagaagcatctaatagaaacaatgaaatgattgaactgtaaaaaatcaaaaacaacaaggttgcaacagggttataccagcgtacgatatgcaaggtaaaagagaaaggaaatgcatcaagggctgcactctatacctaacagttggacaaaatactgatcttgtatataatgaacaacactctatatcttaagggcttcgagaaaatattgatcttgtatatcatgaacagcagcataattcatctcaaagataagtttagaacattaaatttagtgtatcgagttagatgagatatgaataagtaaataacagaatggagaacactacagatagatcacgcaaactactgatgtcacacgatggcctcataacatgtcaaatttaaggcaatatcaaaggcatattcatcattccaactctgaaaacaatccgaatccataaaaatgtgcctaagccacaaaaggtatgcagaaagaaataaagcaattcagactcataactgattgtgaataaacaaaccaaaatgaacttattttaccactatgttgtagaaaagtgataaaataagacgttgcgcctgaatcgtatctccatctccagataaattcaggatgccttgaccatgaattccaagattgccaatagaatgtataactgatgattcctgacaagcatgggaacaaaataaatcatacagaagagaaggcagaggaggagaagggccatatcttgcaattttgaacaaataacataccttcaacactatcaaattgctaccctctagtaaagaagtcgcaactcctgactctctgccaccatcaatcaacattctagagttccacataagaagcatctttacagacattcgtaaagcaccaaacacctgaatgtgatttaagaatcgtgaggtgcagatacaccacataatgggttaaaattgagcaaaaggaatacaacatctgcatgaagtaacagcagataaataccttaattgtagaatcactcataagaagttcctcagccaacaattcaaactctgaatatggatagtgtgtcaagccaaaagttaatgtagcgcgagatagaaggctaatttgtccttgagcctgaaaatcagaaaacattgaaaaaagggtaactgaaatatctatagtgactagaatgaaagaaacatttagttaaagaaaatactagtccaatatcagctgcaagctgcagcaaatgtatccctgttgacctatacctgccagtcccaataaggacagaaaaatagctcaacagcagggaacagcaactcatgttatttaccaaggtgacatgcagtaaaaaagaacattttttcccataatggaagtcaccagaataatagcattcctcctcccaatttaagaaagaaaaagaggctcagatcctttttaaagaaaataatttatgtctttgcaatttcatctccacaaaaacgaaacaaatgaagtgtttatggacaagcaatcagaatagactttaaaactaagtgcctcacacctgaatacgactccaacgcaagggaagagaaactttggcatgattcttgataaaaacatttgtccagagtggatcatatgggggttctagaaaaactgtatcagtttgtgtgctcaagttattgttgctaacagtaatactcttaggcacttcttcataaagagtcccagctgcacctgcattgtccagacaacctgagctcctcccacctgttaaggcaacatagttcaaacacaaataagtagtatgttgaattgttgataagcttgtacaaactatgtactttgcataaaccaagtaccaactacacaggtaatactaatactcataacttgtcctcgtcaaacgaaaaccaaataagaaattctgggctagtccaataaatatctatctaacctagatcagataacgccaaagttcactttacactccgccagcatgaaacaaatggagaatatgtagatcatcttttaattttcgagcaggattcaagaagccaaatcagaaaatgaaaactaacaccctgcagggacattagtgtcccttttaaactgttactggaagaaactggttggttctgtatatttaacaagttcttgatgtttaactctaaactaataacttggtcagaaaagttatggtcactaacttggtcactaaagttatggtctctaaaataataatgtagaaggtttaaagaatagttcatatcttacaatttacaacaaactgaactatatgccagtggtttccctgatcagaagtttgaagaaaaagtatattatgctaaaacaagctcttttgacagttgaccaaatcaatgttgaaagtcagaaaagaaaaattcaaagctggcagggaaaaaaatacggataccatgaagatggcaggttataaacgagaacaacctcatataacctcagcaactagaaaatcaatgtgaagatacaaaattggaagcctatcagagcaaaagtagtccatgatacaaatgaaatcaagtgaattaccatgaacaaaaaattgggagtcatcatgcctactgaaaacatcaacagaaacacgcccaccacctcccccagccaaaccatcccctccgcaagcacttattgtgccacctccttgcctgttacaacaaaatatcagagaggaggcaactgttcgaaataacataaattcgaaatttaaacaaaaaagttatatatatatattcatttaatattttaaaatatcaatgagtatggttttcatagaccagctcacttaaaagtccaaaactccaaatatggctggtcaggccaacctgcattataatctaacatgtacataactgatgcttcttggtaattctttgcttccatggttccttctacgttggagacttggaatgtattgtttgatcttcgctagtcatgctcatactagtcactatgacataattgtggaattttagactagagcaactgatctggagtaagtttaagtagcatttagtccaaaatcctttgtttattagttgcctggcaatatgtctttctgaagaatgtgtttgtaacccaaatacgtagatatcaacatacaatcttcgagggctacaaatcctatcatatgatttagcacttaacataattgtaaattaaaacttatctggtccccatcactgcaactgtcagttttaggcatatataaataaaaaaaggatacacaatctctctcaaatccttattaggtcctaaaataccagtaccagatatagttcctcctgatttatttcaattgggaagtactgtttcaatccaatgcactggaatgtgaaatttgtaccattctcaacacagaagaaattttattggctttacatccattccagtgtaaaatttctaatacatctattggacaagctagtgcatgttgagtgcatcctatacaggaatcatgatctattacagaatatgatattggatatataactttttaaatatggtaaaattaaaaataacaaaaatataagtatatatgaattgtgggcaacaggcagagcaatgatttatccaaacttcaaaaaataaattcgtgttgcctttgtgtgaaagtgtgaaaaagagccaagaggcctgaattttgaactttaacagtcataaccatatgaattgcttatacgatttcgaattagccaacaaagttaatatcatattttcaatataaattacaaatactcacatggttttagccttgagatagatgcttcccccagagccacccccacctttggtgccaccatctcctccattagcaagaattgttccattcatcataatatccttggcgaacaaccacactacacccccaccaccaccaccatagtccttctcgacgctggtagaaccgcctttgctcccgtagctattgggggtcttgagttcagcccaagcgtacatatcgccgccccacgaatcctcctgcgcctgcccctccttgacgtagcagctagcaccacggccgccatggccaccgccatcaccatacgacccagtaggcacgccgctggtcttatcaggcgggtcgccagcgagcgcggtggtgtcgattacagcatcactggagagcgtgatgttggtagctgaaagagaaacccacccggccacgacacgggcctcacggccgaagaagatgccgccggacaaattggcggagacgacgcacccaggcctctcgcaggtgagggcgacgccgtcgacgagcaccagcgtcccattcccgctgatgtagacgccggggccacggagcctcacggaggcagggaccacgcagcgggtgtcgaggtcgcccacgccgcggaggtccccggcgcaggtcgccgacggggcgggcggcggcggcggcagcgaggggggcggcggcggggtgtagtcgtggaaggtcaggatcgagtacgcctccgcctccgcgtccccccgatcgaaacccccgaggctagggttccccgatgcgacggcgaggagggcgagggcgaggtgggggaggcggaggcggaggcggaggcgggcgaggggaatgtgggtggccatggggtgggaagcatcagaggacccagcgcccggagggtaggtggggggtactcgacgaggtttcggattggcggcggcggcggcggagatcgccggagacggcgagggggggttggggtttggtggtggttgctcggtttccgcttccgtcgctaatgggaatcgaagcggggcggtggtgcggtgggagataggccgtccgatttgccttgagattcggggaggggttggtggggactgactactatgctggggtttggtggggccggatgggcagtggcgcttttggttgattcatagaggagggtataccatccatctctctctatcacttgattgcagctaatagtgaatagctttgtatgatcttttaaagtgcaatgtgccaagtgacgacagcttatagtagcagattagcaagaggtcagtttgctggtacttttggaaagatcttacagttatttgaaatgtttgtttctctttcactaaagtatcaaagtactccctccgtttcataatgtaagtcattctagcatttctcacatttatattagattcattaacatcaatataaatgtaggaaatacatttagattcattaatatcaatatgaatatgagaaatgctagaatgacttatattatgaaatggaggaagtatctatttgtctatttctcgttttcacatatcactaagttacttgtaagttgaatcgtttgtaggtatcatccttttttaaaaaacccgggcacctctttgcttccacaaattattctaatctttgaaaaaaaagttaatttgatctttgccattgcaaatatgcctattcagataaatatcatcactatttatctattcgtagtctcaaggcgaagaaagataaggttgtgttacttggtaatggctcaaactcactcattatctgtgctggtccttaccaatctcttcttccttcactgccatcgtgcagcgacgggagtttgacgctcaacggacgctttgtgctccatggcagccccacaaagagcatgaatgtctcttaccagtggggcccaatgcatattttatttgattttcactggttgtaatatcaaggtgccaataagagtcacattagtcaaaatcgtcttacaaaccattgaagagtcattttgcatcggtccgaacggtaggagaactcgttatagctagttttctgtcgaggaacgcgaagcagatccaacataaatttgaggaactcgaattagactttatctgatgagtaacagatcgatgctctctttttgggctggtttagtggtcacattttgaactttgagcccattaaactcccatggacaatcattatttttcggattacatttcataccccagcgtggtcttgtagtgcataagcttactttttacttactagtacagtgtaacaatcttctattgcttacatcccttgggtcaaatacagctgacaaccactcttgtgcagaaattgtttggagtagattaaaaagagagagtaacatcaatggtggaatgaacggggtataagcacgatgcttattgattcattaccaaaatattcctgaaaatttataagtagtgaaaagtacgaatatctgtacaagccactaaacacctacccctccgtctaaaaaaacccaatcctaacaacgaatctggacacagattgatctttttttagacggagtagtaaaacttaaccattcaaatatagaaattattaatacttccaaaacttaatatgcaaatacgacacatcaacgcactaagcatttaaaactcaacaacaaaagcatagtaagtacatctataatttattacatgctaaaactcaacaaacgagcacggtaaatcataatatttatcaatatcattttcacaatattttaacccaagtccatccatcttttctacaacattcaacataaatttatccatatattccacggtaaagcacgggacataatctagtatataatataacagcctcatcggatggcctaataagtcaaagaaaaagcctaattttaaattttcaagtttaattttaaaattaattttgacatattttcaacatagtttctttttcaacattagcttttaagtcacaaataacacatttctaaaagttttacccacaaattcatttttatttcctaataagccgttttggcttattaggaaataagccaaccaatggggacctgagtgacggtagaaattatttttttaatgccccacaaataattgagatgaaaaaaaagtgtaagtgggctggtttatttgttgtggcccaagcaaagcaagcaagctagcgtagaatgcagggccttagccggcccatgagagcagcatcaggcaaccagcaaagcaaacagtaagcaactcgtaaagctcctgtagcatcgcaaattagtaaccacgtcggaagtttgcagtgagagggaaaagcttacaagaaggagatcctaatatcctatgttcaaaaaaaaaaaaggaggagatcctggacaataacaacactgaatataaaccttctgcgcaaactggggatggtaatgaaagggcagtttatgagtatatgagctaagctcatttttgtttgttttaatttggtgattttttcgcaggcgaacagcataacttgaccccgcctacgataataacttttgtgccacttgtgaaagtgggtttgccccgtttacaatgatcaatttccgtagtaatgtgactagctagcgagtattttctttgatggccgcaatattatctgtgataattaaggaatttgagctgacatttacaagcactatcactaaaatggtcaccactgtcaattcagcgcgaactggctatgagagtattattgagatgcacttaatagtgcagtggtaagaggtgtatggttttaattaactccaagatcctatgttggggctcataatttttttttaaaaaatatatttggaggaacatctcttcttccaaatctcctttttttaagatggagtatcactgctggttcaccatatagtttcatgcccaaaacgacaagaaccggcagtgttgctctgtcggttcgttcagctgtcggatcacgtattcacgttagccgttattctctcgattcaatggatcggatgcatagatgctcggccctaactaatactattaattaattacattattcatgcatccattttatctctagaaacattccatactgcagcttggatatgtagctagcttttgcaataatgttgatctctatagctatagctacatacattgcttccgggaaagggatataaaagatgataatgacatgatcaaaagattgccaaaggatattagcataattcttcatcactctagaccaagaacaggaagaatatgcatcaaatgcatgcagctaatgcttgagagttgaaacgaaacatgctttacatcgatatggttcgctttggtatgttctccttttgtattgtgcatatcagctactttttgcttgcttaaaatatttttaggtcatttagttatacattgtgggaggagaatatatgttctgtcggctgcactctcttttaattttctgggggatgcaggatgcaggttgcatgagccgttgatagagccaaatacacatatatgcactcatgcatgtatgtacatgacaatgtctggctttgtaattggaatcatatcaaaatttgaacacacgtatttttgtcagatttttttcatcaagaacccagataacgattgcatcctctgtcttaattaattaccgcggctgcagcaacaaatgctactcattatagggatttcaacaaagaacacgcctgttgaccaatctacagttttaatttcttgagagagatcagttaatttgcatgtatatatatcttctggtcaattttaacatgcatgctttcttaattgtgatttgatattttaattaggggtgaaaatggattggctagtttctgaccgattcagaatttccggaaacaaaatgtatcagctcggatagctagtgttggattcggaataaaattcagattcttttttcttcacgtatggaaataaatacagaagttttaatatccaccgggaatgaaaacaatcggaaactatccggataggtgttcagatagttctcagaaacaaagacttagacctgtagcccatattacttttaactttaggctcatatctctagcccaactcattatccaatatttttatcttagaaacatagtatgtggagtagctattcttatatttactagcttcaaaccatatatacgttgtatgggtagtattattgatattgtaaatattaaaaatttaataatgtattttaaataacactatctccttttatatcataagttatttttgacttttttttctagttaacttttttaagtttgattaaatttatagaaaaaatatagcaaacatttctaacacaaaagaaacatattatcaaaatatattaaatgttagctttaatagaactaatttgatgttgtagatgttgttaattttttctataaaatttaaaaaagtttgactaagaaaaaagtcaaaccgacttataatatgaaacggaggtagtattatttttttgaatgtaagaactgattctttttaaataagagtatagatcaattacatcttattaattattaatattagaattaaattaactaatttctaaattgagagtctaacatggatacaacttcatatttatcatttcaagtattttaaattattaaattttaaaaaaacaaaaactaatgtacagaggagtaaaaaacaaagtatgacatattatatttaacaggaatttaatatattctttcgggtgaaataatgagttatatctctttgtttatattgaaagcacagtctaagggatttcatgttccgataaatattcgtgattgtattctttctggttcatatttgctctgtatgtgtagtatttatttttattttcatatctagggtgactatattagttttcattcttagaaaaatatatgaaaccgaatatgatagaactagctggtttccgtccgtattcgagctagctgttttcattcctactattaatgatggtacgataaaagaagaagagaaaacacatgttatccctacttggtgaaaacatataatagataatatttgatagacgttaaatataaaatacaggagccataaactgactggaccaaattaaatcatattacaactaatttgagaaaacaacatgtgtaatatgatgaaatagaaggagcatgcacacataagtttctttaaacaattaaatcaaaggaaaaaaacacatttttttcactaaatttactaaacagatgaaataatatgggacagattaaaatggtgttttgcacaaactacctttttgcattttgtacaccataaaattaggaaccaattttttggtaatcaattttggaagcacttctagtaatttaattttcaaaatggtttaataatttaaaaacaagaaaaaaaaatccatggacaaactgatgcatgggagtaatttttttttttgttttctttgccaaactaacttgacatgccctcatttgattttttgatgatataggagtatcatttatgctgttgaactatatcacttacacgtggaccagtggtggagcccgtatcttcacaatggaggttcagacttacttggctccattctaaaatgtagctatttctagcacagtaacttgttccaaaatgaagctatttcttcacctatcttctcttctccaccaatcacaactctcatccaatcatctctacctactttcttaatatctgtgactacctataaaaatgcttacattatggcaggggtggacccaaggggggtgccgggtatgcactagcatacccaataattccgaaaataagttaacatgtagtaggtattaaacatctctgtattagtatgtctaaatgtttgatgaaagctttctcgtgtggcaatacaccaaggctcaataggcccagctggtggtaggttttcaatttctggcgttatctccatctcgctagcctcgaccgtgccttgtggcggcacagagtgcagacgaaagcgacgagcgaccatcagctaataaccatgtactccctccgtttcataatgtaagactttctagcattacccacatacatataaatgttcatgaatctaaacacatacatatgtctagattcatcaacatctaaatgaatgtggacaatgctagaaagtcttacattgtgaaacggaggaaatagtatttcacttttttacttcctctgaatcattgatatatcctctttctctagatgactacatttgaaattgaaaattgaaatacgaaatcattgaaggcgtgtttcatgatttgtaggattaggtaaattgaatcagtcaattctgattaggaacatgggcatttctttattcagcaagtcaccgaaaacttctgattctaccagttctacattacccatgtcttcactcctgtcacggtgatgaggaaattccgaacagggaggaataataagtaaagaaaataggaattaattggaatttgtgctgtccattcttcttcaattccatctcagggtgcattatcgatccaatgctaataatactatttgtactaatacttttgataacctgatgcctaattgtattagcgtgtagggaggctttaatttggcttgtcacatgggcacaccgacgacaaaaaacctgggtctgccactgcattatgggacggaggaagtagatgacaattgacaaaccaacaaagccagtcgcacattcaaacaaatcaacaagataattcaaatgacatatatattacaaaagttcaactggtttttattgcatgcacttgtgtataaatatgggtattatgtcaaaaagtttgggggtatagatgtacccccatgaatcaccctagttcgccactgatgtgaaccatcccgaaacctaccaaatggtcaaaatgtgagatgaagaaacaagttagtggaaaaacatatatgtccatatttatatatttctcgatgaaaaatgtattgcagcatatattgatccaagcacacatatctataagttctaaaaaaagacgcacgcgcgtgcgcacacacatgtgtgtgtgtcaaagataccagattcaacattcagacaccagctagctggctagctagctagctaacttgtgctagaaagaaaaaagaattgttacggcataattatatattccaagttctaatttaatctgaatagcaagaaaagcaacagtagcgtaatgtctaactaatgaaagaaatgtctataaacacacacacacatatatatatatatatatatatatatttgcgttgtatgcacccatgcgtatatattagggagagagggagggagataatttgctgacagaaagagaagtgagcacatatagcttcaagcacatgaactctctctctctatatatatgtatctcttcagtcaacacacatatgaccacatatgcaaggaaagaactatatatgctcactctcttctgtcggctccctagctcttttgttccttccctgtatacaaatcagcaagacatgtcatcatgcttgaaagttattgattagcaaaaaggaaaaaaaacacatgcccaaaacaaaaggtgtggcctctcattctcttgattgctttccaagaccttaacttgtgactttagtttcatagactactgttttatttgaatgtgtggcttatgggttctgaaggggatggcatggtatttataggaggagattgcgaggggatgcatgtacacaacctactcccttcaatttcctagtttgaacagaataaatgcctcatccattaattaatttgctgatgccacaaagaggtgaacttgtgttttcttgtactccctccatactcgtaaaggaagtcgtttaggacagcgacatggtctccaaaatacaactttgacatcttgtttctataaaaatatttattgaaaagtgatatatgtatacttttatgaaaatatttttcaatataaatctatacatataatttttatattttcaaactcaacaacttaagagttattcatgatttatatttccaaggtttgacttaaatattattctaaacgacttcctttatgggtatggagggagtatacctctaggttcttgctagtttgatcatcttatcctatatatccatgcatgcatggctgagcaacaagcatagaggtaacagaattatagggccttgtttgattaagattactgtggagagtattcggattactctacataatatagaaataaattaaatattttaggaaataaacttaacagatagcttagaataactggtcgaaacaatgcagtgtagaagaatttttgttttgagaaaacatatttttcaaagcataactcaaataattaattttaaataatccagtgaataatctgaaaacaacgaggcctgaggtcagctaatctgtcctaattgcatcggtcgaatttaaaactcctgtaaagagtatctcgagccatttatagttcaaaagtgaagttagttcgtttacaaggtgttcgagctccctttttttttttgagagagaagatagattttgttgctagctcgttggtctacatgcatggaagatatcccatctttcaaaatgttctggttggtcttaactacaatctcacacacgagaacatgattatgcattttaactattgacccccattaatttttgtcaactcttatatatgggttaggagtactgcttcttgttataaaggaaatgaaaaggtccgaattaccccattaaactatcacggtcgtttgagttagcctctaaaaatactagatattttacaccctcaattattcaaactggacaaataaccctctcattcaatccggagtggttttgttcatggcaaaatttgctatagggcataaaaaaagcgtaattagctggtggacaccgcaagaacgcatatatattgtaggacactataaaaaactgataattagctgctggacacttacgatattatttattatttctgatagaattggagagagaaatagtaattaaagacaagtttgcccctgaccgaacttatttcaatccgactggttcctgttcaaaccagccacgaggcttttcgcagtaaatcgatgcctgtcgcaaacccgacgagtactggcggcaagtgcgtggcgcggcggaactcagttgccaaatggagggtacacgttctctgcaccgtcggttaatcaactaatcaagttgtcttttggtgacaaatatttcctagtgccatagaccaactagcatcagagtggattataacagcaggtgcatgtatcgtcgcagtggcagtgcaggatcgaggaggaagaagcagccaaagggcagtaatggcgcaggtggagaagacgggcgcgcgagagattttctcctctgcatgtggaatctcctgctcgctttatcccgtgcgccaggcacagccctattcgcgtccgtgcgtggcgcgcacacgccgtggcatgccaattaccatgctgctcgcgtcgtatatggtgagagaccgtacgtcgtgtgggatgagacgggtattgtcgttaatggtggcactggcatgcgcggcgacgatgcctctggctgcttgggccgcggcgtgcgcgagcacatgtgcgcagcgacgacgacaccgacgacgcggcatgtgtcatttacgtgctcggccactctcctttaatttgtcgggtgatcagccggtgccgcgatcgtgtcactgactcaccggcaccgtccactggggacacaagggatcgtgtcatgaagagcagggttagaatcgtgctctcacacattagtttctctctccaattttcccgaaaataataaaataatatcatgagtgtccaacagttaattatcagttttttacggcctacagcagatacgtcttgcggtgtccatcagctaattacacgtttttcggatgccttgtagcaaattttgccgttgttcatacgtggtatacatgtggcaatccaattagcacttttttattaaacaattcggtggggcccacttgtcataggcaagctcgaccttatctctttcccctctggcctcaatcatgagcttcgtcgacgacatgagggcgaaccaagcgtcagccaccgtccctcttcctcttttccccagcgaggcaaggcatggctaacatcttggaggagagagctatgcccgcggaggcgaggtgctcgccagctgtggctgcccctggtggacgatggacgacggagcttggagagcgggaaagcatccacctcgcatactccggctctgcatagctcacgcggagatgaagctcgagcggaggcaacggtgaggaggctgcagcagcgatgatgaacgactacaaggcagtgaccggtgaaccaagacgcacttgtgactcgacctcctctggtcgacgacttctacttgccgattgacatgcttgtggaggagagaaccacgccacgcgaagaagggattggtgtggagaccaagctgcggcatcggtggggagacgctacagcgaggtagcaggccgacaggctggtcaccggctgcatgccatgcacaacgtgggcacttgtggcccaccagccgcatcttacaatagcggacgtgggcacgcggccccggtgctaacctgcacaacatctccaccaccacctccccaggacaccgccaacgccgttccagttcctccatccgtagcacgagcagggataagcagatgtggccctgggcttctctgtcctaccacgctccgttgtcggcgccgtgggggaccagtatctgccgctgccatggacttcttcgactgcctccaccattgacgcctccttggccccgtcgctctcgcctttcctctggatttgaggccgccgccgctgtcatcctgggattctttggccgaccgtgcaccgccgcttccctgggcttctccggctgatcacgctccaccactagcgccccgggggtctagtctctgtcgttgtcacaccaccgccgctgcctccacctcctctgtgctcggttcaaggtagagagagagagagagattgagggggggggaggaggcagaagagaaggggagaggagtgctggagcactgacaagttggccatgtattttttaaatatttttttagccactttagaaatgtcatttcagccagcctagcccaaaatagtgctcgggtgtaatttgtccggattaaagagttgagggtttaaattgtctgttttttgaatttttttgtgggttgggtaattcgattgacaactatagtgttttttttaggaggggtggggattcggactttttcctagaggaaactatttgtctaaattagttatgccatcgtcatcagttgcatcttgtgtgataaacacatatatactagtccccactctattgtgtcgtgggaaaacagagagctttaacaaccattagctactcctcctaatgaattagcgaataatggtaaattttggaatagttattatgacattattgaagttgtcaactattatgtatgtgttaggaaaatgtccattctatacaacactaaacttttatataaatgtgtgcaaaacaacagtgaacttctaaaccattgtctagataaagagtgttttcagtgaaatgacgaccaagtggcaatgtagggagaagtacagcacatcgagtatttgaattgatgtaagccagcgctaaaacatttcttgaattttttaaattacttcaaatattcttaaaatattatcactatcttttggactatctataacctaaataaatttggcaactgtgaaacaatatgtagcagtttaggactttggtaaaagttgaaggttgtaacgtcaacagtttctcctctatatgataaattttattgttcattattactgctttttaacacccatggttcacaacacacttcacaccgaattcatttttccttagtagttggttgtcaacacattcttgagggaaacgatatatcctcaaaaatttatatgctactagcaacttgagaaaaaaaacaaggtccattttacaactttggattgtcacgcaagtttggttttcaatccaaaactattgaaatcattcagttttttatggtggtgcaaaattcgaatggttttggtacctaaacacttgaagagttttgaatatgtaaattctggaaagattctcacttaattgagagtatttactagtaaataattttggtatttataattgatgcagggtgtttataagtactaaaaccattttgagtcccccaataaactttactttctaaggaattaatcgatttagctatgttctcttgaaaagaattaataattatgagtgtacatgctgtcatggggatcaaaagtgttttccacatcttaaggggatgaccccttgttttctcaaaatactttcgaaaattaataaaaaaaacttataaaaagatgacattgttactatgtaacatatgataatcaaggaaattcaaagtctaaattaatcatctctcgtattgagaaaaaaagacgaatctaaactgtgaacaatacttaattacattattcaccactatatttctccttttctttttcttggtttgtaggtcgagttttgacatgagattttttgtgcgtgatagtttggtagatgtcaatatattatacattatcaaaagtttttaggttcatccataactatcagtattatcattatctcaaaaaggttaattggatacatgccattccaaatttgcatatttttaaaaaataccattactattcacccatttcaaatcatgccattacaactttacagaaatttgagatatgccactacttaccccttcgatgcattcattaaaatttttagaccaatttaccctttcttctttcttttcctttttttccttccttctctctcctctcttcccactggtgactagtgctactcactctggcagctcctccatctgcaactcactccgtcgatggtgcactgggaggttggggcccacggttcccctctcttcctctcccccagctactcaaaccgacggcagcgcatggcgaggtcagggccgatggttcctctctcttcctctcctctgctttatttattgctcctcatctcctctcactttagatagagcaaagtcggcgactttgccaccgtcgttgacctcatacatcttcgtctccgacctctccaccatcggatatgcttctatctccaacgggtgcactagccatggccatgttgaggggaaagggagagatggctggtggcggagtggaggtggagggggatggccatggtggccaggctaattggaaatgagatagaggagataggggaaggaggaggaacaagtctaaaatttttaataaatgcatcgaagggttaagcaatgacatatctcagataactgtaaaattgtaatgtcttgggtccaaataagtgaatagtaatagttttttttttaaaaatgtaaatttgtaatggcatagatccgattaacctaaaaaaatatcagtattgtatttgagaagcaaatttacacgagagacatcccagctatgtcgcattgtaacatgtgcccattgcttttgactattccattgctttgtttatgcagggaaagttaaagatagctagctagctataaatagaaaagctaagttagctaggtataagttaggccctgttcgtttgttctacgagtagagaataaaattttggataaaagtgacatgctttttaaactgctaaacagtgtgtttcgtgtgaaaactttctatataaaagttgttttaaaatatcagattaatctaatttttaagtttgtaataattaaaactcaattaattatacactattaccacctctttctttctgtgtgaaacacttaatcttaatctttatttttatattcgggagattcaaacaccacccaaggtctctctctaaagatgaagaacgagaatttttgctctaagggaatacactagagataggtctcacagatgtctgatatgacgtgaggatgcatttaatcctttctgcttgattcccatgcatgatggaaatattttgcatgtaagaacatctgtgtattacatattatatatgacatgcatatatgaaaaaaaataatgagagaacattctccaccaaggaccatacttaatctttagtgtacaaaatataggatactccacgtacacggacatatctgaacaggaatatcacatctaaggcctgtttagatcccacataaaaattttacaccctttcacatcgaacgtttgaacacctgcatgaagtattaaatataagctaaaaaataactaattgtaaagattgcgactaatttacgagacgaatcttttgagcctaattgctccatgatttgataatgtggtgctacagtaaacatttactaattaatgatggattaattaggcttaataaatttgtctcacggtttactaacggattttataattagtttttcattagtacccgaacactccatgtgatatcctatataatatccgatgtgacacgtcaaaattttacattcctgataactcttgagcaaatgaggagagtgatcccggaagaaaaacgactgcctacagattgggattgcttagattgtatctcaacttatctctcgagttctaccctaacaagggagaacacagggacataaagacaaggcttcccatgagacgagggtatcacgatctccatacaccaatgcaagccacgtcaaatccacattccgaggattcccaagtgttagccgtcaatcatgtcgccacgaccttaattatctcgccaacacaagtgttggttccattaggattttcatcatataatttgtttttattgtgtctaaaaaataatacatataaacatgacatcaggatttacgatttcgacggacggatttcgtaaaatttcgatgttccgacgaggctcggaagtataaaccgtctaagatttcagggagtttcatccaaattcaaatttaaattgataaaaaaatcaaataaaatcttataaatactatgatattaatagaacctattgggatataaattttcgaaaaaaatgatgtagtgtgtatttactgtaacttacattagaaaaaaaagaataaagaattaaaaaaagaaaaacacttacattggcccgggttgcatgtattaggcccagttaatagttggtccaaaatactggagcaaacaggggagtggcggcgagctgaaacgactgagtcaatatgcttttttttctttatcattttttctaatgggctggtcgagatggccaaacacacaggagctggtcacacaatctcttcgaccgtgttagctttccatcgatggaatgttacaaacaaaaaagcttccaatggattaatcgaacggctaattagttcacctggttgctgtgccaagagcgccatgtgacgaataataaaaattacctggtgtccaatactacatagtaattatttaattatttatttaattattagctagtatatgttatatttaatttaggatcggccacccacttttgcctaaaactgtcacatcgcccaaagcttctgggagaggattgatatcagcccagcaatctcagatgctcaaagcattcacgcgctcaaacgacaaacagcatccaagtctacctgctctggttttgggctctttggaataatcgtcagtcatcgattgacaagatcatcagagttgctgaaggaagaggataggcatgtagcatttcattgacaaggttgaggtcaaacttttataatttagactatcaatgactttaaaaatatttagtttaaaggaactagaacaacatatatagatttgtcttttaaagtactataataaaagtaaacatgcatttatttattatatatcttataatagaaaaacaaggtcaaagatgtatcttgtagaccgtgttattgtccaaaacgttaattaaaatgaaaccggagggattatgtttttcgtcctcgctgtaactctatactctactgtactcctctgtataccttgcaaacaatttgagcaatgaaaaattattcaggtgggaaatctctcccctccggtgattcgttaaaaaaaaaaaaacttatgactgcatacgtcactactacagaaagcgtttttgcatacgggcggaatcgatcttcacatgcggttggccggcccgcatgcgcgaaatggtctgcaaagatcaccatttgcgcatgcggccgtcgcagccgcatgcgaagattgatcttcgcatgcggtcacttaagacggccgcatgcgaaaatagatcttcgcatgcggtccatataagaagccgcatgcgaagatatattttcccatgcggtcgacctaagaagaccgcatgcgaagatctattttcgcatgcgggcgtcttaagtagaccgcatgcgaaattcaatttccgaatagctaaaataatatttattctagcattttggtgattcgtaattaatatgaaattattgagagatttattatcgtatttcggagtagtaagcatataagataagacaagtgccgcagtaacaaacatgtaatacataaccattaattcaatcgtaatttacatacaaatatataatacaagtggcacagttttttcatcatatgtataagtagtgtacatgttattgcatatgttctttctcccactctctgagaggtttaaatttgtcgtccattgcgagttcactctggttgtcgtagaagagacctcttgcgttgcagacatcgcgacggatgaatcggcagaggtcagcggccacgttcaagatagtagtgtggttgaatcgttgtgcaaaatatgggatttcggggatctgcacacagaaaggaaaataaaacggtactcagtgagaagtgtgtgcgagatgggtttctttgtagagaagagttcgatgacctactcggttactggttgttttgtacctcccatttactctgagcatctcgcacacgtaataaccacacaagttggttcctggtggttgtttgtagcactgcgatataattatggggaccgatctcagtagatatatttagtatatatgtactattcgataattagttgtattggtataaatttgatagtaccggccagccagtcctgacggataacttcttctgggatggaatatgtactggtccacctcttttgcggtagtacttgtgtgctctgtttgaaggaaacaattgttttattagtagttagaagactggtgatcgacctaaacaatttatagtaatgaaatgtttatcacttacaaattcaaaatagtgaggaattccataaatgtctccttgtcatagtgtgcggggtccaatgatatgatcaattggtctttcggatatacaaggaataatatgtagtggtctctacatataagataggcttattggagacagaaaattccgaagaagataaattaattaaacaaaaagaagagagagcttacgtgaactggtaggggaccattaagacatctttgtcggcgtgcgccaacattgctattgccaagtatgttgctacttctagcttcttcctcttgtgcaatgtcttcacatattcttccttttcttccggggtcttgccaaccaattgctcgcagtcctgtctcagctctacggtgtgttgtgttttgcatattcttgttggatcgacgtatccaacctttgctccagttctatcagcttcgtggaattgcatactgtacaatgaataaagaagaaatgagatttggtttatttgtttcgaatgaaacgtgcaacatgtaataaagagtttagacttacagacagaaagccgcaacgagattaacgtccattttatctagcttgtagagggcgtaaaggtcttggaaagagataaaaaatatcccattaggaccactcatgaaagcgccttccgggacggcgacgcttatgaaaccgagacctttcctagatgccttcatataccattcgtgcattaccctcatttcccatggtagcttgttcataagataagttggcaagaatggcttgccatactcataagtttcaggcacatcggcagataaccaggattgcacttcatcttgggccgctagtactgacttctgggagtctgacaagacgtgagcaagttcttttctcttctcagaattcctgaaagctgaaaacatgaacttctccttatccttgtcaatctcctttgggtcgtatgtcgatatcaactttggaattatacgacgaggttccaaagtattagactttggttcggatgtagtaccatctggtatgtgcacttcttctaccagagcagattggggtgtaggtggagaggtttgaactgagggcggagccgggggagcatgctgtttagttggggaggtgggagaggcttgaactggttgcggggtcgggagaggcggttgttgagaaggggagggtggtggtgtaggttggcgaggcggtgacctaagcggtggtggtgacggcggatgtcgaggtgacggtggttcaggaggcgacggtggtgcaggagcggcagcagtcattgcctgcgatgaggatggggttgaagatcctgctgcaagaacggccgcgctcaggattatgtctctgcggtgccacaagataaactgattcactgcatcaccgagaagttcaatcccctcaggtgcaggtatgtctagttccaaggaaacgtggtcgctatggaccttggcgacctgtacccttgcgtaatcctcagggattgccgtgttgtggaattgacgtccgggtatcgctaaacccgttgcaacctccttagtctttccagcgcggccgattggtacgacgagactgcacggagttggtccagttatactatccacagggaaggtacttgtctgcactgagcctacactgctgggtacattagttgtttgctgtgcggattgtgtgggttgctggctatcagggaataaccttggaaatgctgtcgggttttcagctgccaacgagtagaagtgttccttcacttgcgcatagatcttgtccgatagttgttctttgtatttgtctctcttcttataacttggtgcgtcttgtggaaacccgaccttccaacttgtctttgaggacaaaccccttacacgtccagagtgttcagccgtccccaacgccgcagtaagctgatctctctccctccgtgggacgaactgtcctgatctttctttctcgactatctgctgcaaattagtagtcacttcttctatgtctggagtctcgaatagtatgtctccctcatccgagacttgacctgtgctgcgcgcccaaacccagttcttgctacgttcaaccatggggtctaccagcaggggcttaccggccgcggcaaatctttgctcgatctcccgccattgatcgacgtgaccagcgtatccgctcgaccccaatctatggggatatctgttcttcttcgcgagctcggacatttttttcctcaaagccaatgcttccgctgttgtacgatccgcaacaaacgtgtcccagtcagcctgcgatatatgtccataatccgtaaacggtgggagattcttctgaacataatcccgatttagatcggacttccactgtcgccatcgatctcccatctttttaagtgcgtaatctctccccctgacctctgatccaggagggaacacaaaatacttctgcaactcattccagagaagtgtcttgatgttgtcgtccactgtttcccacaacttgacattaatgggacaacgcgtcctgactagagtgccacaggcgttgctgaacttggaccgcactatcggtggctcgatgggcttcccatcctgatcgagagcaatcacgttgtaagtttccttgggtaatttattcttgcttctctcaccacgtctttttttcccactcccgcctgcacttgtagatgtctccgtacgttcaggtgcagacgtagcggtgtccatctcaacttcttgctctgtcctgttcctcccggctttacgtttcgagcggcgtcggactaccatctgcacagaataggtaactctatacaccattaggttcatgtcacatcatagttagggaataatacatggctaacgattttcagcacttacggcctgttcgataggtatgtagtccggatcatcatcgcggggggcgacttgtgttatttccattggaaacgggtcacttggtgtgcgccacgtttcttcactagaagcgcctggctgcttattgctaccggaattttgaggagcgttaccttcttgaggcgctattggtgcgttcgatggaaccttttcgttcgacatcttccaacttgacgtaaaaaaatttgacataagtcccaattttacgtaagtcccaatttaacgcaatttcacataagtctcaatttgacataagtcccaatttaacataagtcccaattatacataaatctcaatttaacataagtcacaattatacataaatctcaaattaacacaggtcacaatttaacttattttcacataagtcccaataacttaatttcacataactcccaatttaacataagtcccaatttcacataagtcccaatttaacataggtcccaatttagcataagtcacaattaaacagaaatctccaattgacataggtgccaatttaacataagtcccaattatacataaatctcagtttaacaaaaatcacaattatacataaatcacaatttaacataggtgccaatttaacaaaagtcccaattatacataaatcccaatttaacataagtcccaatttaaacataagtcccaatttaaacataaatctccatttaacaatccacaattaaaccttctcaaaattaaacaatccacaattgcacatatcacaatccacgatgcacaattaaacaatccacaatccacaattgcacatttcacatttctaaaaagtaaatgttaccgagcgacggcggggacgacctggcggcggcgacgacctggcggcggcgatggcaacggcgaggggggagaggtccgtgcggcggcgacggcgacctggcggcggcgacggcgacggcgacggcgagggcaacggtcctggcagtggcgtcggcgacggcgaggggcggggcgacttcggggaggagccggcggtagcggggacgacttggcggcggggacgacctggcggcggcgatggcaacggcgaggggggagagttccgtgcggtggcgacggcgacctggcggcggcgacggcgacggcgaggggggagaggtcctggcggcggcgacggcaaaggcgaggggggagaggtcctgacggcggcggcggcgacggcgtggggcggggcgactttggggaggagccggcggtggcggggacgacggcgacggcgacttgggaaattttggcagcctggcggctagggtttcgcgggagctgggacttagaaaattttggctccccgcgctccctatatataggcgcagatcatcgcatgcgggcggcttaagggaccgcatggaaaaatatctttccatgcggtcgacataagccggccgcatgcgaaaaagatctttccatgcgggctgttaagccggccgcatgcgaaaaagatctttccatgcggtcgacataagccggccgcatgcgaaaaagttctttccatgcggtcgacataagccggccgcatgcgaaaaagatctttccatgcggtcgacataagccggccgcatgcgaaaaagatctttccatgcgggctgttaagccagccgcatagaaagatctttttaccaaaaaaactcatattttttttcctctataagtaaactgtccatatatatttttttcccaatatttcgccacaattatacattccaaatgtttttggcactaagaaaactcatgaaaattactcaaaactcgtaatcaaatgttacatgctaatgattacaacataagggggacctaaattcatgcacgtacatttgctaatgattacaacataagggggacctaaattcatgcacgtacatttggaatacaatgagaactaaaggttacgaaataactatgacttaataaccttggcaacaccatctgctcgaacgtacgacatatttgcttcatcgattgttctctcaaccttcttaattcgcataggaagatcagtaaacaatggtacatcgtcgaactggttgtaatcattggggtcttcgatgttgtcgatgccgacgatctgttgctttccggatatgacaatagtttttctttcatctgaagggtccttcacataaaacacctgagccacacgctctgctaaaacccatggatcatccttgtggcctgttttactgtgatcgactatcgttagcccgtagtcatcaacggaaacccctattgtgtctttaacccattcacaacggagcacagggatctggatgtttaggccatagtccagttcccatatttcttgaatggtcccataatacgacctcttttctccactcgtgtcaatcgcttcgacacggatcccactgttttgtgaggtgcttttcatgtccttcgtagtcgtactcaaggtaaatccattgatgtcgtaaccttgccatgaattgacaatacttgaaggcccacatgccaatctttgtaaagtaagttcctccacagaatcaccaactggcaggtttagatctttcaaccacagaggaaagcgacgcttgtgctctcttgatatccaatcattggaccgccctgggaagcaggctttgatttcttctaggtgtcgctcaatgaatggctcaacgatagcgagctgttgaagaacgctgttgtgtgccgcggacacctttttgtaatcattatcgaagaactgcttcctaccaacagtaccccttccagacaatctaccttcatgtcgatgaacaggaatgccaatggcattagcatcctttatgtagtccatacaacactcgactgcctcttcagttgtgtatccctctatcattgatccttccgggtgagcgcgattgcgtacatagcctttgaggatcgacatgtaacgctcataggcccacatctgatgtaagtataatggaccaagttcaataatctgagggacgatgtgaacgatcaaatgctccatcatatctaaaaatgatggtgggaaatacatctcaagctggcatacagtctcgacggcaaatgtctgaagcggacctaattccaaaggatcaaatactttttgcgaaattcgattgaaaaagtagcacaactttgttataaccacctttgtatggactggtttgactgcccttatagcaattggtaggaacactgttagcaacctatgacagtcatgcgcattgtatcccgaaatggacaaatcctttattgatactagcttcctgatgttcgatgcgaaaccagtaggcactctaaccccttgtaaacatttacagaaggcttttttctcatcaagtgtcaacgagtaacaagcaggaggaatctcggtcttcccatttggcagcagtactgggtgaaggtcatgccgtatggacaaatctacaaggtcgttacgtgacttcaatccatccttcgttttactcgggatgtccagcaatgtgccaacggtgctatcaaacacgttcttctcgaggtgcataacatcaattgcatgtcgaatctctaggtccttccagtaatctaagtatttaaagaaaattgagtgcttcttgaaaggcgacgcagtaccgttgtcaccatcagctttcttcctctttactgtcttcttctttccctttccatatacaaccttaatcttctttgttatctcatacacgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatttgtatgaagttttctccagacatatcagacatccagtcttccctttaatctgcccagataatgaaaagtttgcaggtaggtcattgatggtaacgaatatgattgcacgtagattgaagtgctcccgcttaaactcatcccatagtcgtaacccctctttccaaagctcctccatgtcctccatcaaaggctcaaggaaaacatctatgtcgattccaggttggtttggaccttgtatgaggatagtgagtagaatgtactttcgtttctgacatatccatgttggaagattatacattgtgagaaggactggccatgtgctgtgcgagctgcttaagtcaccaaacgggttcattccatcagtgctcaacgcaaaccttacattcctaggatccttagcaaattctgggtgttttgcatcaaatgtcttccactggcgagcgtcggcgggatgtcgaatcataccatctattttccggctctcttgatgccatctcatcaactcagcatcagtcgggtttgagtacagacgcttcaggcggtccttaattggtaggtaccacatcaccattgaaggaatcttcccgcgcttacccttatcagaatctggatcggtacactctgaatctacgggcccattccccgttttataccgacttgtgccacacgttgggcaacattccaattccgcatattctttacggtataatatgcagtgattcttacaagcatgaatcttttctacaccaagagataaaggacatatgagtttcttcgcttgatacgtgttcgatggtacaaagttaggcttaggaagcaacacacgcaacaaactcatcagatcattaaaacttgtgtccgaccatccatgtttagccttcaatctcagaagttcaagcactgaacgcaagactgtgaaatccttatcacatcccttcgtttcatcgtaaagaagatccttcgatgccttctctaatgcttgccaattctccaatcctcgtgacctgcccgctagcacctctggttcaacatggcgtagcatatcctctaaatcaaaaccaccatcgaaatcatcactatcggtggaaacatcgacaatcattctttcacgcgacatgtcttcgattataaaattctctgcctcattcatctcgaaacttaactcttcatcgtcatcttccggattggcgaattccccgtgataggtccaaaccttgtagttggcggtgaatccgtactccattatgtgacccaatatttcaccaggatctaccaacaatttctgattcttgcaatgacggcacggacaaaagatctttgtcatattctccctcaaagcatgctccttagcctgatcaataaatttagatgcttccttaataaatatcggctgcgttctccgcatctcatacatccatgacgaccgatccatctaattatataaaggcaaaaaagttacagataaaaaaatagaccgcaggtatttcatacaaaagtttaaatgcatttgtctcccaaaaaaaatacaacaatacatgtaactagtatgtacaattgattacatgcaaaatttgcccatcaaaacatatattttgaagctagattttgcaaaaaatagttggaacaaaccttgtcaaaatattaaaaaaactccactttccaccaacgaaatataacaaaaatggagccaaatgaagcaagatagagagttcttcacctttcgtatagagttcaagtaaaaatttcgagttgaaaacctccccccctaattggtgcttgctttaggagagagaaagcttcgttttcaaatggtcaagctcgggcctggaggagcatatatggccgatcatcgcatgcggctaatcaacccgccccgggggggcggtttttgcaggcgccaccacaagcggcccgcatggaacctaccgaccccctcgtacagaaaaacgatttttgtagtagtgcgtgtacgtcttccaaaagagtaaattgcaatacttattataaagcttgttattgatacaagctagatgcatacatacatgcgtgaactgatcatacaccctcttaaccaacacaagctgatcgaagagaccgatatcaacgacgaatcactaatatagtgtatgtgtaatatttgtgacatcaaaatttaaacattagtggatgcatccacgagaccgtaccacgattcatcacttcatttgtacacttcctagaaagagcatctccgataacatcctttccaaatctcactttccaaatgttcatttgaccgatttgccaaaaaataaaaagatagtcaaatttacctttcatttcaatagcctctctattacaattctctaatctgatagtgggtctcacatgtcagcctccctacttctttccccttcttctttctctccttcaccctctcctctatctcttctcttcctctctcttcttctttgccggccgccagtcgaatccgtgtggggaaagaggcgttggaggccgtgcaaggacagagacggtggagaccgcgacgagcaacaacagtgcagttgtggtggatggcgagactccaaatgatgagtcatgagagagactgtgatgaagccgaaagcgcagccagaacgtattcatcaccagtgaccggtctgacctcgtcgacaccgccgctaaaggtcagcaggccctccgatccatccctgccctatcatcgtcgttgcttgctccgccaccactgctacaactccttgctccaccatcagtgccgtcaccaccaattgatccgccaccgtcggtgtcatcactgcttgcgggtgggggccagtacatggcgagagagagagagagcaagagagaggggggggggcggggagccggaagaagggatgggagagatggtgggacccacctttggccaatggaagaggctggctacgtttagccattcggatggagagtctattggaactcgttttttctctatgttggagatgatctaaagctcatcaattttttttaatacaaactaagtaacacatatataattagataatcaaattaagagtatcttttattttgtcagatgaatttgttttacagattaaatagtatataatataggccgtacctgatctttgtcaaggttatggataccacgtacctaatagtagttgactaaatctcggcaggacccaccacataccatgtcctatacggaaacaacctgcggatataggaggagttctggataaggaaagacaaccagagttctacatagaaatgacaagaactactcggattgtatccatattggtttccttagttctacttggacaaggggacacctatgtgtataaatacaaggctccctaggaggagaggggacacaaccaacgcccaccatagacggaacaacagaagccacaacatacaagccaacatacgacaggacaagacgccggatatcgacttcagggataggcacggctagtcccctacggtgtctccagatactgtcaggagagacgaaagcgctatctctgatctcgccgggcacgaactcgaggaggaagactaccctgttatcgactacgagtcagaccttcagaccgccatgtcgacaacagttagataggctaccccacatattgtacttgtgtgatctagatgaataaagagcaacaacggcttcggccaacatgatgtagggttattacctgataattcaggggcccgaacctgtataaaaaggcatgtataaaaatctccgtctccatctcttttacctcagtctcgcgtataccctagtaccaacgatccccataccatgtaaataccagaatcgcgacatcaaatgtcgacagtggcgtaccaggtaggaggattttggtgcttcaggatttcaatgagatgggtttaagagatagattctccaacaataagctactcgacgactttggctatggggagatctaacctgaccggaatatgtctttcgacaagagcggaaccatagtcaccaattatttgatctctcgagatcaaccaagcttcgacgtgttgccatggtgtcggcatggtgtcggcatgatccaacattaaattctcgacgtgtgcgacatcaactggtgcaaggtatcggccggctgagtccaagtcgaacccgacaccgatccctaccaaccaaccaagcacgtcgaggagccaaaaatctaccgctggattagtactaccgtgttctaactaggacacgatttctagccacgatctactggtcgacagcctgacgtcaccctgcatgtccctttaccgagccaacacccatgtgcgcacgtgcatgtatattggccgaacagagctcctatatgtattttgatgacacatactccatgtctcccaaggtaattagtaagattaatttttaaattggtctactaattccgtagatacatccggcatatatctgcaaaggtacgcaatattttatacacaatttaccatacctacttttccgatctatacgatattatcagatctataatttattatgtttacctagagcatatttttttatacaatatctgttgcgcgggtgtccccgatgttaaatcgactacgatctaacgctggggctcgctctatcttcttctgtataaatcatgcttgtttacagtttacataatgccctgatatttaatctgctcgttatatcctgataatgctagaagatccatgcagtttttttgagtacatattcgatattatctgctatatatcttgtcttctagaaaatatttttcaggaacaattgagcactcgagtaggttgtggtcaagtacaccgcattatcgagaatgatctcgacaaatgcagagttgtttcccccaatctaccaacgaagaccgacgacctatctaatagcaccggccgtggctagactatttgagaaaaggttgttaacggataattcctcgtgaacgttgtcggcttaatcacacgacatgattgcaaacggacatctggatatgctacaagttgggtgtgtgagtcatgctggccacatgagatacacatgtaataaaccaactctagcgctttcattgttgttcgagagatgattctactcgctcgctggttctcgaaccagtacgtagcaatctcccacaccgcaacttccattggtgttcgagagatgattctactcgctcgctggttctcgaacaagtacgtagcaatctcccgcaccacaaacctccattggtgttcgagagatgattctactcgctcgttggttctcgaaccaatacgtagcaatctcccgcaccgcaacctccattggtgttcgagagatgattctactcgctagctggttgtcgaaccagtacgtagcaatctcccgcactgcaactttcattggtgttcgagaaatgattctactcgctggctggttctcgaaccagtacgtagcaatctcccgcatcgcaaacctccattggtattcgagagatgattctactcgctcgctggttctcgaaccagtacgtagcaatctcccgcaccgcaacctccattggtgttcgagagatgattctcgctcgctggttgtcgaaccagtacgtagcaatctcccgcaccgcaacttccattggtgttcgagagatgattctactcgctcgctggttctcgaaccagtatgtagcaatctcccacaccgcaaacctccattggtgttcgagagatgattatactccacaggtggagaaagcgtttgtagtaccggtttgtaacccccctttagtcccggttgtctaaccgggactacgaatctgggactaaagatagctatctttagttccgggtgaaataatcgggactaaaggtcgatttttagtcccagttcgtgttaccaaccgggactaaagatctgtcagccacgtggccggccgaaccatctttagtcccggtttgtgttaccaaccgggactaaagatcggtgtaccattttttttattttgcatggcgctgtttgctgcaaggttgattatatatatatatatatatatatatgtgtgtgtgtgtgtgtgtgtgtgtgggcgcgcgcgcgcgcgtgcgcatatgtgtatatgtataaatacatatattacacacatatgtataatttaaagcacttaacattttatatgcatatatattaccaaaatatatattaacactaaagtaaatgtgtacatatataaatatatatatacacgcatatatagtacaattcatttgctcgatagctatagatacgacttcgacgccggcgttatgtcagaagaggaaggaccgacgttatgaattgtcgatccatcgtagtagaattcaccatcgggattaaggacttcttcgttgatgaatcccattagttattcttgaacagccgtgataaaatccttgtgtgggagattatccctcatgtgaatacgctatcattcgaaaaataatgacatatcaatatatgaaattaataaacaacttaacaaatcgatacgcaatgaaattttgaatggtttatgtatacgtacatcgagctctcgtgtggtgtatatttggtttgataggcagtgggcatactcgcatatgtagtagccgtataagttagttccttggtcctgctttgcacacttcatgagaaacgatgagagatttaatataatctttatatttaactgtaattagagatttaattaaatacaattttggatcatgcatatactcaccggaaaatgaaacctccatccaagtttttctttccaagtcccgcggaccaatttacggaaccgatcccaagccctacatgtgcagttgcaagctatgattaattaattattacccgagatcaacataatagcaatagaatccccgcgactttggaatagatggtattatattacctgtctatcagttggaagaccttttcaaaaatcttctcctctttattcattgagtcatacacagtgactctgcatgcgtccaagtcgaagaataacaggacccagtggaatctggaatatgcgtgagatgagatatatatgaaaatatacatgctatatgtatgggaacgaaatttgttcgaacgacaataaaaactcactctgtgttgtacggcagtagtataaacgtcttgaaatgctgctgcgttaggagatggacgagattgtcctctgtgtctttctcgtacttgtcgatcatttcggtgttgattttccgagggtcgatgaacccagtatcgtaaaccccccgccgtcgggccctttgaatctccattctacaacaataaaatgaaattgttattgtttacatatatgacaggagctagttattgaacgaaacaaatcgaactcaaagatacttacaaaatccatgcgctcaaaagagagacgtcgagggcgtccaaatggtacagatcgaagacatccttgaaatggagccagagaacatcttctccttgcaagaagtcggggtttctgatcctcgctccgaacatctctctacccttggcgctcatttccatgtaccgttcatggaatttgtacatctgtgtcggtagggactgcagctgctcaggcgtgacaagcggtttaccgagttcaaacttgtatgccacttccgcctttaggattggtgtggctccaatcagctgatccacagttagaccggtatctgaaatgaaatccgttattccaaaattttcgccggtcaccaacggctcgacctcttggtttggttgttctccaagctgagggactggtttggacttcttgtgataggctttctgaagtgttcggtcatagtccgatatctttaaggcctccttgtttgctatggacattcccttaaagaagttcttcacgcttgggtcaataggtatcttcttttcattactccgaggcttgagttgcttcttcacttctcctgccacataagcatcaagctcctcttgactgcaatcgtacggcggctccttgtttgtggtggtgtcaactttcgccttcttcgttgcccttgtgtaggcaggcggtggagcttggtgagaccttgtcttgggaggtgcaggcagacacggtggaggtggaggaggcggaggagccggaggagatggtgcagggggacgtggcggaggaaccgaaggatatggtgcaggaggagatggtggagccggaggagatggtgcacgagacgccgcttgtcgcccagggaggatgatgtaccgcttgcaccatagtataatggcgtggcttgtgcctcgtagatgcgtctcaccgtttcctcctgggtagtccaactcgaggtcctcatacgcagcttccactagctcaacttcgaccctcgagtatcctgctggaatcggcctgcagtggtaagtccctgaaatgtccgttgggatggccattcccgacaccaccttcacgtgatgagaggttatctattagtaatcgacctaagcagaaacttgcggaatgtacaagtcaaaaaatcataaaactatgagcataccttgattgataagttcttgaagggaatatgcagctcacatggtgtccgttgcgtgatctcatcaacggggcaggtggtttcatcctgggtttgcatggcgtccatgctctatgatcctacctgccccgttaaggcacagctgttacgattgcctgatgggctaaccattgcaggaggaatgtacggctggggatcctgggaccgatgtgcggccatgcgttcatccaccttccttgccacctcctcttgcatgctgagctcggctcgataccctgtactcaagatctgcaatctttgcctcatccgactcctgtacgtgtggatgtcctccttgaatccaatcttccagggaatcacgcctttccctggtgttcgtcctggatgctcgggagtctgtagggcgagtgacagctcgtccttctctctgtcgggtcagaatgtgccctgagaagaggctttcactgcgtccgttagtcgactggcagcctcgcgtatctgatcgctgaagacaagggagccatcaactgggttaagcgttccaccgtgagcatagtaccagaacttcgatcgatccggccatttagcggtggccggttcgatacccctctcaatcaatcttgcctccatctcctcccacttcggcattgcgacgctatatccgcctgaccctaagtggtgatggtacttctttttggcggcattttctttgtttctggccatcatcgcttgcccttgttgccctgtcttgtaagcaacgaacttgtcccaatgatctcttagctttgggaatacgtcgaagttcggtgttagtcccttcaggatgtatttcttgtagagatctcccttgaagctctggaactgttctgccattttctgtagagtccactgtttcactatgttctccgtacccgcgggtagcgtgagcatctcgagcattgtggtccacaacatctctttctctgattccgggacaaagctgtcattatccccgtgtgcccttgttctgcgccagtacaccgtgctgacaggcacgttgtccctcacaacccaaccgctgtggcgtacaaaattcttggctgcttctgccggggcactaggtcggccgtcttcgtccacctcagttatgatgtgccgaccctctatcttcttcacagaacctcgttgtccacgtgccctcttctgtccagcggagggatgacttccactagcctcctcctcctcgttcccctccgcatccctctccatgttcccctcctcgttcaagtactggtttggatcctcgtttccctcttcttcgttccagtactggctacttccctctgcgattgtatcgtacagtatctgttcctcatcgcgatcagccatctgtgcatacaaaaaatatttgttaggtctataggtcatatttgctaagcgtaatattaaaactctaataatcttatattaaaattgtaataatcatatatgctaagtctaacaattttatattaaatcgctactaatcttatattaaaattgtaataatcatatatatatatatatatatatatatatatatatctatatattaaatctctaataatataataatcttatattaaaactctaataatctaataatcttatattaaaactgtaataatcttatattaaatctctaacaaacacttctttacatcacttgcctgcgcgaattcctttgatggctagctaccacttcggcttgagggacgacgacgacgtcttctctgcaacattaccaggaaaatgtattagtctaaacgggccaagttacatatattgtatttcacgttttaacatatatatatataatcatatatgtatgctaagtttaataatcgtttaattatctcgttcgtacacgttcgctcgcgttcgttctcacacttttagtacaagtgcatt

SEQ ID NO: 75648 - DNA, 7455 bp, Oryza sativa
gggagaggggaggaaaatgacaagataattgttgcgtacaaatcttaaagtatatctaacggtccaaaatttaaaagatataagctggatttcatgtcacaaaatatatagactttgatagatcctctcttagatatatcaggtctcttacaataattcgttgggcctaactaagccattttgtctaaaaaaacctgcaaaaattaaatcaaaccaaggcatgtcaaagtcgataatgcttgaagttaatcattctgttccaggaatatgtgctcaacttccatacgaaatggaacttaaatatatacagggtgaattgctgttctgaacatgtctgaaaaaaaacttgcactataatcggtttgccgttgcatgattatcgttagagcagctgcttcagttgaaacttgatactaaacgacttacatggtggtgtactatattaattaatctattactataatctatcgatcgggcaaacaatgagtattactcaattaattatgactgcaatagagcaatggcggatacagatgtgaattgaatatgccccctgaatgaacagaacggttagttatgtgttcaaagaagcaaggtataaaattattgctattgtacgtgcaatgaagagtgcagaccttgcgctcccactaatcgtagtggaattcatcagcaaaataaataaatcatatagaaatagagtttttttactattttcatcatacgattcttgttggttgacctcaagcactgaacaagataatgcaaattatttggctatttcaatgtctggctcgccagtagttggaacttgggagagaaaaaaataagcagcggctgcaaagggttcaagggagttgagcctgttgtagttaggtggtactgaaaggataattgattcagaaaagtgaaatactccaacgtcctttccattccaacttctcgcttgtccaattaagaactttgaaaaattccgtactaattaagaatttcacggaacgaatttaggtagccaataaatgagcagatgcatatttttttattacaaattaaaactgattgagaatttctcgttgagaaatctgtgtgtgaaatatttctgatttagaatttcatctctggctggtaaaactgatatattacagtttggcacatcaggaagtatatttaattttttttaagatgatggatagaaatccgatcctatattcacacacatacttaaagattacatgggtacttaaggcacattctaaagagataattgagcttaactactactcgttttctattagcatgttttttaaactattaaacgatgtatttcgtgcaaaactttctatattaaaaatactaccttttcaaaataaaataatttgatttatattttttaataattaatacttaattaattatatgctaataaagtttttattttgcgtgtcgctaaataagacaaaacgttaagctggaaagaacgtgtcctaacactccaaatcccataactgacacaaaagaggaaaaacaacaataagaaagataaattttacagttcctaagatgtactgtatcaaaacttttaatgcaaacttagctcctctcggtacctacttaactactataaaatcactaaaagaaaaggtaaacacgatatgtagttagaaagattgtatggctaacattcagtttagctatgcatgcttgactagcatagaaacattcgcaagcatgcatgttcagagcatttctgttcttgctgcgaaaacgcaacgacttgtgttcagattgaactgaataatgctaatatacgacttatcatttctgatggaggaaacggtacgtagagcttagaccagcaaaccaattaatcatcatttcgcataagtcaatttctggacgttgcagagccatcagccatgtgcaacgatcgttggaacagtgatcgcatttttcaataatgcctacgacaatcattcccttgcaatatgtaatccacgcctctgcatgcaggcctcctagatcatagtactatataagcaccaccattgccgcatacatccctcacctccaaatccattcatcacaacaatatctagctagctagttatctagcttaattactctcgatcgactgcacaggctcaacctagctaagaggaaatggggaacattttcctgcagctgctcgccgttgttgcactctgcattgcaccggcgaggtcggactggctcccgggcaccgccacgttctacggcggcgccgacggctccggcaccatgggtacgtatacgtcgtctactccacatacggcccaaatgtccgactcacgtacgactgaatttgatttatttgattgccatggattaaccggatgcatgtgcgtatgtgtgcatacaggtggtgcgtgcgggtacgggaacctgtacgaccaggggtacggcatcaacaacgcagcgctgagcacgccgctgttcaacgacggcgcgtcgtgcgggcagtgctacctcatcatctgcgactacagcaaggcgcccgactggtgcaagctcggcaaggcgatcaccgtgacgggcaccaactactgtccgcccaactatgacctcccatacggcggctggtgcaacgctacccgccctcacttcgacatgtcccaacctgcctgggagaacattggcatctacaacgccggcatcatccccatcctctaccaacagtaataagcacatttaccgacctgacatctcctgaatttgtatgtgtgaattctgaagcgaagcagtacgtgtgttgtgctaaaccgttatgctatgaattgcagggtgaagtgctggaggtacgggggcgtgaggttcaccatcaacgggttcaactacttcgagctggtgctggtgaccaacatggccgggagcgggtcgatcgcgagcatgtcggtgaaggggtcatgcacggggtggatccagatgacgaggaattggggcgccaattggcagtgtctcgctggactggccggacaggcgctcagcttcaatgtcacctccaccggcggccagaccatcgtcttcgacgatgccgtgccggcggggtggtcgttcggccaaacattcagcacctaccaccaattcgactactaagcagggttcagacgtcgacaacatcgagatcgtcatctgaaatctgaatgtctacgatcgatcattcttgtttgggatcatttattcgattgttcagttgggatcattcattgatttctaactgatggatgtaatttgagttgcaattcaaggaaatcattattaaattatgtgaaattgctactgaaaatcacatttcatcggtctgtatgcatcataaaatgtgtatgtgctagtggtttcttcggccccgtttggcacagctctagctcccaactccaacttacctagagttagagctgtgccaaacggtacagatcctccattttttgagtggagctagttgagctactcatagaaaatgaactacgggggttaggggtggacagaaaaagaccgaaccgaaaagaccgaaaccgaaaaattcggtcctaggtagtgaaagaccgaattttgttcggtcaatttggttagtctcctcggttaaccgaatagaccgaaatatcaaaaaattctaaatgcaacctacaatccactatatttaataggattaaactctaattttcacatccctacttcttctaggcatgcaacctaataaaagtctttactcataagtgcttaacgaatttttttgtgatttttgtgttgaaaatttccattttttctttgcatatatgaaaatattgttgaatttcggtcaggagcgagaccgagaccgaatttatcggtcctgactttttgcgctgaaattcggttttcatttttcaaagaccgaaaagaacgaaagaccgaagaccaagaccgaaattttcggttagaccgaatgcccacccctaacggggatggagctggatttttgctgctccacagctccactctaccccaaaagacccactaccctttaattttttagtctatttatacaaaaatgccactcaactgctctttcagtcctcctctcctcccccatcttcctcccgatccaaaccgagctgcatgcggggagcggtggcgtcggtgggtagcggcgacaggccgaaggcgcgcggaagacgacatgcggccggcggcggccggcgcgcctggggacggcgcacggccggcgggccggcggcggatgcggaggaggatgacagagcggcggtcttcttcaacccaggcatgggctctgggcgcaagggtggccggttgtttgtgcctgggtgtcacgccccgaactagtcccgaccggaactagcccgtgacgctccaaattaacctgttaatcgataccagtcccaggaaacagtgttggtatcacagggagacagaatatcacagcaacagaggtctctttattatagagtaggagtacagtcatgttgggctgcggacagatcccgagctcacaactgcattacaaaagggaaacggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggaattatttatatagagcaagggtgagtacgggggtactcagcaagccaggggaaataagtgtttaatgcaggcttcaaggagaggctgttgtttttgcaattgattttatttgaactccttttttctaaaaacgactaagtgagtgcttctcaaacgacacggatgagacagtgcgtctcgtccggtcggagtatgtgcaatgtatcaatctttagatcttgaaacaaggttggctcccggccaacagcttttcaaacggccacccgggccaacaacttttcaaacggccacccgggccaacaacatttcaaacggccacccgggcctagctgatcccgtcagctgctgatttttcaaacatcgaacccattttctcaacagcaatttcacaagcggtagtcaaacaaaactacgctaggaatcacctcacatccgcccatgaccgtgggcatggctgttcgaatagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaagggtgtcccattccacccatgtggtcgtacttgtcttatgtttggatgaaattccaaggaaacggtccttaagtgcaagagcgggaaaccgtacacctggtacgttccccggtccgcggttttggaaattcatttagttcacaagcaccgacccaggtgtcgggttttccaagtcttttgtaaaactcccgttttacccaaattgttactcagattttaagtttgaaggcgaccgtcgatactcgcacagagtgcacgaatatcgaggcgcaactgggtggttacaaggggacatggtatggcaattaacaatcgaaggatcaaatgcaacaagtcaggtaggtccaccaatctgccttgcagatgggacaaaagattaagtgcggtcctatcaatacataatatttttcaagcaatataattaaatttcaattataggctcaagatgttcaaaggtggcttgccttgctcgagatctggagcttgatcctcgaaatcctcgcactgcgggtcttcgggctctgaaactacacgcgaaacggaacaactcaacaaacggcgaaaaaataaagccctattaatgacctctaagcgtgccattagatagatctcgagatttgaggaattttggaagttgaacggagtcaaacggatttacggttgggaagatattgaatttctaagattattggatttttggtctaaaggaaaaaggatttaattaaatcctttttggaaaagaaaaagaaaagaagggagaggggggaatatagacttttctcgggcggctagggtgcggcccaagagatttggggcggctcggccgagcttaacgggccggccggcccaagacggcccaagcgcgcgcgcgcgggagggaggagagagagtccggtggaccgggctcaccacgcgtggccccgggtgggacccgcttgtcagcggctcggctcaccgtgcggagggagcacgcggcgcacgcgcgcgggcggggaggaacgcggtgcacgcgcgcggtccgcggcggacgcaggtgcggcgggcccacgcgcagcctcacggcttgcggtggaatgcgcgcacgcggagggaccgaccggggtcggcccgacccggtctgggctgagctggcgccgacgtggcgcctacgtggccgccacgcggaccggcgggaggtagacgacgatccggccgcgaatggacggcgggcggcggcggcgagcggcggagcgaaccacggtgatacgggcaaaagcgagcacaccgggcggttacacgagacgaggggagacgaaccaacggctcggatttgccgggggttgctcgacggcggcggattgcggcgtcggcaaccggcggcgggagaagagggaaacggcgacgaggccacgagaggtcgattcccggcggtgagagcatctatgcggcttcgggaactcgacgctagcgtcggattgggcggaactacgccgagcgaggccggcgacgagcgggtgctacggagctcgggcggcgacggcggcgagcacacggcgagcgacggcaacggtcggggcggcgccggctaactacgggaaggctactcaagctactaccgaaagctaggggaaggagatggagcgaggaggaagaacggagagagacatcaccgagaagaggaggggcgctgtgatgagaggccgacggcgcgggagtaatctctccggcctcgggccggggaagaggaaggagagggtgcggccggagtcctcttccgcgtccttgctcgtgccggctcctccgacacgcgcaacgacgatcggcgacggcgaaacagagggcggcaatggcgcggaggcgaaaaatgagggagtttggagggggagggcttgggcttaaatggacggcaatgtcggtttgggagaggggaaccggcattgaacggtcaaggcgcgagctggcgctcggcgcttgcagccaaagcggcggcaggaggatgacgccggcgaggagaaagaaaaggggaaaaaa

SEQ ID NO: 75649 - DNA, 7423 bp, Oryza sativa
cgggggagagatgggccgagctggattcggcccatcgaacccgggggaggcaaactagacttttgcggaggaaattgatttggagggatttggattcggaattgaactcgacgatagatcggggattgagatcttgagatggcacggacactagacaacaagcaaagaaacaaatttcgcaattagggtttttaagagataattttcccgctaggcgccacgacggaacgggcgctacactgggatgacaagctgcgaccgctccggcgccttgtgctgtggcggcgacggccggcagccggcggcgtgcctggggccgccggctaggtctctttttttcattttttttcattttttttccagatctagagctgaaaggtagcaaaaaacttttcaacttttcaacgagtcttcaactctaacaggagctagctctcactggagttggagtttggagccctaccaaacgaggccttcatcacgggctcctacacaaatttaatatggtggcccgatgtaaatatatctctttcgtcttcgtggaaaccgtatggacatattatgcgtcgtgcaaacttggtttagcttgtgagcggcatgcaaaacaagataagctattagcacatagataattaagtattaatcattataaactttaaaaattaacttaattgtttttttgaaaaagaaacatttatataaaacatttagaaaaaaaaaacacatcatttaacagtttaaaatgtatgctaatggaaaacgagaaagttgtagtttagatttgaaaaaactagacctaataagttgacattaatgtactctctttcatctagacattagcctttaaggccccctttgattcaaaggaaattcataggaattttaaaggatttcattccaatttttcctatatagccctttgaatcaaaggaatgaatactatggaattctatgaaattcctatggaatgcattttcccatgtaagttttggaggaaatttagcatgaggtagaacctcatgttaaaaatcctttgagtttttatctctcctcaaattcctgtgtttttcctatggctcaatcaaacgaccatttctacgtttttcctgtgttttgtaattctctcttttacacttgtattcctgtgagaatcctatgtttttcctattccttcgtttttttcattcctatgatttaaagggggctaagtgttggaattatatgtgctaaatccatgtagttagacaatagtttctaaaagaaaaaaaatcaaggcccatcacatgaaaggatgcacgtgaactttagtatcagcttactaattctatgaatatgagatcactttttttaaagtgcggtgctctctatgttactagagcaatatggatgagagataactttaagaaaagcgcaccttaaccactcacttcacggagttttgtcatgttgtcttagagtggctagaaattcaaaccgggtatgctaccttattcttttctgcttaatggatagattgattaacgatacgtttgctaaactgctaaacgatacaatgtttgtccctttttgcatgttaacatgtgagggaggatgttcatatggaccagaggatccaattgcctacgtacatgtccttttattgggcaattgactatatgtgatttatggactatgagtccatgattaacgacacgttcggcttaactctcgggcccaggcatgctggtaggccttcgatggttcggcccaaatccgtgcgacactcaaacaagttaagccatttcattttcaagaaatctcttcggtctttctgacagtttttttttcttttgcgaacatttctttgacaatttgctaacgtgtgtgatctgtatgtgttttccagtgcctcgttgcagtgttttcgcggatgcggctccatgagatgctaccggctggtctccgatctccactccttatcatttcactcagtcaatttcaagtttctgtacgaaacctttatatggttaaactggtaaatctaacagctacaattttcataaatcttttcttagatgtatcaggtactcttttataattcgatcggcctaaccaagctattctgtctaaagaaacttgcaaaaattaaaacaaaccaaaaacatgtcaaacgatataatgcttgaggttaatcattctgttccaggaatattgtgctcaacttccatacgaaaaggaacttaaatatataaaggctgaattgctgttctgcacatctgtctgaaaaaacctgcactataatcggtttgctgttgcatgattatcgttagagtagcttcttcagttgaaacttggtactaattaaacgaatatacatatttgggcatattaataaataaagtatactctatagtaattattgatcggtgaaaaagtgattaataatattctatactacttaattaattatgactataataatgcaatggtgacgcatgtgtggatcgagtgcccccgaatgaacaaaacggctagcatgttgtcaaagaagcaagatatgacactattgctaatggaatggttttttaaactcttgaagatgtttattgtatgttatccaagtaattatgaaataatttgataagatatataatatgtgttatatcacttcacaaaaattaatctctataagtttaaaaaataacaaatttaactatagtagttaacgtatatttatagtcaagtttgtcttttaacttgtagaagttgaattctaacttacatatttgtgaagtgatatattaatctatcttgacaaatttttttaaaaaaaattcgtagatggcgtgtgaagaacaaggggacattcccttgagagtttagaattgtttcccttattactggtgtcgatcgacaaaccggtattttgtatatgtgcagaattagttactccctctgttacaaaatataagcgatctccaatattcaaaattagtactacaatataagcatttctatgacactatgacactgattctattataaggaaattcataggttttcaacaagtcaagtgtttgggagaggaatataagcgattcaaaatttaaccattatggtgacagaaagggaatattttcccttaaccttagtgtttgtaaataatctatataaatgcttatattttgtaacggagggaatcctaattacgctgtaacacatcagaacaagaaattcataaagatatgcagtattctactagttgatcatacggttctggtggttgacctaaagtactgaacaagataatgcaaattatttgactatttcttcaatgcgtcgccagtggttggaatagaaaaagagaagaagttgtggctgcaaagggtttaagggagttgagcctttagttagacacttagacagtactgaaaggacaattaattaagaagtgaaatactcctactactcgcttgtccaattaagaaatttgaaatatcccttacaaattaagaatttcatggaacgaaattaggtggccaataaatgagcataggcatattttcggtgtggattatttctgatcgatatataaaattgacatgttacagcttggtacgtcaactagcagaggatatgctagtagcaataattttattttttgagagagaagcggaggatataatttcgttagccaaacagagtaaaacaaaatgccctagtcgactggaagaatggtactccagttcagctatagcagaaacattcccgtgcatgcgtgatcttcggagcatttctgttcttccctttcacaacgatcgacttctgttcggttttaactactcgacttgaagaatgctaacatacgacttatagtttctgatgcagcaaacagtgatcatcacgcgtaagtcaatctctggacgttgcagagccatgtgcaagattcaataatgcatatgcgacaatcattcattgttatgcaatccatatccattcctctttgcaggcctcctagatcactatataagcagttaagcaccaccattgccgcagacatccttcacccccaaatccagtaatcacaacagtatttagctgcaaggaatcaagctagctgtagcaaacagaggagatcatggggaacattctcctgcagctgctcgccgttgttgcactctgcattgcaccggcgaggtcggactggctcccgggcaccgccacgttctacggcggcgccgacggctccggcaccatgggtacgtcgtcgtctgctccaccctctggaatagcattgtcaattatgattgacaaatgacaatgttgcatgcatgcatacgtgtactttctctattctaaaataaatcaaactaaggcgaaccttactccccagcacgcaaaataaagtagcgtttagcacatcattaattaagtattagctaaaataaatttaaaaatagattaatatgacttttgaaagtaactttcgtatacaaaatttttgcaaaatctataccgtttagtagcttgaaaaacgtgcgagcggaaaacgagagaggtgagttaggaaagtagagataagaactcagccctaatgtgggatgtaacatctaagctcctagtactaagggtgtgtttagttcacgccaaaattgaaagtttggttaaaattggaatgatgtgatggaaaagttggaagtttacgtgtgtaggaaagttttgatgtgatggaaaagttggaagtttgaagagaaaatttgaaactaaacacgacgtaagatattattcaaatttgtagtattaagatatgtaacattttataataataatagattgatttattttgaaacgaaggaagtacgtcatatgcaacctgaacttgtgacagaatatttgggtgcatctgtacttgcaggtggcgcgtgcgggtacggcaacctgtacgaccagcgctacggcatcaacaacgcagcgctgagcacgccgctgttcaacgacggcgcgtcgtgcgggcagtgctacctcatcatctgcgactacggcaaggcgcccgactggtgcaagctcggcaaggcgatcaccgtgacgggcaccaactacggcggctggtgcaacgcgacccgcccttacttcgacatgtcccagcctgcctgggagaacattggcatctacagcgctggcatcgtccccatcctctaccaacagtaataagcattaaccaacctgacatcttctctgcatttctatatatatgtctgaactctgaaacgaatcaagtgtgtagtgctgtttgtattgaaaaatttgcagggtgaagtgctggaggtatgggggagtgaggttcatcatcaacgggttcaactacttcgagctggtgctggtgaccaacatgcccgggagcgggtcgatcgtgagcatgtcggtgaaggggtcatgcacggggtggatccagatgacgaggaattggggcgccaattggcagtgtctcgctggactggccggacaggcgctcagcttcaatgtcacctccaccggcggccagaccatcgtcttcgacgacgccgtgccggcggggtggtcgttcggccaaaccttcagcacctaccaccaattcgactactgattgagctatatatgttcagacatcaggaatatcagatcctcgtctgaaatctgaatgtctatctgatcgatccagcattggtaatctgtttcattgtaagatcgagcattatttgggagtaccattcatttgatcgttttaattgctagtcggtggatgtaaatcaagttgaatccactgctatctttaatcgatgtgaaactgtagtagtaccactgaagatcacattccatcagacttcgattacatcataaaacgtgtaccacatgctgatgacagccgacgagtcatattcctcgatggaagcagagtggcaattaaaggctacgactagagaggctcacgagaaaaatacatgtacaagtacgcaataatatcaacaccaaagccatcaaataattcgagactcgtacacaagaaaactgacaggaagacagcggttgagctgattctgaacgaagcctttcgtgtggaggtgattaccaaacgagacgagctacgcaggacagacagcgtcagccgctgtctggtgatgcatgacagcagagacagctctggggatcgcaacaagagcttttacttgtggacggacgcttgcaaaatccatcgacgatcgtgggacgtggctagctcggcgatcaatccaaaggagtaccaggagactactagctaggagtgtggaaccttatccaacaacacaacaagacaggagaagataaaggccccggattctcacgtaacagcgtgtgttttgcgcttgcgttttttttttttttgacttttttgcgcttgcattcgaatcacgttcctgtatcttcatgtttatgtcttctcatcagtcatccctgcatgcgttcgagagatcaccttttccttttctgggttccaaaagatccgttaaaatttggggcttatttggtttaataccctatcaatatatgttggtagtgccaaactctaggcaagttttggcactacaatattttagtagggtagaattgtaaatgagtgcatttgaatttataccaattgagagccaaattttaaattgtggtgaagaatattctaaaattatgccaaattgagtattggcattaccaaacatttggcttcaaaccaaatcatcacatttgctatttaaaccaccaaaaaattggtatggcaatattttggtatcaaaccaaaacgccccttaatataggcaaaatactgtagagatgcatttgatagtacagtgataaggagcgtattcaatcttcaacacgaaatattgcaccaatagtaacacgctagaagcatatctgaaaattcttggttgaaaaggcagaacaaagaatatatgctgattcactattgttttcaaaaacaaggagctggggcagtgagcgatgaggttgggcggcgaagggatgaggtcgtcggaatccagtaggccagtagtcgtaggccggagagacaaaacaaagatgggcggttgcccctccctcctcgaccaccgctggattttctcatcccagacgtcgcaattatttcactttcccatgacgtggatcctccgcggcatcccccgccgtcgatccggcatcggacgggccgcaccccgcggggccgcgtggatcccacacgaatacctaccggtgccacggccaggtcgggcccacgtgccagcttcccctccgcgggacgccagcgcgagcggctttagagcggcgcgggggggtgggccccacaccgggatagcaatcgtggccgtccgtgtcgatcggacggtggaggcggtgtgaacaggtggtcgctgcgcgacttgtctcctctctctct

SEQ ID NO: 75650 - DNA, 4179 bp, Oryza sativa
ggacaagcgtgccctggccagagccatccccagtctacaccccaagccaggagcaatggaggcggtgatcaccaccagaatggtcgatatggttcccatccccaagccgaggtagtggctggtggtggggggaacagaggggcaatggtggaggtggaggtggaggtcgccgtggacaggagcaccatggtggttttgatgggcaacgccgtggcggtggccgcagggacggccatgggcctggacaccagcagcgcggccaccatccatcttacataagggctcctctggctgttgtgactgcggcgcctcctccaccaccaccatttgttaaccctgctactccacaaacaccaccttatggagctcccataggcttccctggtatgccatgcatgtggtttatgagatcatagagttgttctattgttatgtcaccttaatttgcttcgtttcaaatagcagagatagcacctcatgtctactattttacgtctcccctggaaggtgttcaagcactgccttttgtgcctcacccagcaagccctccagctatgttaattcctcaatttgatcctcttcgagcggagctgctgaagcagatagagtactactttgggtacttttttgtctacatttacgtgaaatatttgttccatatcattgccgaggtaaatttactgagccacttgttcaacttttgcagtgatgacaatttgtgcaaagacatattcttgaggcggcatatggatgaccagggttgggtgccattacccctgattgcaggatttaatcaggtgagtttgcaggttctacatgatgttttttttaactaaaaatattgtcaatgaacctttacttcgttgctattgttcagcagattaatgacaaatttaccaactgccttgtaaggttctgctcactgtcaccatcgagtgagggacatagaaaactttttttttcttattagtattagatatcttcttgcctggttgcctgattgtgtgagaaactgcatgcacatttagatattattcaaaacttctgataagtgataacttatatcctgtgtaattcactacataaatgacaacaaacatgcaattgtctctattttttaagctgaatacatacaattgctcatgcattgttaattgtgtcgacaaatatgatggaagagacctcaatctattactgttgtataggcatatttctttatggattttccgaatcatatccttcacagttagttagtttggtgagtaccatttaccattgcatcatgggaatgaggtttgtattcccctcaggttgctttaaccatgccaagactcttttttggggttatttcttcctctttcaactacatatttcctaactttggtcttgtattatgttctttataatgtttctgtgccttccgatgcactatgtacaaaagtcttataggtttgcatactgtatttatgctttttttttttgtcttggtctgttacttcttattccttgtgtgtgctggggagggggggggggtttctgcaacaataagactgaagcatccaaaatacaattcatttttctatatgaacaaactttctgcaccttggtaattaagcatttaagttccaagagaatgactacgtctgaggactgaatctttcccatgaattgttacaagtgttaatgtttttctaaaagaacaaccaggagttataattgcactcaaatgtcagatatgttggctggtcataagcagggcaaagagagaaactagccactggaatgcaaaaagaactgtagaaaagagacaacaaaggtagaggctgactaaacagtgaaaaggttcttaaaagtgctaatgttgttgtaagacaattacacaataggaatgttttgtgatgcagatagttagaataatggaaataaagtgaatttgaagatgctctgagttgtttttgctttgcaccggcacatgggacattccacaatatggaatcatggacacatatttcacatgactatacatggatgattaaaaaaagagagagaaaacttattctatgccataacatcatgcatgtcctgccaaaaaatatatatcaatattcattggccaggaattaaaatagatattttgcttcttttacaactctgactgattctgacttatattgtttcgtgtaggtaaaaaagctgactaataacgtgcagtttatcttggaaacagttctgcaatctaccgtggttgaagtacaggtgatctttaattctcataatttacctttgaagtaatttcatattttgagtttcaaacagacttatctgccatatacaagtgctgtaatttataaatatgcaagtaatattcatgttctgctatgtgcggactgcggaatgtactgctggtttagagcatgtactataaggatttaggtgttgcctccaaaagtgccacataggattaggtgatgaggtgtagagagaggatgagccacccttcatgcaagggacaacctccgcacaatctccaagagaaaaagagagaatgagatagtgtgggagtgaaccaacacaaaaaaaaatgatgtttgtgtattagaggtaatatgttgtacatgttgcctcttaattaatggatagatgacatggctaaaattagaggtagtagccaactctactataagatttgttcttagtgagcagttttttttaagtatttaaacttgatttagtgagcagcttaccattacaaatcttctcttcactagatatttcagaaagggtaaacatgacattcaaatgggctgtaaatggcgtggcatgctgtataaaaggaacattctagggaaatatttttggtttctgatcttcaaactgacattatttagtttcagtttgtaagggatgctgtactttactgatgatctttagagcagcattatttagttccaatactttacattcaaaagcttgttcaccttttattacaaccaattgggtagctctttatgctatatctgcatgacatattagtttgcgtgtctacctaggtaactcggcctatatctgcatagcgtcttagcttgtatgcgcacctttggcgtaacgttagtagtaggaatattggagtactcagactgttgtgcatgcccaacttaagtccagttgcatccttgtagaatcttagtccaatcttgtgtgtacattggatctggatccacatgttgaaatgtgcgcacgacgaacattgccatggcgcaaaggaatgcaccattgatttttaaatagtatattttttagcaccctagatgatctcacatgccaggaagcaggccttctctattttttcttccttcttaacgcaggacttcaaaaatgaattgagagctgtttcattactaagttttacttgccaagttcctttggttaaaacttaatgtatatcacttacaggtacactcttaactgattagccactaggaaaaactgaatgtctctgaacgtaatgctagaacatattacgaggagaatcttatctagtgatagcaaacaagttgtcaataggtgtattcaataatgatcttaaggttttcctatagattggaattgtgatagcttgacaacactgttatttatcattctacttacccgcatattcacttaagttaaaaatatctaaatagtaaccaccaactcatctagaaatcactcatctatcctccttgattagaaatcactgtaataaacttctacagtagtagccttttcttttgtcaatcttctgaaacaatatgacttgaaggaaaatttcgtttagcctgtgacaccccaattgactccccaagacgttagaaacatcatgtacttttggtttcctatcatggcttcttgcttgaaatgagaatgacatgaatatgttttttttttaattctaattcacattttctccatacatctgagttctcgctgtgtttcttgcatacttactttacagggtgacaaattgcggaagcgtgaaagatgggagatctggttgcttccaaaacaaggttattctgctggaaattcttctggttcgctgtcccctgtgacatccaacattgtattcactggcatctcagtttcaatctgttggacttgagggggcaggctaccatgcaagtcaaggaatgcccggtg

SEQ ID NO: 75651 - DNA, 1569 bp, Oryza sativa
caagaagtttactccggagcgataccttttgaggttttacacaagaaagattacaacggcatgccgagttttctctggttacggcacgcgtacctcatctactggggtgaggagtgaggactaaaatccagttgatttggaagaaaacaaccaaaaaaaggaaataaaacatacaaaaaagagagatagaaatacccaaaaaaatataaaaatataaaaaccaaaaaaatcgaaaaacttaaaaacaagaggaaaaaacatagtaggtagtattatgtgcaggacttatgtattttgtggttgtgctcttgctgggacgtgagtacgtgacattacctgttaagtactcgtttgattgttgctcttttgcagactgagttgttatggatgttgtcagtcggaagctgttaaagacgagacaaacttatttcaaaaaactgatgacattattatcagttgtgcatcttctgctgcccaaattgtgcatatgcattgtatttcttttgaaaatcgtattcatgttatgtatactttatgctgatttggtcgaacgtggacatcgatctgccgctatgaaacatctgccttcttcggcaaaattgctgttatgtgcttctggcacagagatccttcctatttacttgggggaaaaaatcttattcatctctatagttgtgctcaagagtataacaaagttgtgggcaggccattgtatggtctgcaattggtattatctgtgaatgatacgttttattagtaataatgtcccttacgaaactttggtgatatcaaattatgtcattatcaaattttaggaaagtaagacggacatgtgtggtgttaggtttgagacattctggtaaggtttcaacagtagaaactactgaaaatgccacaacttgataagattgtgttgacttggtattgatctagtgaactagtggtagtatgtgttaccttgccaaattttaaatgtcaaaatttaaaattaacatgaaagagaacaagcccgaagatagatcacttctaaccattctatcagtagcaatttattttttaaaaaaaagaaggctaaagttttgcctcgtatatattgatagagcaggaggaaaaaccaaacaaccaaataagttatttacatgtccctgccgtaaaaaaaactgagtccgcaaaaagggaaactacgtaggttcttccaacggggttaactcagcgagttttgcggatcccgtcttgatccaagctaacgcctcctcttagattttagcgatgatggtggttggggtggtggccacgtggcagaatatcctagcgtcaatggcttcaatctaacactaaagctacatggtactccttctgtcccaaattatagggcgcttctttttttttttaaagaaaaatcaaactcggtagtttttactaataatcatactaactatatatatatatatatatatatatatatatatatatatatatatatatatatatatatatatatactaagtattatacatgttatatcactagattcatatttttgaagtactttttatatgatactccatc

SEQ ID NO: 75652 - DNA, 3960 bp, Oryza sativa
ctctcacaatgcctttctttcacaggagggtttaccggtttataggctttccaaacgaagggtatctgatgatcgatgatgccacctttcccaggtacttataccgatagagatggctgtgaaaaggataaacttgagacgcttcttgtgcttctgacgaaaaaacagtgtactgaaaatacaagcagaatgggctgagcgcacgcatctcgcgagtgtaccgtggtagagaatagtaacatggatggacgagtctggattgctctgcatgcttcccaaatcccaactcattagttggaaatggagctctgtccggttgcttctatttggatgtttccacgcgtgataggctttcttttgtgaatcaccttttcgcgaaccttctacgctcctttgctgttttggtcgggccgtgctgtgcatcttttttgtgagatttcattcagttccaccaagcattgtctagacagagagaagaaaaagatctctgttgtgaatcttcctgcatgaagaagccttatacgattcaggctgtgatatatacactacactcgccttcaatgtactatagcacgtctgaaatagctgaatgattttgcgaacaatatagagaaattcacatatataaagttttttgcgaaaatcgcactgttaattcaccattttattcactggagaagaacacttccttactcagttaatcaggtacttcaacaacaatagaagagattttttacctttgagcttttttacctgcttctggtttgatcatgctaccgatagaagagattgaaatgttacagtgatggaagccaaatacagcacaaaaccacttcctttttttctggaggaaaaaaatcggtgtaaagtctgtgtctaccagtatacaatttgcagtcatacaaataaaatcctctgttaccaatctaattgccaacaatattaaggaaacaatgtcgtattgcgaatacattagtataggctgaaaccgaagaactgcccaactagaagagctattcccatgcatattgctacaagtgaagccgcccaggtcagtttctctgttatcctagggaccttttctttcaaggcctcactacaagaacctacaaaagcagtgtaactccccatcgaaaatacagtccccatcaaaaacatgccaagaaatgctgcaccagcgaagcgtgagggaagggccaatgaaggcaacaccatcagtagagcatctggttggagaccatgaacaactccagtggcaaatgttgcaaaaccaactttcttcttcctgggagcagcaggggtttgtaaaggctcactgctggttatgttgcagtccacgccttccagggcgagcgacgattcctgaacctctgtagcttctcggatgcccatacctcctatgattagaagggtcagaccaaccactcttgttccccatgtccggagaatctcaatgtgcaatcgatccttgagtaataagaatagcaggccaaaaataacttgtcctgcatcatgaccacaaccccaaagggcaccgaccagtccactttccagtcttgatcttccaatcgacagtggtgccaaagcaacgagatggtcaggcccagacaaggtatgcaagcatccagcaatgaaaccagcccaaccactgcttagtatctctgatgtaaatagtccaccagttttggttattgattgcactgatgcatgggcaggataaggaatgctagattgcagggtgccggtaacaagcgccaccaataggaaaagagcagctctggaagcctgtgatatagcaaaatgttgactaaatcagaataatgatggggaaatacgattttaaaaaaccaaagcatatatgcacaaaaccaaaccagaaaacaagcataatgcccttgcttctgatgaaaaataatgtagtcacctccacaacaccttagctatatttgaagagctttagtaaaatctcaaaaacattacacatgtaaatcagtaaatgcaatcccatctagcatcagatactcacaaatgctactagacaaggtccatttcgtatacgcatatctcataatccatccgaagccacattccatacctaactagatcaactactacacttttaaacatgtgctgcatagcaagttatctaaagtaccataaaaacatgtcagttaagaaaacattaaaatagcaacgcattcttccaataaatcatgaagagaacattgggctagggaatgatgaatgcaactgattatcatggcattttcacagttgacggttgacacacagtcgaacatttttatgacctgagttaaataacataatagccatgatgttgcgagagaaaatgatgcaaatatgttataaaacagtgcaaaaattaaagacactaattcatgatatcatctctcactttgttcacagttgcaagaactatcacatagtgagcctgacacatttatgattaaaaattgtgtccgcaatggaaccccaatatggtacagtgctcactacaaaaatgataaaaacaaggtctacttttcaatttggctaaggctatgagatacagtttctttgggaacggaagaactgtgaggagtgagatctaatcagatgttaccaatttagcatcaatattaactaccaaatgtatcactcaaaaactaaagaccgcatggacattaaacgatcttacaacacaccttgttagttgcccaaaaccctaactacgatcacaggtatcttggagttctcacaacattctgggttagttttgataatgaagcactaaaatcatctctccccaaaacataccaaatcatcacttagtttcaagtgaaatactatacttcagatgtttacctacaacaaaattccgttttgtaacttgctatatacaggcagtggcgaagctatatagtgtttggggggtgcacatgaacccccgaaattcctaatttctcacttaaaaagactagaatatacaatgttgtactgaaattttctagattctcaatggtagtgcaccccccttgttttgatgctagcttcgcccctgtatacaggtctcacaattccacaaagaccgcatatcggttctttttcatacccatctagtatacagtatcttaaatcataaacatgattgtacataatggagcacaaattaagagtgctcacatgttcccctctgttctgctaaaataaagattttcttgtgcattggctttgtatttttccatatgaagtatatggaagcgccagaaaacaccagcttaatcatttatagaggtagagccaacacaaaaacagcatttcatttggagatctctttcatttgctacaaagcatactactcttctcatcccatacacagccgtggcattgtcaaagcccagtcgaggcatgtgtcatgctattcgatctcaaacagaaggttgtcatttgtcaagctgaacgaactttctcaaggggcataattaccacaattaagtactacgactagcactagttgagaacctaccatggcaattctaccgcgcgcatcattttcgagccaaacattgcaattccagtagatgaaaaaaaagaaaacccaaaattggggcagtcaccttggggagcagactccacagcaacttccacggaggtccaaccgccgccgccggagcggcctcccgcggcggggccgacacaccatcgtgcggccgcgccgcgatcggcccgagacgcggctgcgcccgtagcctccccgcccacggctcgacgccgccgccgccgccgagacccgcgacggcgaggcggcgggatggggatccgccccccggcagagggatccgggcggcgacggacttggagatcagccgctccatgcgcgccgccgcgaggaggagacggagaagaaagaaggcaaactaaactagaactagaagagtccaaggcagcgagagatcgtgc

SEQ ID NO: 75653 - DNA, 1928 bp, Oryza sativa
  unsure (1)..(1928): unsure at all n locations
agtttagagtaatctgacttaataatctagattacaggaattttaaactgaaacaaacaggaccgaaaaatatttaggtgagcgattattgttgattaattgaaagtatagtcattttaaatttaaaaacaggttaatgtatttcttttaaaaaataacttatctatattttaaaaacacaacatttaacaactaaggaaacatgcgcgtggaaaacagtcgctttccgttattctctcattctcacgaacgcacgaacactctcagtaatagtgagatcaatgaatcgtatatgtgcatctttcgtgtgcgcgcacccaaaaaaaaaaaaaactctgtaccacgtacagtcaacttgcatatcgcgaacagggaactcgccccgtaaggtgagtccgttcagtgtaccctcgccgccgtatcagcagcagcagcacatcgtcctcctcgtccattcgtccgtcctgttacgctgatttccgctgcgagcgccggtgatgaggtgacgacggtgtgacaccatttgactcaaacagcctctcctcgggcctcgtgccggtcaaatggcacggccggctccaagccggacatgccgncccgcccgcccgcgccacccgtggccgtcgcctgcgttccgcgggcttgggcccaaccccaaacaacacgtgccgatcgggacaggggccgcacgtacggcccggatcgctccggacgcggatcgtacagccagcgccgcggttgtcgccaccaccgtgtcttcctctccttatctgctagtactacgactacccgcggctaaccgagaaaacgaacaagcggaatcgaacaaattgagctcaccgtcgtcatagtagcttttacctaacgcttactctatttttttttcttctttaacaaggaccccatgcgattgcagtgtaggtagactggtgccgtcatttatccctgcccatgtatctagaccggatcgtttctacaaacaaatggtgtgctagatacggtcgaaaatgatcaaaaaaaaaaagagatacggtcgaaacctgcttaaattcggcaactgtttgctaaaaaatctgttcggcatgccgtatatgagtatttggtgcattttgggcgaatttttttcgaaaaatgtaaatgaaactcacgtgacatgcaccatcggagatacgcaaggagtttacatatttttttgtatgcattaattcggttctctaatatattttctacaaatttctttcttccaattttagtgctccctcaaaccgttcagttcatcgagtttaatgagatatctgaaatttatcttctcactagggctcatatttaaacaagatcaatttaacttataaacatttgggagtgttcggcaggccactgccacagctgcggctgcgcacagcgaggatggcactgttcatgccggctacgccgcagccacaaaaataatagccaacaggtcttttatattcaatataaacatttaaaggatatgaagctttgctaaacagagcaattataagccgccataatgcagaagctaccacaccaagacatccgtgtgtcaccagccacgtgacacggcgatgaatgggattttggatacaagacgcaaaaatacaacaaaggtagttggaactcggcgacgaaatccaccgtaccccgggttttgccagcccaggaacccccgcccgggaccctctgccagccagccccgttacaggtgcggtggccacccgcccacacgacggaccagcccaacaacgccgcggcgcctgcgcctcctctcggtctcgcggagtcggtggcgccgcggccgctgcggcgttgggcggcgcgcgcgcccccgaaggccgaagcgttacgtggaggccgcacgcacgccgaccccccctcccctcgtctccgtcgtcgtcatcatccactct

SEQ ID NO: 75654 - DNA, 5843 bp, Oryza sativa
gtcacgataagctatcattgacgatatctttagcccaatctttttttttcttatactacctctatattatgacgccctcgactttttatccaacgtttgatcattcgtcttattcaaaaaatttatataattataatttattttattatgacttgattcgtcatcaaatgttctttaagcatgatataaatattttcatatttgcataaattttttgaataaaacgaatggtcaaacgttaatcaaaaagtcaacaatgtcatacattaaaatacggagggagtacttacgtttatcagccaaaatttaaattttcaaccttaaattcaaaattaattttaaagttttcccatcaaaatttattttgcagtctttgtttgtagatagttaataacacatatataaaaaaattataaattatttttcgtttacaaatataccgcgtttagcgtattccctggataaacgaaacaatcgctttcttggatggatctgcgtctgctccatgagatgtggggtacgttacgtgccggatagaaatcacgtgtttaattgtgttatttgtttatttatttgcttgatgaggcattgtttgactcaatacaaaataaccgagagttgacaataagggcatgtaaaaataattatcgtgtcatgagtttgtgactgttgatactccattagtcacgagactcgtttttggtttgtttgaagcattatatggctgcttctctgatccgttttttatttaagtaaattttatagaactatttctacttttatcaaactattataaaactatagatttaaagaggtagtattacaaaccacatattaacactatatttttcacgaaactctatattcaaggtatgatatcataaaatttagtgatgaatttgtcaaaaacctaccgtactctctaccattggtcatttttagccgttagattaaatgcggccggatgtgatcgatcgctacggtaatcaacagtaaaccgataccgtatgagtgaacagtactccgacactgttcgcacagcgtttttactgtgtttatggcaagatattgtagctcctggcacattttactgtgcgtctcaggctctcagccattctctccgtaatatcagacgatgcaaatcctgaaatccgacactcgacagtcgacacccgccgagcaggtgaaccagtatcagccttagcgacaccttccacaattataccttagcctgtcgccaacagatcattccagaattatttccagttgcggcgagcagatcccattcccatcccagagatcatcgaggacctctgatctctcaaactcgtgccactcccgcgtatgtgggactacctccaatccctcgagcacccgctccttgtcttcaacgacatgcccatcgagcaagtgcacccgtctcatcctcggcgacgccttcatgacatgcctgacaaagccgatttgccaccctactgcattgaagccgacgacaacgagctccttcaggcaatggtactgacgatcttgagcttgcacgtctagccaagaagccatattttccgacctgttgtcaatctgcactaaggtttgagaattctcgtgtgaattcacagatatattccaaaaaaattgaagaggatatttaaggaaaagagacttgtagagtgcatacatgaacatggcatgactccaaaaccggcgcagcatcaagcagggtgacaatccagaatatatcccaattaattggtacgtttgcaatgaatagcttcttgagatgaagcaacgggtcgggtacagctattggctcaatccacacctgcacacatgaaaatgcaacgcaatttcacttagagacaagaggccactacactattactattagttcatacactagtgactagtctgttagttcatttcaggagtatgtatgatcgctcacctcaggtcctttgaactgcagaacaaggctctcaattggcgggatcctcttcaagaatttgctcagtggatatgttgtgttgctaacacttggatcgactttgctgtcgccttcggtttttagatagtccaaacctacatgccaagtccaggcacctcgccatagtatatcttggaaggcagtaggccccggcaagcaaaagtttcaagacagggcagtgaatgcagatagattttcccaaatttgcagttgtccaccagcagattctttaaccttgatgttgggacattgatacggagaccaccagcacagtaacccggacaatatccgatactaaagtccaatagatgcacacaatgtgtcaaaatccgattagccaatccaaagtacgaagttttacacaaggagagtctcgtgagcctctgaaacgtcaaggaattaaatgaacccaagggagggcagttgaacagaacgagccgcttcagctgcaaattctgacatccatcaagtatcttgaagtcataggcgatgcaacggccttcaacgttaagctcaaaatcctcaactccccacctggcaatcgctgcagtaacccatcgctgaatgaattggttccacttcctgccaaaggtttgaagccttagcttttggatagttcggtgcacaccatcggggggcagaaggaatgcatccacccgcttgacatagtgccgcatggcccagcgttcatagcgttccagggcagccgtgagtggacggatcctcctcgtccactgatccatcttgtccttcatggcataaaagtcgctcaggttcacagcatccctgtttgttgtcacatatggtgacttctctgcctcatacgctgccttggcttccatccacagtcgcttcaacctgtggtagcgtggagggaggaggtcatcaacggcgaagtcgtaacatgtgtgggagcgccgaggaagattaagccatcgctttgaaaggatagtggtggttattgttgtgcgtgcatctagcttgtcgagaatcaggatgagtatctcatcaggtaagctgctgagcctgtcctcgttagtattgcgctccttactcagacgcacctagtaaatttgatcagaaaggagatggaacaacagtaagctaactaaagccactataagtaattgtcaaggctgctagtgaaaaattttcagactaacagactacgttgcgacatgaacaatggaaaggtttaagtgaccaaattattaaaccaaactaaaacttcttgcagtgaaaggaacatattgagctgcgtgggtaccaataaggcaataacaacgggtattgttccactttcttgatggcgcaattcggactaaaaggggaaaagctcgtttctactgttaaactagtcaacgattattcaacactaatctgtaacactacgccaccgcgaaactcgccgccgacaagagagagagatatttagacgagatcggagttggggacgaagagaaacagagctgaggcagaggagagacagagtttggagagagataaattcgatttctttttgccaagttggccacagccattctctctctcgagtatttatctcctgattacatggaccgttggcccaaacgatttaaggcacgcaggccgcattctatttgataaagtctagcccaaaacacacacactatcattcacagttaaacctctttctcagtgtcaccattgccggtcatgacagtgccgcccgcaggagtttcagcttgtccccaagctggagcatctggaaagcgagtcttcacaacatgatagtcctcccaagtagcatgatctgctggtaataaagaccatttcagcaacacctggacatgagctgcattaccgcgcttcactagtcaatgctccaaaatcgcctcaggaacaacgtcagcagcatcaagaaccactggggatggcaaagaagtataaacaggagtatgatctggcacctgagctttgagttgagaaacatgaaacaccggatgcacagtgctgctggcaggtagatccaaacgataagccgccactccaatgcgctccaaaacagtaaaagagccaaagaacttataagccaacttaggatatggtctattaactactgaggactgagcataaggctgtaacttcaagaaaacagcatcacccatagcaaaaacacggtcagaacgacctttatcagccttgttcttcatacgcagctgggctcgagttaactgctgctgtaaaaattcagacaagtgctgcctttcagtctgaacatccaccacatcaggcagagtagccaatgtcagatcaggaacttgagaataatgaggatccaccccaaaaagagccttatgaggagaacagccaagagatgtatgataatttgtattgtaccaaaattctgccaaatgaattcaatggctccacttcttagggttagcctgagtcatgcatcgtaaatacatttccaaacactgattgacacgctctgtttggccatctgtttgcgggtgatatgctgtgctcatctgtaattgagtgtcccaagtagcaaaaagagttgtccagaacttgctagtaaagagacgatcacgatcagacacaatagaacgagggatgccctgagttttaaatacagttttgtccaccagatgagccacttgtgatgcagtgaatggatgacgcaaaggaatgaaatccgcatacttagtaaaacgatccaccaccaccaaaattgcattataaccatcagagcgcggtaaaccttcaataaaatccatggagatgtcctgccaggcctcttttggaattgggagaggagctaacagtccaggaagccgacagtgttcatgtttggcctgttggcaaacctgacattgcttcacaaaattttcaacatccaacttgagaccaggccaagcaaataatttcttaaaccgatgataagtagcagcaatcccagaatggccaccaagtgcagaagcatgaaaagcttgaatcaacttagtatgcagtcctgcattggatccaatccaaatcttattctggaatctaataatcccttgtgtcaatgaatacccttgagaattaggagaatgcacagccaactcagctagtagctgctgagcttgaggatccactgtataagaattgatcacctcctgaatccagatcggttggaccacagaaagagcacaaaattgagaggaggaaggcattctagataaagcatcagcaacaatattatcaacccctctcttgtattggaaagaatattgcaaacccatcaatttagtcattgccttttgctgtaattcagtccccaatatttgatcatccaaatgacacaagcttttgtgatctgttttaatgataaatggacctctctgcagataacatctccacttatccacagccatcataatagctagaaactctttttcgtaaatggacaatttctgattaacaggacccaaagttttgctataataagcaatagggtgactctgctgacttaaaacagcaccaagaccataagcacatgcatcattctccaaagtaaaaggaagctgaaaattgggcaaagctaacactggagtgttactcatagctgtcttcaactgatcaaaagcaagctgagcagcatcagtccaaagaaaggccttcttcttcaacaagagtgtcaatggtcgtgctatgatactataaccctgaacaaattttctgtaatagcctgtcagtcccaaaaatcccctcaattcagtaacagaagtaggcacaggccaagccagcattgctgctgtcttctcaagatcagtatgtagcgcccgttccgtcgtggcgcctagcgggaaaattatctcctaaaaaccctaat

SEQ ID NO: 75655 - DNA, 7224 bp, Oryza sativa
ttcccctctcgccggcgtcacctcctgtcgtcgctttggccgctagccggagcgccagctcgccggcttgaccgcccaatgtcggttcctctctcccaaaccgaccttcccgcctccaataaacccaagcccccccccctcccttccttcctctcccattcgcctcctcgccattgccgccgctcccgtgctctgtctcgcctccgccgtccatcgccaagcgccgggagagccggtgcgttcgtggacgcggaaggggactccgggcgcgccctcttcttcctcttcctcggcccgaggccggagagatcactcccacgccgtcggcctctcgtcaccgcgcccgtcccgcacggtagtgcctccctccgttcttcctcctcgctccatctcccccccttagctttcagtagtagctcgagtagcctcctggaagatagccggcgccgccccgaccgttgccgtcgctcgccgtgtgctcgccgccgtcgccgcccgagctcggaagcgccgctcgtcgccggcctcgctcggcgtagttccgcccaatccgacgctagcatcggattcccgttaccgcgtagatgctctcgccgccgggaattagcccctagtgacctcgtcgccgtttcccccttctcccgccgccggttgccgccgccgcaatccgccgccgtcgagcaacccccggcaaatccgagccgttggttcgtctcccctcgtcacgtgcaaccgcccggtgtgctcgcttttgcccgtatcgccgtggttcgctccgtcgctcgccgctgtcgaccgccgtccgttccggccggcgtcgtcgtctacctcccgccggcccgcgtggcagccacgtaggcgccacgtcggcgccagctcagcctagaccgggtcgagccgaccccggtcagtccctccccgtgcgcgcgttccaccgcgagctgtgaggctgcgcgtggacccgccgcacccacgtccaccgcgaaccgcgcgcgtgcatcacgtccatcctccaccctagcgccgcgccgcgtgcttcctccgcacggtgagccgagccgctgacaagcgggtcccacccgggaccgcgcgaggtgagcccggcccaccggctctctctctccttcctccgcgcgcgcgcatcttgggccgctctgggccgccttcttgggccggccggcccgttaagctcggccgagccgctctttctctcgggccgcgccctagccgcccaagaaaagtctgttttctctccctcctttcttttcttttcttttcttttccaaaaaggatttaattaaatccttttcctttagaccaaaaatccaataatcttagaaattcaatatcttcccaaccgtaaatccgattgactccgttcaactcccaaaattcctcaaatcccgagatctatctaatggcacgcttagaggtcatcaatagggctttattttcgccgtttgttgagttgtcccgttttgcgtgtagtttcggagcccgaagacccgcagtgcgaggatttcgaggatcaagctccagatctcgagcaaggcaagccacctttgaacatcttgatcctatatttgaatttaattatgttgctcgaaaaatattatgcattgataggatcgcacttaatctgcttgttccgtccgcatgacagtttggcggacctacctaacttgttgcatctgatccctccattgctaattgttataccatgtccccttgtaaccatccagttgcgcctcgatactcgagcactctgtgcgagtatcgacggtcgccctcaaacttaaaatatgataaacatcttgggtaaaacttgggttttacaaaagatttggaaaacccgacacctgggttggtgtttgtgaactaaatgaaatttctaaaaccgcggaccggggaacgtaccgggtgtacggtttcccgctcttgcacttaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcactgtatggtctgggacctaacctgttgttggtctgggacccctctcgtcggcatatggtaaacctgtgtcggctttcgaaatgccttgtcatgaaagcttggaggtcccccgacgtggctgatttccacgggctgggtgatccgggttagtaatgtcgtgtgggtaaagtgtaccccctctaaagaggttaacaaactgttcaaatagccgtgcccacggtcatgggcggatgtgaggtgattcctagcgtagttttgttttactactgcttatgaaattgctgttgagaaaaggggttcgatgtttgaaaaatctgtagctgatgggatcagctaggcccgggtggccgtttgaaaagttgttggcccgggtggccgttgaaaagctgttggccgggtgccaaccttgtttcaattctaaagactgatacattgcacatactccgaccggacgagacgcactgtctcatccgtgtcgtttgagaagcactcacttagttgtttcagaaaagagttcgaataaaatcaattgcaaaaacaccagcctttctttgaagcctgcattaaacacttatttcccctggcttgctgagtactcccgtactcacccttgctctatataaataatctccccccccccctcagttgctgaagaagatgaagcggatcccgctgatgaggagttcttccaggagcaagccggcttcgatgagttttagggtttcggcctagttcccaagtcgcgcctgtgatgtttggtccaagtcctggcttccgtttcccttttgtaatgcagttgtgagctcgggatctgtccgcagcccaacatgactgtacttctactctataataaagagacctctgttgttgtgatattctgtctccctatgataccagcactgtttcctgggactggtatcgattaacaggttaatttggagcgtcacgggctagttccggtcggtactagttcggggcgtgacacagtactaactcctttgtcagaaatgatatgtcctaagtattccagttgagtgcaagcaaaagagcatttagacctcttagcaaataactggtgttgcctcaaaatagcaaaaacttgctgaagatgatgcaaatgactatcaaggtcagggctataaactaagatatcatccataaacaccaacacaaacttcctgataaatggtgcaaagactgagttcataaggcactgaaaggtggagggtgcattcgtgagaccaaatggcataaccctaaactgaaattgcccatgatgtgtcttaaaggttgtcttggcttcatcagtttccaccattcgaatttgatgatacccagctttcaagtccagtttagagaagaatttagtgcctgagagctcatccaataattcatcaacaaccggcataggaaacttacttttaatggtgagagcatttaatcttctgtaatccacacaaaaacgccaactaccatcctttttcttgacaagtaaaacaggtgatgcatagggactcatactaggtgtaattaaaccagcatcaatcatttctttcacctgtttctcaatctcgtctttttgtaacggagaatagcgataaggtctgtagttgacaggagtagcatcaggtactagagaaatagcatgatcaaaaaccctatgtgggggaagacacttaggatcgtgaaagacatcgtcaaagtcagttaacaattgttgcaccgaagaaggaatcacatgctggacatcatcctgggaatgttccaacaaagcagcagcccatatttcacaacccttatgccatttcaaaagttgtggcagagtgacagcagcaatttcagaagggactgcagcatcttgtactccttgaagagaaatccaagacccttgatactgaaacttgagtgttttattagcccaatgacaagacatttccccccattgctcaagccagtccatacccaagatggcatcgtgaccccccaaagtgaccaccctcatgtcataagtaaatgtgtgcccctgaatccaccaaaaaaaaccaggaaccacatactgacaaggtaagcaatcaccattagcaactttcaccagagtagaaggaattggttttagaggtaaacccagcatctgtgcaaagttgtaatcaataaagttgtgagagctgccagaatccaccaaaagtaacaagactttactatgaaccaatgctctcaaacgaatagcagtaagaaggtaagctcctgtcaatgcattcagagaaatatgacagtcctcctcatcatcagattgttctgcagcaataacaacatccaatatgtcatcagtgagcacctcttccaactgcatagctttgatttggcctccaacagcacaacgatgttcaggagtatatttgtcaccacacttaaaacaaagaccctgagcacgtcgatagtctttcaactgcttagccttccatagatcccctttatctactcgacctggagtagtatcagaactgacatcactcttgtactgaggaagtttcacaaatttccctttgagagctttggtagctctactagccaagacagattcctacataagagcaatagcagatgcttgctgtacagtgtcaggcaattgaacaacaacagcagctcgaatttcttcagtaagaccattcataaaacgagtcactaacattttaccccccacagatggatcaaacactctgatctgatagacaagagaatcaaattgttgtttatactcagtcactgtactagtttgagtcagagtatctagtgcagacattttcttacgttccacaacaccctcaaattctgttgcgactgccattctaaattgatcccaagagttaacctcattcactaacttataagaatgataccattgagccgcatttcccgacatatgcaacacagcagcagagactttgaaattttgagtgatttggtacatgtcaaaataagtctcacacatatccaaccaaatccgcatatcagaaccatcgaaacgaggaaaatccattttaggaagtggctgatgacgccaataaatcccatcaccaaaaccacgacccaaatcaaccccatccaacataggaggaacaggtggattcaacggcggaggagtcgcagaaccacttgtactaacctgcgagatcccggaaggcgaacccaaaatcccggcctgatcagagcagctggccacccgcttcatcgaacgggccaactcagcacactcttgctgcaccttgccgacggaatccatggcgagatccaccttggtagtcaccttctcaagactgccaccttgggaatccagccgctgatcaatctcgtgcatccactttgtgatgccttccaacttctccaagagtttggactccatggagtccatagcttgcttcaaaggggctgaaagttttgcgggcgccgtggcgaatcaggaagaatccaacgcacggcgacacccacaacctgtctctgataccactgtaacactacgccaccgcgaaactcgccgccgacgagagagagagatatttagacgagatcggagttggggacgaagagaaacagagctgaggcagaggagagacagagtttggagagagatagatttgatttctttttgccaggttggccacagccattctctctctcgagtatttatctcctgattacatggaccgtttgcccaaacgatttaaagcacgcaggccgcattctatttgataaagtctagcccaaaacacacacactatcattcacagttaaacctctttctcagtgtcaccattgccggtcatgacataatcctacagagtacagatcggaaaaaaaggtgtagtttttctgtacaacacaactgcaggagctttgaatcaaaggatataacagtagaacgggcatatgtgatacccgcttggagggcggggaggcaacgacggcggtggcggtggagacatcgatggccttcctcaaccgacggtagcgtcgtggagccgcctcctccgtagccatcggatcttgattgtcgccggctggatgaccgatcggcggcgagggattggagagagggctggacggattcgagaaggatggaggcgcaagcggcggcagagcgattggagaggacgggccgcgagcggcgccgggggattggagggggaaaagctccggggcgtccgtacagttttatggtttgcatctcagcccgtttgtgttcggctcaacgtgtcctttccgatacgaaaaagctccgattttggccccctttttctgcatctgaagtttggacgcaactcgggatcggcgcccgatgggattcagcttgggtgactttgtgttggcatgtcacaacgtgacattgtgaggatctctgccatcaaaaacacatccaacggctcgtttggttgggcccgcctgcaggtcggaaatttagccgccgatccatccgtcccgcgggagatggcgcccgccgatccaacccatcccgtttcgcctcgcccgagtccagccgtcgccatcgccgtgagccagctgggaggcttgctgtcaccgcgcgaggccgtcgggctcgccgcgagtggggaggggaccgggcggccgccgcgcaaggccggggtcggggccctgccctgctgccacgaccgaggagagaagccaagccgccgcgcgaggccaactccatgccctgtcggcctgtcctgccgtgacctgtggagaggcgccagggcgtcgaggccctaccctgccgccgcgaccgggggaccgggaaagctaccaacagtacgatagaacatttttctctgaaactcagtcagtcaacacaagggagatagctatatccaattcactcacaaatgcagtgaaatcattgcatttccctccatttgaatggcacaaccatacatctcctttgaagtcatatatatcaagcatcagcgcgcgaacaccattctgcaaaaaaaaaaagaagctatttctatgagaatcaattgtggctagatgtatcgtcagacatgtagaacaatggctagaacagatgatgcatatagcaggtgcgacatttaattgatcagtgactgtatctcttgg

SEQ ID NO: 75656 - DNA, 5267 bp, Oryza sativa
agctgcagattacagaagaaaaatgaggccggttcaccacggctgcagatcaccacgactgcctggactggctcggcggcctccaaccgcaaccaccaccgcacgagggcaggcctggtggccgaccgctgctcgcgccggcagggccaccgcggcgatctcgacgctcgcgcgcggcggccccaccggagtcccgcggcgacaacccccttccgagcggtggcaccggcccccttccaagtggcggcggtggtggttctgggggattcgcgagcagcgtgctccggcaggaaacggagcaatgcggggtgaaagctgaggcctgcaggtgggccagcgcagtggacccttggatttattttcaacggcccagatcgctgcaatgtcacaccgtgccataccatggcaatgtcacagaatctgagtcccgcccgatgggagggggaaaatcggaagctgacatcagtataacacatgcgcgcaaaatcactttaaactattttttctcttaaattatttatccaagtcattgaaaaccgcatgtcgtaatattgagtcgatggttatgcagttgttcgctaactttggatggagattcataaataggattcaataatttttgtgatctttttatgctgtgagttttcattaatctgtatgcttttgtttattcaggtgtgagtttttattgagttggagtaataattggctatagctttttgagcaaaggcaaggattatattccattatctaaaaaattagatctatacatagtaaaacattatgagtacactaacatttttttttaaaaaaaatgaaacgaatttccttaacagaggatttccaaaatacgcgggcaatttgttgcaacggagtatgtggtggggccacgtggctggtgggggcaggaacatgtggtgggcccacagagcacgtgcgcgtatcgtgggggggagagcgaccgatttttcccctcctcgagcgaccgatcagcagcaattctgctgaagttctaaacgtatgagaaacttttggtgacagctcaaacaacgttggctagatgtaagttagtaaaatttattgttagaacttttgatttttttaatcctaatttgtttttagcttggcttttaaattttaagattgttttacctggaatagctctaatttacaccacctttagaataggacatgactatatagcgcacgatcgctggtttgattaaggccctgtttagatctcaccctaaaattttttgacctgtcaaatataatgtttgaacacctgtatgaaatattaaatgattatacactgtaattataattgttaaatttttagaaaaaaaattgtcgacagatatgtagccaaaagtgaactggcaataccaacgccgaacgcatacgcaacggcgtcatagcacgagtagcaccttttctcatggccctatgtatcgtggagtctgtgtgatatttgttgtaagtattgggaagtggaggaccagactttgcctaagctgtgcgtcgtcaagtttcaaccaggtcaggtgtgtgcctctcgctgtagtagtctctaccattcccagcgcatgaaaccgaccgtaatgaagaaagcccacgacgcaccccaactacccaagtgacactcgtcactcgtgccgtcggtcatgtgcatgcaccacgcacgcatggaatccacggcaacagcggcgacgcacgcccaccacctctagactctagtagttgtagtacaccccaatgccacatgcaaaagcgaggggttgtttggttggcatactcacattactaaaacgtgccatactttatttagctaaagctgtttggatgctatattaagtttgccaccattcaccatactttttatgctacacttgtctaagttgtgacttacaaaaagtgagccacaccttagctagcaaaattgaattatgccacactttattgagttgatgatatgtgggacccaaatagataagaagtaatactgccacaagtgtggctataaaccaaacaatatactaacttggtcaaacttatctaacataagttgtgataacctttggcaaactttgggagcaaaccaaacaacccctaacatgcctaacatgtggctaacaaaattgaagccacacttcaactataggagagcaaacttgccacacttttatgtgtcaatgatatgtgggacccacgtcatggtgaagaaatcttatcataagtgtggcacgaaccaaacgaatgcctaacttaattaaacctggctaatttgagttgtgtcacagtgaagcaaattgtggcattgagcctcacagcccctcaattctgctgcgggtcgcgactttgcgaattgcgagtagttggcgcacgtactactcctactacacgtccactgcgtgtgtctgcgttcccggacaaaattgccagccagtgcacaagtgcaggcgtgcggccacttcccaaagaaacccaagtagtggaatttccggaaattaaaacagcataaagtgctcctaccactcctactagtagtactactacttctacccaacaatcattccaaccagtctccaaacaaaaataaaactattgcaaccagcctccaaaaaaaaaaaaaaaccttaccccaaccgccaactcacgggctttggcccctggcacggcagccttaacaccctgtttaattccatctccatgcctcatacctacccactaggctagcacccacgacacacataaaccgagcaacctgtgagcagatggccccatttgtcactggcaaatcgtggaggcgacaccggtgtgaaacaacaagccgcacgaccccccagaaatctcctcctttgcctcggcccctcccacggcgagagagcgtccacccgacgctcagcaactggagcaagcacgggcaacgagtcgcagtaaaacagcagtgcggactcggagacagtacggggaaaacgcacatcgaacggtggagagtggagtggagtcgaatgcagcgcgagtgagtccagaacgactcgtctcgtaacaccgaagcgaccgagagcgcctactgccgcctactgcgcctgcgctgccgccgcgcaagcccaagcgcaacgcatccgcctctgcctcatcctctcctccacttgctggtcgctgccattgcctgcgcctccactccacttctcgcggctcgagaggctgacggcggggcgcctcgaatttcgccctctccgacgagcggaggcggaggagggagcccaggaagaggatgcgaaagcagtgaagtttgtagaattttcagttgcattttgctgtttctgcttgggagttgctttggggcgataagaattctcttgttgatttgttcctcgcaggagaggaggagaagaggggggaacggaaatctcagctgctgcgtcagtctcgcagatctgctccgttgagctgctgtttcacggaatcaccatgggtggaaatcatcgccatgggtggtaggattggttgggtgtcgccgatcttctcgcttcacgccaactaatcgagtgaattgtgggaagaagaagaagaagaagaagccgagtagacgacggcaatggcgtcgtgggagaacctcggggatgtggcgaccgtcgtgcagctgacggggctcgacgcggtgcggctcatctccatgatcgtgaaggcggcgtcgacggcgcggctgcacaagcgcaactgccgccggttcgcgcagcatctgaagctcatcggcggcctgctggagcagctgcgggtgtcggagctcaagaagtacccggagacgcgggagccgctggagcagctcgaggacgcgctccgccgcgcctacctgctcgtccactcctgccaggaccgctcctacctctacctcctcgccatgggctggaacatcgtgtaccagttccgcaaggcgcagaacgagatcgacaactacctccgcctcgtcccgctcatcaccctcgtcgacaacgcccgcgtcagggtcggtaaaaccatatccctttcagcttctctcatcagtgttcatttgtttaatcgtgtagttgagtgttagactagtagcctgggcatgtaggcttttaagaaatgttggttgcatcattctttgattctaaagtatggtatatggaatgtttgcttttgaaattggatggaaaatgatttgtcttggattcttggtggttttcctgtatggtctcatgggttctttgttttctgttggttggtgtgacccaaaggattctattttagaatctatcttctgaatataaccgacgctgcaaccttttggtgctccatcattttcatcgtctatataatctgatttttttgttggtgtgaatgtgacccaaaggattgtgaaggtatatgtatatgctaggaaactgattttttttttagctccagcacagtgagctcaatcactaatcatgccacttgggactagtgatctgcatcggatatcatgtttatttactcctatacttgtcatctttgcttcacaatccttttttttcaggagcggatggaatacattgaaagggatcaatgtgaatattcttttgatgatgaagacaaggaggttcaagatgctctgttaaaccctgatccaagtacaaatcctacggtagtgctcaagaagactctgtcatgctcttatccaaacttgccatttaacgaagcgcttcgaaaggaaagtgagaagctccaagtagaacttcaaagatcacaaagcaacatggatatgggccaatgtgaggttattcaacacctcctaggagtgactaaaactgtggcaagttcgattccagagaaatgtgccactcctaaggtttctgaaaaagctgactctaatcacacaaaagtcagtgaagatagtgcaaaaacatatcatgatgactctccaaagaagcaaaaggatgcctgcactgcaccacggttagtaagtttaactagtttctttcggtgactatcttcttatgatgtgggttgcagtggtaaaaaaggcagtgtataaaaccttttctcattaagtaacattaacctgaacaattactatggccatttctgggtaaatcatgaaaaatgtgcgcattcttccttattttagaggtgtaagtcttgtatactcaactgtgtgatccaacaaaagagaacttcactatgttctgttctagacttgaaatagaaattttgttatgtgcttatgcccctcaaaatgcgtatgcacattataaaaa

SEQ ID NO: 75657 - DNA, 8263 bp, Oryza sativa
ttactgaagaagtagtaatgctatgatagcagctagcagggtcaaagatgatcagttctactaaaaaattatatagaaattagtcttgttttgtctttcctcggtacttgtcaattatatggaaatatttgtgacatatttttttttgccatttatttacatactgtgatagcacaggtttgagaacattagtgcttattaattatatggaaatatctgttacatattttgcttgctatttattacttgttgtgataacacaggtttgagaacattctttttcccctgtggaacattctcaaagattgcttcaattgcgaagaacaggcccatgtgtaagaatatttccctgacaataatcatcatgttgagagttgataatttttgttcctcctagcatttttcttcatttccctgaaaatagtcatcatgtattatttgcctccacttgttttactatggtgctgacttttctgcatttggatagtaatttccaagggtgtgcagtatcttgtttatgttagctagtgttagaccaaacagattggccttgcatgttctctgcatcttgagttctaaagtttgttgtcaacaaaattctccatcaaaatgcttccaaataggattctatgccacattttctgtggactgaattacttatgtaatctgaaaggctggttgacactgataaaaaaaaatttcagcatcgtcggaagcatgcaatgatattatggcatattccctgatattatcctgctgttgttacacttgctgtgtgaggagaaagcttcgtcaaaagctaaatattgcggtaaattttcctgtcccttcatatctgttgtcaattgattttttttcctgcttctctaaagtagaagtgcttcattctgaccctacaatgtgaaactgagctacctctggaattgttacagctccatgttatacactatgggtcatttcagaactgattaactgaactagactataactggggctatgggtcattttggctaaaggattataaatgaaactaacttaacaaaatgtctgtctgtccattgctaatgcagaggtttgttaaaagattgggtagagttttatctgaaagaattaccatgcacactatggagcgttcgtatatcctaagagccttttatgttacttaaaactctgtttatgttatgccgctgacagggaggttgcattgatgatttcctatcacatttgatgtgttgttgctgtgcgcttgttcaagaatggcgggaagttgagattcgtggagcttatggtgagtttcctacttccatgttatccaattaaccagttgagcacgtggatattatagggaatatacatggatgatggagtatatataacagtccacatttcctccttaacagtatcctaaatactagtatatggcactgttgacttttatttggtcaatcttttgaaactttgaccattaatagctctgaaaacattaaaaaaaacaagtggatatatttttctttataagtacatttacaatattacaattttgttagaaatgatcttaaattctaattgataaacagtgatcagcgttgctcactgaacacggaatgaattcaacagtgttatatatttaaaaacagatgtagtaaatgggaaggaagattgtattatagtgatatggtctcgaatcttctacggttgaaacattgctctgaaacatttcatgtcatcataaccctgccgatctcaaagacaagcacaacatgatttaaattgcacaagcaatattaatcagtatgcctcatttcctgcaggagagaggactaagattagcccaccctcatttcagtacatggaacactaagcagcgatgcaaggcttgagcttctgtgaagataatgacctaaaggctagagcaacccggtatcgtactacaatagtaatgatgacacagctacaacattgttgtatttatgcttaccctgcattgtttgtgttggtactctgtttatagtaacatcagttggtgttgggcacagtatgttgtatgtagtactttgtaagaaaaaacacaagttacatgccctcgttgtgctcgtctctgttgaatcccccatgcataatttaacctttagcttcatttgcactataaaacagtaacaatattaaaaaagtctcaaattgcaaaggcaatggggtccagaaactcggaggaagaaaactgttaacaggtttctcaaaaaaaaaaaaaaactgttactagtagagataaacaatgcgatgctgggccatgcgaacatgatgcaacaattcaaacaaagaccatcaactaaaaaacattagactttcaccatgagcttccgtttaccacgacgtacataagcttccaaggctcaaggcaggatgtatattttggcaatttaagcaggtacgtcactggccgccatcttatttatcagtatcttggcgaaatccatttcataatcgtcatgtgaagaattgttaagcatgtgaacagtttcacgatgacgcgatccacgggacacgcagacatacatcaacgaaggtcgttgagttgagatgaccgtcctaccagagttcctccaggcttcctgtcgaaactcaaacaacaccggcagatcgatggcctcaccgggcgtagcagcctagggtgagtgcaccggatgcaatctggccgcacgctactgctttcagcgaatcgaacggaacaaggagttcggataataaaactccgaaccccttttcaggctgcagtagaaccaaagcaagggttcgggaacaaaactcctaacccgcgtagcgcaggtgaccgtcgtctttgtgcccaactatctctgtagattgccatctcttgctctcgcaggctgcagcagaagctcttgataatgaatcaatgctggatgaatacaaagttcagcacattattggacgggatcgcaatgcaaaatcaccgcgctcggaggcagcgttcagcgtggccgtgagactgcattgggcaaaaagcgaaatccaacaactccagcgtctcatgctctcagccctgtcaaactcaaaaaccggaaaatcgatcgatggcctcaccgagccacgtctccgccttcctccagaccacgcagctgaaacaccgaatacgaggcccgcgaccaatgtaccttaccgaagtgagtattagtgtgggccatagtaactgggtagtagtagttgttcatagcatccacagtgtttatgtaggggatgggaagtaaggtggggcccgctttgaaaaaaaacgcaagttcgctatagacattggcttgatgtgtcagaaggtgcttatacctggtggtagcactactatccggtattagttcttcaccacctccatagtggttattacccgataataaggtaatatttaatgcttactactccctccatttaacaatataagttattttagcattttccacatttatattgaagttaatgaatctagacatatatacctatctagattcattaacatcaatatgaatgtgagaaatgctagaatgaattatattgtgaaacagaggaagtacctgctattttgctacactgtagatgccctggggatcagagaataaaactccgaaccccctgcaggcagcaagagaacctactcagcacaggtcacaggtgatcgttctgtgtgttgcgctgcgcccaactatcggctcgccttcgccgccgtggcgtctctgtagactatcatcccttgctctcgcaggctgcagcacaagttctttagtggaaatggacaattctgggctaataatgcagttatgtgtttggttgacttgtcgatttcttgataatagataggatcttgcttccgaatcgagctcttagtcatcgtcttgaaggcgtcgatcgtcgacggacaagaagtttgtcaagttagaattcctgcctttcaaatttcgaaggagattagtcattttggtatgaattgctgaggtgcgtcctcttagtaaaactgtaatggcatggacgtacaaataacagaaaccaccattgagttttgatgcaaagttaagaagaaaatcgtaacaaattttgggacttatactcgttattgttgcccacaattgacctatgaggcaagtaggaacagatatgtcgcgctctgaacaagtagcagaaagacagaacagttaaaaaagatctatcttttcgtggcgcaatttatatatatatagttacaaacttctctatgtccaatcatctggtaagaacgggtgccatcctagcagaaatccagactcctgttagtgcactcgacgaccgattcgctagctggctgaagtcttcgttcttctcagagacatgtacgctagaaccctgtagccgatgatcatcgcgaccagagctacaacttctgtcacgccgttgtcaagaggtatggcattgatcagaatgtccgggacaggatgatattgcaccttcagcagtagcctgtacgtgtggtagttgaatgacaggtagcggagccaggatatgaatggtggaactctctgcatatcatgatggagaagagggcaatgcgtaagacggagtaaagacttgttcattcagtatgttcttcagcattgcatcagtaacacagggaagtgcttgctctcacctttacaaagaaccctcctgctagcatgaatgtcatgactgtaactgaagctagagttgttgccttcttgatatccaagaggctagctccaattgccaatcctaatccctgcatgattacttttttcttgagtaacagatttctaatcactgctaatatccttttgaaatatctaagatatatgatggatcaaccaaaatgttccctaacttatgaataaacacaggtgatgactacaacttcatgggaaaattccttggattttgttcccatctcaccatctatttagatagttttgatgttcatcatacattctttttctcatgtaattggtgtgtatatagacagtacaagttcaactaacagaataaacttttagaaaaataaaaaatgctataattcatttcttatataggtttcctcctttagaaaagattaagggccagtttggttcatggcctatgttgggcttaccaatttatgggtcaagtaaacagtacaaacaaaagtttggtttggatccaaatatcggccagcctgaggagaaagaatcggccacgccgtcgacaggagccgaatcgcgggcgtgaaatttgaactcccgcgcgcgcggccacacatcgaccatatgtattctacgctgcacacaaaaatataagaagataagctctagagttcccagttcccatttgtcctctgttttttgacgcccttcatcttctccatccaataaccacatctcctccaaatcttgaccaagaaaacccaagaagatcctcatctggtcatacacactcatcttctaaaccaaccgaaacaaataatagctcaaatggggtagagatttggggctacatctaggagggatgggggcgagttgaaacttgaaaggggagtgactgctcaggagaagaacaggacgagtacgtgtgttgtgattccagcagtagctgtactgactccggcgtgctcagttgctgtgaaaaacaccatcgattgctacaggaaaaggtaatcaactgatgctccatccgtacaatgcttgttcatttgtgctactaatgtagttatttatagtctgccattaccatcttaactagtagcaataaaaaacagtaggttgaataaatcttactgtcttagtgttgatttctttgctcaaaaaaatatacaggtgtccatttacacctcagtaatgttatttttagtcgacaaatctacatgttggctgggcacaatatttattcagtaaattaatttgtttttcactgaaccgacacatttccttaagtaatttgaagctgcgtatgtaatctcatccagatggagaacactcgacaacaatatatgcatcacttcttgctaacgaagaaggctgtagtggtactttgtcttttgatcatcatatggttgaggaacaaatatcgtaggaggagtagtcgcaaaggggtaaaatatgggcccctagtccacagggatgtatggagaacaagtgaactaatcaggctgatcaacatttcagataggacgtgcactcaacaattaagaatgtcccgtgcagtattctacaagctttgtgctcgtcttaggaacaagggactactagttgacacctttcatgtttcagtagaggagcaagtggcaatgtttctgaaaaaggttggacaacaccattctgtttcatgtgttggattctcattttggcgatccggtgagactgtgagtaggtattttcgtattgtgctgcgagccatgtgcgagatagctcgagaactcatttacatcaggtctaccaatacacatagtaagatcaccagcaagaaaaacaaattttatccatatttcaaggtaattctaaacaccaagccataacaatgcatattacaatacattttgtttattttaactctaatgtttcactttgatatgtacataggactgtataggagcactagatggtacacacatcagggcaagtgtgccagccaagaaggtggataggtttagaggccgcaaaccataccccacacagaatgtattagctgctgttgactttgaccttaggttcatatatatcctagcaggttgggaggggtcagctcatgattcccttgtgttgcaagatgcactgtctcgaccaaatggccttaaaatacttgaaggtaattaaacatttcaaagaattcatgattagccttgctataagttgacgttaggctctatgacatgtttgtagggaagttctttttggctgatgctgggtatgctgctaggccgggtatattgccgtcttatcgtcgtgttcggtaccacctaaaagagttccgtggccctcaagggccacatggacctcaaggcccaaaatgccctaaagagcttttcaactatcgtcattcttcacttcggactacgattgaacgagcttttggtgctttgaagaatcgtttcaagattcttatgaataagccattcataccactgaaagcccaatcaatggtggttattgcttgttgtgctcttcataattggatacttgagaatgggtctgatgaatttgtcaacgatgagaagacgtggtacgctcgcctaccaaggagcagcaaccgtgtctctgaccaaggggatgatgtacgtgagtgggcagccaagcgtgataacatcgctcagcagatgtggaatgacagacacaatgcggatgttcatgatgttttgactagtgaatgaattactagtcccatggactattaatgatattatattttgtaatagttgtgaggattgtatgttgtattaatactattgtatcagacattatcatattaatatatttatgtttcttccaatcatcttattacttcattaactgactatcatctgttcatatgcaatattaacttataattttttcactgtatgtagtatgggaaagcgtacagaaggtactagcgaggaaggtggctctcgtgagaagtatatcagttggagtgatgatgctactcagttcatgcttgagtggtatatagagctccgcaaagacaaacctagtaccttcaagtggaagaaacaacaccaccagcaatgtgctatagctttaaaagacaagtttgggattagagtcaccaaaagccaagtccacaggcacttaaggctatgcaaggaaaaatggagttggatttgtgtagctttagggaaaagtggctatggttttgatgcagcatcatgcaaatttaacattgacccatctgagaaggattcaaacaaacttggtgtaagctatattattgtgcaataatttctgagttataattcatacaagaatgtgctaaatttgtttatttctaactatgtttcttctcatggcagacaactaaatataactacttgactaagcctatcaaattctttcacctctttgaagaattatttgttggttgttcaaaagctgatggttcactagcaattgaccagttcaatgcaaatggtagcagtgatagtgatggcagtggtagcatcaaggagttggaagaatacatatttgcattggaagatggtggccatgattctgacacgatagctcgcaatagtcctactactgatggc

SEQ ID NO: 75658 - DNA, 1637 bp, Oryza sativa
  unsure (1)..(1637): unsure at all n locations
tctgaaagctagttgaaatcgtgacaattgactagctcaccatctgtgcaggcaatttaaaattcatcctagaaaagcattcagcgtggagtagtagactagtagtgtaactgttatttatctctatatttaggagaacgttgattttaaattttgtaggtttgcaaactgctacttgtatacccaaaaaaaaaaaatctgctacttactatgctatatccatgatttatttcagaatgtttggacacgccaaatgttcaaacagtattccagcaaaaattttaggcactgttccaatcaaaatcccccttccaaactaaccagccgcttgtacggctaaactttttgcctgtcctcctactgctaaatttgaacgccacattgaacaatatctgaaaccgtgaaacgtgcctctctggctaaagtgctaaacagttaatccaatgagaccaaatcacgcaggcaacaaatatggatataagcaaatcgaggacgcgtgaacgagtggggaaatcaggatatgcgatgacgacgtacgaggaggctgaagccggagacgctggcgagggaggtggcgatggcggaggcggagagcgggaggacgccggggaggtgccccaccatcatgttggacgccacctgcacggcgttctgcgccacgctcatcgcggccatgggcagcgccatggaccccacctttcctgcctcccgcgccagcccgctccaccacctatctccgccctcctcctccctccctcctcccactccggcggtgccgtccgccgggaatcgtttcgagagcagaggtattctctcctccatggcggcccgagtgcgcgcgtcgtcgtcgtcgcctccaccgaccgagctctctctctctctctctctctccctctcttcttcttagagacggcttttggtgtctgtgtctcggcgctggtgggcggaggggttntaatgggagaggactctcgcgatcagcggcgggataaaacaggagttatgggaaggttgttatgtcaaagtgtcaaatgtggcgtcctaattttatactgcgggttaaaagtagaatgcaaagttttatacgagtgacatccccccctcaaaaaaaaatactggctatataaaacaactacactgtgaatattttaggaatgcttggaaatactcgctctgttttatattataaattatttttactttactctaaatcaaattactttaaatttaattaagtttgtataaacaatataataatatttataacactagattaattttattaaatctataattaaatacattttcatagtttatttgtattgggttgaaaatgttactacttttttctacaaacttagataaatttaaagcggtttgattgtaaccaaagtcaaaacaacttataatctgaaacgaagagagtaaggtttataaaacataaataaagagagtaagatttataaaacagagaaagaaaaaaacatactaatagaatgctatgctcttgtctgcagaattttaggtcacgagaatacgaatcaaacataggaatataaacttttcaggaaatttgtttggataggggagagactagatagagaaaggaatataatgcatacaagagtttgagctca

SEQ ID NO: 75659 - DNA, 643 bp, Oryza sativa
acagctttaagagcttgggtgatagtatgctctgcaagatgctgcttaccttttgttcttgcaataatcctcgggctagtttttattactagtaccagctcagaaagagacaacagcagcgagcgcacacacacggacatggacatggcatgggcggatggtctctctccgacttcgtttccaagggccctgctgcacttgcaccctgcactgcacttgcttgcggttgccggcaatcgacgtgtgactgtacttgccgtcgtggaatcgtccgatttcacgaccaactcagcatcagcgatgacatgaacagtctgtgtgcatgtgtgatggattgagatcagggtgcacttcgatattgcaagtgcacactaaagaactgcaatgaatctgagcctttcatattttaatctaatggtacatgttcgctgctacgatatatataaattactattattacttgatatagtgaaatggagctacaataatgcattgatttgggcctgctttctcaaatctcaacacgtggtgttacactaacagctgcaccattcgtgtgtgatatatgatcatagtaaaggttactgattttgctttctagtgcatcaaaacatttgaagtcttgattgtgaagctatggatg

SEQ ID NO: 75660 - DNA, 11168 bp, Oryza sativa
cttgtactagtatgagtttaggactcttagtatgagtttggttcgtggctttaggctgcctacctcatgtataaatagagggggagcgtgaggcttcccggtatcgctttagagagcaattgagttgagtttggagttagggtttcgagtttagtcgaaatttttgtaaggagtgctattggtgcactttgtaagcacagagagaatcaataaagttgtcatctactttaagagttcttcgatttgtgtttcaccgggtttcggcggtctaaccggcaactcaccggcggtcagaccggcggcattgcggcggtcagaccggcgggagcacagcggtcagaccggcggcgacgacagcgagcggcaggcgatctcggcggttagaccggtagatcaacaccggtcagaccagctaatctacttcggtcagaccgatttcatcgaaattaagggtaacttttatttccgctaaaagtttttggtttttgggtataccaatcattcaccccccctctggttggcttagttcttgtgattcgttcctacaagtggtatcagagccttgttttcttctttggatttttatcgatctagagtttttgccatggctactcccgcaaggttttcaactaagcctcatgttttcgatggaacggatttttctcattggtgtagtaggatgcaatcttatattatggctgaagattatgatatttggagaaaagtttctcatccttattgtcgaaacatgataatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactgtagcttcttgtcgtcgaatagtcattgcttgattgaagatatgtgttgaagatgtccaagtagaaatcctgaatattggagagccacttgttgtagtaaaataacacggcatcgcatgccgagatgtcgagattcacaacaacgtcatggttggtgatgtagcaaaacttgttaagtagcagcaatagagtttgctggttccgaagataataaagatgaagtcgctccaccatgatgacaaagttgtgttgccgtgatgaagtgaaccggtagtgaagacgcgcagttgtgaagataaaagcactagtcggcggcggcataacacgagtcggcggcggaagacgatgatgtccatcagtagtggtagctgtataaaccaaatgtagaggcgagggcactagtcagcagcagacgagacgaccggcgatgaagatggtaaggccaatcaacactggcagaatcatgcagccatggcaaatgtaggcagcttgtgttgaagatactgatgcctattagtagtgacagcgatgtagccagtcgtgaagaagatagcatcagttggcgttataacaggccagccgtgcaggcgatgacaccactcggcggcggatgcggcggccggtcggtgaagacgcagacgcccaacaacggcagcataataggccagccgtgcaggcgggaacaccagtcggcggcggtcgaggtggccggtcggtgacgacgtagacgcccaacaacggcggcataataggccagccgtgcaggcggaagcaccagtcggcggcggacgaggcggccggtcggtgaagacgtagacgcccaacaacggcggcataataggccagccgtgcaggcggaagcaccagtcggcggcggacgaggcggccggtcggtgaagacgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcatatgtcgcgaccgggaaaattgccttttcccgaacgctagtgtattaatccccgtcccaggaaaagccggggtacaccatacaaacatgatataaaagacacatctttattacatcgataatatttacattattacaaaggcacttaaggcctgacaatcaaaaataaacagcagcggactagcgggcctacggctccatcttcacaggcgctcaactggggtataagccaggaccccacctaagacatcttctccaaagcttctcttactgaagaggggaaagattgagcaagaatgagtacaaccacagtactcagcaggccacaccggagatgcacaattaatgcaaaggagtacaaggggataataacatagaggttaagttttgcagtagacggcatttaaaagtcacttagttgcccaaagctattttgtaaagacgatcctagctatacaatattattaaccaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgatatagtttccaacccatcctagccatagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttataactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgagaattcccaaagtctaaagttataaaaaccacctaatgttgcctaattaatcagcgaagcatctacctacattcatactagtggaaccatgaatagagtacccactagttggggttttgtttaatctagggtgaacaaggtaataatatcaataacaatagtattaaggtcataacaaaggtaaatgggcatggctaaataaaacagtgatcacgcgggaatttaaataaagcgataatgcaataatttaaatcaaaataattttataaactgggattcaacatgttcaaggatgatgtgacttgccttgctcagagagaacagccttccgaaccttcggcgacaaccgcgaaccacgcttcgggaacctccggaacgacgaaagctacgcgaagcacacaagcaaagctacaagcctataaagaagcaataacaacacataaaaagaaagcacagggttctttaggttataacaaacattaagagacttgaacgggtcgattcggagctcgtatgaccaggatatgatcatccgaagtttaatgctgttatatggagatttgcgaattattataattaggttttgcaactatgaaacatgtgtaagcgctagcctggaaaggacaggaaggctgcgccgttgacatgtggaccccacatgtcaacctaaaggaccgcggtagaccgggtacacagagacggtccacgggtcgacggaggcggaccccgtgtgtcaaccgaggcgagtggccaacaaacggactccactagacaccacacgggatgcacacgtagaaaccacgcggctaccgagcgggcacacaaacacggacaccacacgcacaagcgaacgactaccgacaccggtacacgggtaccggtgtcgacaaccgcacaacgggtacggggcgacaccgaaaggacgagggcggggaagcgagaggacggatccttaccaccacgcgacgaggcgcgggaacgacaacgacgaacgggcgcggcggagacagacgggcacaacggagacgaacggcgaggggacggcttcggcggcgatccttgaacgaaggcgagacgcggccggcacgaggcttgacgacgcggagccgaggacgaagacgaggacgggggctgcagcgacttgcttgactgatgcggacgacggatgagaacggcttgacggagggacgaacgccacgacgagcgaaaccgggaacgacgagaggacgatgacgacgacgaccggaaccggcgaggaggcgacgaggacagccggcagcggctgcacggagacgaggacgacgtgggacacgccgctgcgatgacgatgacggaggcggtgccgcgagacgacgagccgggcgaccgacgggacgtcgacgacgagaacgatcggagacgacgatgatggaccgcggaggggtttggatggaggggaagcgaggccaagagcgaccttgccgctgcgatgccggaggtggtggaggtgcagcgagccgacgagccggggaggaggaaggggcggccgaaaggacaccggcgacgaagaggatggagagaccggcgcggcgacggcgttccggcgaaaaccgaggagcagccggggtggagggcgatgcggcgacgccgagggaggagacggtgacgtcggccgacgctcaggcgaggcggccgggacagctggagatggtggagtggtggcgacaccactagtcgtcggtgaggacgcgtctccggtgatttccccgcgaaacggaggcgaagccgggaaagaggaggcagctgcgaggccgagggagaagacggcgcggccgggcggcgctcgggcgaggagaggaaggcggctggaggtggccggcgcgaaggaaagaggagggcgacggcgggaacgtagttccgggggtctcctcgcgaaacggagggcaggccggcgtggaggaggtggcggcgacgctggaggaggcgatggcgcggccggccggcgcacgggcgaggcggcacaggcggctggaggtcgccggcggcgtgggagagagagggcgacggcggggatggggctagagaccacggggaggctcgggatggggttaaaacggtagaacggagtgcggggatcccattttatatgagagaagagggagccggccacgggggaggtcggaacggcggcggaaaagccggccggcggcaatggaaggcggccggacttggcgcggccgttcccggcgattgggggcggcattcaaaggggaaattagggggaaatgaagaggagtcaatggggattaatttcccctatttaattttggaattaaccaagcgaatcaagcggatttggaggagggagcgagctagggttcacgggagagggagagaggacggccgggcgggaggaaggggacgacgcccggcctggcgcgtgggacccaccggtcaggcggcggcgtcagcgcgcgcacgcgcgcggcacgtgcgggaggggagcggctcgggggctggggcggcttgggccggcggccggcccaggaagagaggagggagaggcggcctgggccgggcaggccgggaggggaggggaagagagaggcagcccgggagggagagggaagagggaggtgggccgaggggaagggggcccaagaggaggagggagagaaaagagggaggagaggaggactttggactgggcttggcccaaaggaggaagaggagggatttttaggttttctttttattgacctttgataattgtttttgttgtttaataattatttccggtgctctgaaaattcaagtgaaatttgagggctccttttagaccaaggagaatttaacaaaaattctccgggtcacatttgaatttttcttgcacgtattttagtgtttgccaatttctttccgacttttaattaattctattattccttttagaaaatgaattttaatttggaatggatttatcaggacgtgacagcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacgtaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacgaaggcacgccggtcagtgaagacgtagacgcccaacaatggcggcataaaggccagccgtgcaggcggaaacaccagtcggcagcggcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaacatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcgatccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcggcagcggcgaaggcaagccagtcggtgaagacgtagacgcccaacaacggcggcataaaggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacagcggcggcataataggccagccgtgtaggcggaggcaccactcggcggcgacgtaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgttgacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggataagccggcggagtggactcgcggccgatcgaccggaaagctgagaagcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgatttcggcaataataaaagggggtagcgcacgagacctaaaagtggatggatgcagagacaaaagatttagacaggttcaggccctctcaatgagaggtaataccctactcctgtttggggatttgaatccgccgggtgtagtatagatctgacgatcaggttgtgtcatgccccctagagggcctcctgcccaccttatataggatggggggcaggattacaagatagaaaccttaaccaatacggtatcggtttcctaaatctattttacaatattatcgaatcaggactttaggccactccataatataaaaggaaacgtaacacccaagtcatgatctgttacatattacataaatataagttatcccctataactagtcggataaccatgccgtgtgggtatggggtacccataatctccacacttatgtgattcctgaagctattaatactactgctgaaaaaactgcttttgaacaaaattgcaaagctcgcaatattcttttgagtggtatttctcgttcggattatgatcgtgttgctcatctttaaactgctcatgagatttggactgctttgagtaattttcatcaaggaacaaataatattaaagaactttgtcgtgatcttttcaaaaaggagtatattaaatttgagatgaaatccggagaagctttggatgactatctttctcgatttaataaaattttgagtgatcttagatctgttgattcttcttatgatgttaattatccacaatctgagatttctcgccactttttgaatggtcttgacatgtctatttgggagatgaaagttacatctattcaggagtctgttaacatgtctactttgactttggattcactttatacaaaattgaaaacacatgagatgaatgttctttctcgaaaagttgattctaagtcgaatgctttggtttcttcttcttcctctttggatgttgatgcttcttcatctaagtcgtcttttcttgctgtttttaatgccacattcgatgatcaactcgaacaaatcgaggaggaggatttggctttggttgctaacagaattgctcgagctatgaataatgccaggaacaggaaaagaggtggtccaaatcgttgctttgaatgtggttcaattcatcatcttcgttcgcattgtcctaatcttgggagaggcaaaagagaagacaaagatggtgagaagaccaacaacaacaagcccaacaacaacaagtcgaagggttcataccgagggaggaagatggagaatcttaggaaggcttttcaacaagtttgcgccgccttcgagccactaagtgatgtagatggtgaaagtggagatgatgataagggaaagaacatctccgatgtttgctttatggcgcgtggtgaatctgacacagagtatgaagataatgaggtgaatgcttttgaggaagctattaatattttgagtgcaaaaaataagaagtgtgagaagatgtatagaaaacaggaatttatcattgaatctcttaaatctgaaattgatagattaaaatctcttattcctaatgatgatgattgtgaaaattgtgaggttttaatgaatgagatttcaaaaattagagatgttaatgctgcacatgatttaaaaaatagatcttctcttgcttgtagttttgccttgcatacacgcactttggatgagttgtttttaactaaaaagttgttgcaaaaatatcaaattgcttttcatgctagtttgatgtttaacatgatttctgctaaaaagttaaaacaacctcattatgttttggattgctcaacatgtaatttgaataagatgaaactaaaagatgctttaggtcatgttgagtacatggaagatgctgtgaaaaacaatgaagtgctttcttgccctaaatgtcgtaaaagcaaaggtatcatggtagattgtgaaaattgtgctaatttggaaaaagaggtttcttatttgaaaaattctttgctaagattttctgatggtaaaaagaacctcaacatgattttggatcaatcaaaggttagcacacataaccgtggtttaggttttaatccttatgctcataattctagacatcctcctgttgtgttaggtgttag

SEQ ID NO: 75661 - DNA, 524 bp, Oryza sativa
ttcaagttcatgtaggggattaactgcatgaatcaaaattattaattaataattatgtaattgtcatgttattattgaataaataaatcgagatcatgcttgagatctttgtactgggacacagtttcaattaattaatgctagtaacaaccttggagtgaatgaatgtgagtagttgggctgaagttgcttgttcgtcttttgctgctgtgattgcaacctgcgagggagaagtgcacggctgtctcgtctcatgcctttgcttgctttgagcctttgaccgtcgccggcggtggatggcagctgacctcgacgtcgacgtggtggaacacaaatttggcgccacgcatagttctgaagatgacaggtcatcttgtgactacaataaaacgctacttccttaaaaaaaattcagtttttaatacaacatttaactctccgttttatttaaaaatcttctaattagtatttttattttcgttagatgataaaatgtaaatagtattttatacgtaactatattt

SEQ ID NO: 75662 - DNA, 2992 bp, Oryza sativa
tggtatcaagaggtttatacctggaagatgttctaatcttttgcattggacggctagccagttttttcctgggagtggtatgctttgggagtttgtcgggcaagcctttgttcccagatttgctgccatcgtcgccttcgtcgtcgctaagcaccagctttctcttgcgagaacctgtctgcccagttggattggaggtttgaggttgcgggtctgatctgattgttggccctccacctccctgaacggtgtgctggcgaggagaccggcgctgagtgattggggggtcagacttcatcaatacatattcctgaatgagatgcctccacggttagttaactcaacatgaagacaagattatgttttggtcatgggttgaaggtttcagatacatacctgcggaggcggattgaacgcgttatatggcaccactggcagctgatgtgagtagttgacgacaatagcatttgagaagattttatacattctctccttcatgattttaaaatccagagaatctggttcttcacgattaggatcatgcttgccgtcaaactcgaatgccgtacgggatctttctttaattggtgccaatcggcatttgatgaagtgccgagtaatctgctctccttgtaagccttgttctttgagttttagcatgcgatccatcaattccaaggcttgggctgcttcatccccaatcggaagagagttccaggtatcttggtacaccggaggaagacaagagtactcgggaagggcaggctcaggattctgaatataaaaccagcttgcatgccaccctttgtttgaggtcttgaagggcatagagaagtacttctggctcagagtccccctcagctgaaatccggcccctccgactacacatggcttactcttgttcggttggggcttgagaaagaagattcggcgaaacagagcgaagtggggcttaattcccaagaaggcttcacaaacatggacgaaattggcgatgtggactatggaatttgggtttaggtgatgcaagctgattccatagaagcttaatatcccgcggaaaaattttgaggtcggaggagcgaagccgccatagaagaaatgggagaagaccacaacctcgtgtgtatcgggggtcggaaaagcctcaccgcacgctggccgccacccgatgatctccttggcagggagaacgccgtgcgccaccatctccttcaggttctcctccgtcacgtcggatggcgcccattggccttcaaagctttccttctcttccgccattgattttacccgaatgcgctgatttgattcgagggatggctaaggagaagtgaggggttgaggcggtggatcacgggaaggattttgatgaacttttcgaaggtggattcgagtggaatggtgaaccctagtttgccggcgcagctctgtactgtagcagggagtggggaaaatggcgagagttccggcggggaagatgaagtgtcgcttggatcttgggatttcttgttaagggtatcggaggtgcaaatgggcttaggcctgaacagtacctcagcccagtacttttgacagcgtggcccattgtgctccttagggacttaggcattttttgctttggcaatttatgcgcacaatagtgttgcccaatgctgataaaatcctttttacgcggtcatataattctttggaattattgcaatgcaaattaaaaggtgcccgacagaaaggtgttatgctgtttttgtaagcttttttaggctacaaaagctgtctgggttaacttggaatgacttgtttttaccatagccatttccttggtatgttatatgcctgttttcattatggtaaatagtcatagcctaggctattagacttattcattaccataatttttataatttttggtgggtaatctttagagttttatattcggatgcccgtcaagtgtgttcattcgtgaaccttttagagtgctaatcactcggattccttttattatggctaaaaagcagttggctagaatgcccctttaggcgccacgtatgcttttgtcatacgatgcacgattgtgctattattttgttctcaactatatgtttagtctgttaactaatcacatagttgggggctacacctaattaggtgcatctattcgatgcaccatattctttatcttttcgccctttacagtctttgtcttcgctactcggcagatcttggcatgaaaggtttgaagcactcggattattatctttgagaaggctatgatggttgactgcaaaggtctcgggggctactgtggagattatggatatcccatatctacacggcgatggtatttggattgaatacaggataccaaatatagatagaatatcttatttgtgtctcgggtttgtctctcaacttgtacatcaaggaaataccttgagacttagtcggttacgactgtattttatctgtatctgcatattccgttagggatatagattatcttttgtaacacggactccttcccatatataaggggggtccgggtgcctctaggggcatatgttgattttctccaaatcatacaatcaataagacactcggcggattcatccccggacaggagtagggtattacttcttgaataagaaggcctgaacctgtataaatcttttgtctccaaacccatacacttctccagcttgatagccacccccttttattattgccgaaatctagtttcgacactactgacattgactgggtgaaaattaatatcttcaggctggaaattacttagttggttatgaagtgaaaatttgtggcatttgcttgaatctgaggttcttttgtcgagggtgagcttctttgcttctcaaggatctgatgttgcacaggtgacaaggcaaatgttcttgggttatgcaagcggactgctgatgacgtccttgtaaaatcaaaggtgtttttgattattattctgtgatgaacaattggg

SEQ ID NO: 75663 - DNA, 9327 bp, Oryza sativa
  unsure (1)..(9327): unsure at all n locations
catgctaagaaagaaatgtgcggcagttgctttgaggcctgccatgaagtagacaatcaccataaatatgactggaaggaaaaggtccagtggcagatcacttgtcgttctggccaagaagtatgcactgagcttgtacatgtcagctgcacgctccttgttcaacattgccctttcttgtgggaatgtgaagatggcagtaaacacaggaaagaaaccccaaaacacagctatgaaaaacagtaagccggcctgcatacgcaagataaaattgtgttatgatactaatcttcctgcatacccgagctgacatatcattaataagctctctgagtaaccaactccgccatttcacatgaatcacattttctttggcgtaaaatgaatcgcatgattattgctatctatgtacctgatcttgtagaccttttggtgtcgagggatcagagtgccaccatagtagacctaagataactgatgttgctatgacctgggtgattctcatccagctcaaataatcatgtcgccgttctttgatccctctacagaagaggatggaatattgctgccaccagctagtgccccattctcgctttgatgatgttatagttgtcttcatatcgtcactgattggaagtggatctagaagctgcttcttcgccttgtatgccactcgattctcataggcgtctacaagatactgcatgaaatcacatataaattattcagacatctaaaccaaccctcaactcataacaccagcacattgctttcatgtcgtcacctcatgaacatcttgtgctgatggcttgtagtcattcttggtattagtttgcaggttttgattttccatgtgcaccttgtcatctaactcggaaggaacagaaacatcagtagtgtttccgttggcgagatccagtagaaattctgctgggttcattgcgatgagcggggtgcacccaatggactgaaagtagggcatggcttcagatgccttcccaaaatagagcaaacttcctcttcccaggaggataagcttgtcaaacttatgaaataatctgctagatggttgatggattgttgttattactgtcttcccatcctgcaacatgtcaaaaggttaaagatgaattgaactagttgccagctaatgtgtaatactctcatgtcacctcagctatatcatgtagaagttgaattatcctgagagctgtagttgaatccaatccagatgttggttcatcgagaaagagtaaagatggatttattatgatctcatttccaatgcaaactcttttcctttcaccccctgaaaccccacggacgaaagatccaccaatcatcgtgtcctggcaccttcaaacatcatcagataattaattaagctaatttctagaataggtgcatgctaccatacaggaagtggagcgtttttcaaactacctttcaaggccaagttcatatatgatgtctattgttcgttcttccttttcttgcctcgtcattgttcttgggagacgaagcagtgctgcataagtcaatgtctcctttacagtaagatgagtaaaaagaacatcatcttgagtcacaaatccaatcctgaaaaacgagtataaaaccaatcattcactatactcttggacaaactttgaattagtttgccatacaggctcaagctcaactttggtgctctgacgatccaaaccattggtacaagcagatgttttgcatataaaaccttgtagaatgttgagggtagttagtctagtcagacagtgcgaaaattgctaacaataaggaaccaggatatctctcagttcgaattgtttgccgaattggaagcggaaaaaggagaatactacatggtttttaattggcgattctactaaagtggtgttatgtttgagtgtctaaccaacttagtagctaggttacaccaacacaatttaaaggactaagcagaagaacaggtggaggtagaggcagaagcagaggcaatcctggtgacaaagacaagcatccaaaggaattgcgggacagagaccctggtgcagtggtgttcaagacgaagtggacctctaaacaccggagacctgtaagctcagactactgtaggcctcaggtgatgcaagtgttcactgacgtgaaacgtgtgcttactaatactacctccagcatcggtcaggagatacatcgaacagcttatcggcaggaagggcatgactggaacctcacctcaccagagcacgctacgacatggcgcagacatgcgatcgagaacaacgggcaggcgactccctgaacgtcccgaccgtgctccgccgcacaagccgccggagtttccatgagacgacgacgacgacgaggcgtcgccgcgcggcgcgcccaagcagacgagaccgtgagagacacaggtgaccaggcgacagccatagccgcgggcaagagccgaccaaaggcatcacggcccatgcgccgggacgcacgattgggccacccaattcggcccaaaaagaacatgtcggctgctcggcgtcggcaaggcccaattctggcgccgcccattagacagaataataatgacaggtgcgcggtacgtgccagaatcggcacgtcagatgtgcagttcccctgcggccaaggcagagggaagctggaagaagaagacagtagacagtacaactgtagcagcgatgaacaggtagccagatttagcgagataaccgtgagccttgccttgctaatctctcctttattatagccagccacacagcctatgcatgcagtatggtactatgctgtgctctgtagctgcaagcaacagctgatcgatctcatctcattcttatcactttcgttccccagctagtgacccatcgaccaatgagaaatttacaattagtggctccatcagttgggctaataacccaaagaaaaaaaccaaaatttaaattttaaaaattaattttgaagttaattttaagatattttcaacatattttctttttcagcattagcttttaaatcactaagaatatatataaaaaaattatctacaaattaacttttattttctaataaaccgttttaacttattgggaatatgagcaaacggtgaggttttagggctcgcaaataactaattgtaaataatttagttaattgattaattaataatcctggccccggaggaattaattggtgatgccacatcgtgtacgaacaagtgcatgctacggagtaactaattaataattaattaagacgctgcatgcatctattgcacgcgatcagagaggtcagaggatgaaccttcctttgtgttgtgttacctgcggttgagggacttgcagtatggctcgtcgttgtaggagacgcagccttcgacgtcgccggggccggcgaccctcccgccgaggatgctgagcagcgtcgtcttgccgctccccgacgggcccatcagcgccagcacctcgccgggcgccgccgacccggatatcccgctcaggatctccctcggcgtacccttcaccgccaccttgtacttcacctccgcaaactgcacgaacgaaacgagtctcatctcatgtagcattagctcactgaacctctcgcatgccggcggcgtacgtccatggagcttgggataatcgatgcgtttggtcgatttaccttgagatatatcggcaacgtcggctcggtcatcagcttcttgcgcggcgtcccggcctcgatgtccatcgctgcatacgcacagcggcacagagaatgagaatatatatattagggaagtgatttcatctctcaaggagatcggatatccctcgtttcgtctatattatctaaatatctataaaaaaattaaaaaaattagtaacataaattaatataaaatatatcactccacgaaaatacaaatttaaattcaatttttataagttgtaataaaaatgacaaatataactacgaaaggtacgataaccatatgtgcatgcagttaggatcagtaggagtgattggatgcatactgttgtcgtcgtcgctgaagggatggagctcggcggaggacatggtgtcctggggaggaggggtgaagccggtgaaggtgaaggagaagccgaggctggcgctggaggcgcggctgagggcggcgccgctggagacgaggtcctccatttcgagcttcagctgcgcgctgcgggacttgcggatgtggctgttgttgttgttgctgctgctgtagccgtggctgttcccaccggcgccggcgccgccggacgccgagcgcttcccgaagctggacttgcgcgacaggctcgtcgtcgtcgtcacgtcggccgtgctcagcaccgtctccgccgacgccgtcctgctcagcgactgcgccgacgacggcggcggcggcggcgccagctggtccgacttggtccgctcaatcatcccccctcccgtgtccatcatcggcttctccattatcgactccatgaacgaacacgaacaaactacctagctaacaccgtcacgttcctagcaagcacatttagagcagtagcttttacacgagacgagccgttatatacacagacacagagtgatgggaaggcaacacacgcagctaaggcatttggcaagcgagcgatggaggtcacgcgtgtgaggtggattgtggcgagggcgacgtgggggggaggcagcggaggggcagggggcgcgccagcgaagcgcgatgcgggacgcggggcattaatggagcgggaaagcgcgggtgtggctgggcgcgctcaggcagccagcttccacacatgccggcctcacgacgacgtatcgcgcagggcacccgcgcgagcccccgcctgcggctagcttagcccgcgacagggacgtccccggccacctcgccttcctcgctctctcgctcgcggaggcctcaggcgcgcgcgcgtcccttgcagatcgatccagcgcgcgtgcgtgtgcgttcggtttaggcgtacgtgcgcgcgggcggcagcggcggcaccgatccttttaagtcagcttattggcttatataatttataagccggtggatttaatgtcctaagtttagtggtttagttatacatctaccttacataagccaaaaaaaacttctccaacctagcttttggcttaatagtgttagagtggcttatggcttccaaaaagccaaacggaaaagctgcttgtttgtttaggtttagacttttcgacttataagttggcttataagcctaaacaaagagggccttagcccctccgcacaaattgaggcgctgggtgtgaaacacaaaatgatgacctatttagcaaatgctaacgtaaaataagtgtttagttcacgccaaaattgaaagtttggttgaaattggaacgatgtgacagaaaagttgaaagtttatgtgtgtaggaaagttttaatgtgatggaaaagtgaaaaaaaaagtttggaactaaactcgtcctaagtaaagttcctttaggcgatacatccatatctttacttgatgccatattatttactccatccgtcccaaaataagcacaactatgagtttccgtgtccaactttgatcgttcatcttaattaatttttttttaaaaaaaaataaaaaacataatttacacataaagtactattcatgttttataatcttacaacaacaaaaatactaataaaaaaattaaataagatgtacgatcaaaattggatactgaaactaatggctgtacttattttggaactgggaagtacaattcattgcagggttgctctatctcccgatcgatgctttaatttttctcgatccaaatcactgtcggactgccggtggtcgtttatccacattccatgttagcataaccacgatcaagcatggtcggatggtcctgttcatcggtttacctatgccttctatcaaacaagcagtaattttgcgcgaccaataacagctaactcatcaccacctaattaaaaacagtatagtggccatatgcctagataggatctaggaagaagacttgtgtgcgtcatgatgtagtgatttaatttttcttactaatgttgtgtttagttccacgttaaaattggaagtttgactaaaattagaagaaaaaatattgaaaatttatgtatgtagaaaaaatttgatgtgatggaaaagttgaaagtttgaagaaatagttaggaactaaataaggtctaagcaagatcttcaatatttggaacgcacattcacatcatgatcatgaactatctttgaggtggccattattgtttccaaacacttgtgagggctgagaaaaacaagcatctaattaaattaatgaaggataaagagattttttattaaaataataatatgaacgcgaaaacatgcttagaatgtactaacggcttaggagtgaaatataaaattttcgagccctaggcaatgtacagcccctatatacgatcttctagccataacacaggaaaattcggagcaggcaaaagtcgtcgatcgcagctgcgcaggagtcaggatggacatgcttggcatgatgcctctttctgttttccgtgctcacactgtcgtcacacagtgcaacgattaccatatatcattcgtgaagagaaacacgagtacacgagcggtcgagcatcctaatctcctttttaattttttttttatttttgaaaacaagcatcctaatcttgacgaggatgaaagtatcagcaacggccccaatgctattgttgacaagagatgtgatgtggctgtggnnnnnnnnnnnnnnnnnnnnctgcatgtagatgtactccactccagtaggcagtacgcctgcacagtcttttcctgactgttacggacgcggaaatgtttgtccggagaggagaatggtctctgctaaccggaagaccggaaccaccgaccaatcgggaaacggcgtggcgttgccagtactgattggtactactgggtagtatctttgacctcttggttaatgcactctaatgctccatttattacgaaatattgacgagatatttaaaaaaaacatactctcttcattctaaaatataactacacctataattatttcaaaatataacaatttatataccaacattttcttttcaaccaatcacaacccttcactattaatttttctcgccaaccaccacttcttaatcaataataatatatttatatttaattttatctatttttttaaataattatgtgcaactctaaaacttttatattctaacggatatagtaattaacgaaagttagctcgaaccttaagcgataaacatgcagccttcccattttatccgtgaggatttctttccggttcattcttgtttcctacccgcagtttagattggccttttatctcctgttacggttatttttttgggatacatggcgtcataattctagcaatccccttcctttttatcctcgtgttgcctgcgcgttaactttcatgaaatttgtttccaatttaaatttgtagcctgagattgcaatcttacaacataacaatttttaaaattcacattgcatcttttgaaatttatcgtgtaaatatggaacatataatgtcaaatacatattaaaaaattaaatattttttatgaaaaatatgacactaaacatattttttttttattttccaattggcgagcccgctcgtgtatttattactttgtcttgttcttgcatgctaccgcaatgcaatgcttgctttctccgtgtgttcttgcatgtataaacagttcggtctgtctatgcctattgtcaatggttaatatggatatactgtttatctttcatttcaatttaaatacatgcaacgggcaggtatgtagagttctagcgtgaggtcaatcacacgtgggtgcggtgcgtctcctcctcgcttcttagggcacctacatgggtttcaaacgaattaagaaatataagtttgaaaaactattttaaaaaactaaccaaaggaaaacaaattctaatcaaagtatttgtgtgtataatattcgtgcgtataaaccttttatatataaatgtatacattgaaatatataaatgtatatatatacattgaaactttatagcacatataaactttgtatgcaaaaacttttaatatagcaacattatgtataaaacatttgatccaaatctgaatcaagcaaataaactttcaatgtataaaattttttatatacaaaaggaaaaaaagtgtggtgtgaaaaaggaaggaggtggtgcacaggtgcatgatcatccacgcgaaagccgtttcgggtagacattaaccaaaagcgagtgaacagtgagtttttatatcactttgagtacagctttttcagaaaaaaaaactattaggagatgcctaactttgaattaaggtgtggccaaaatacccacgacgaaacactacatgcctttaccttcaaattgatattgccatagtcaagcattacatataggaaaaggaaataataaaattcaacaggttacattcgtataagtgcacggaagaaatagtaggttctttctttcgccacgtataagctttttcacgaaacatatcgtttagtagtttaaaaaatatgctcgcaataagttatcagcaagtagctgaaaagaattgaacctaagagttgtttctgtacgcaaatgattaggtcatacataccagctccaagaagtcaagaagaggcataggcgaaggacacacaagatattttggagcaggcaaagtcgcatgaattatctgaaaaagcaaaatcggacaacagctgcgaacacagctcttatctgttttctctactccacacggtgcaaacaattactgataactcgtgcaaaatcatcaacacatgcatatcctaattatcttgactaggaccatcatctctaaaaatataagaccccggccccgtgcgaaatgtaaaataggtctctagctagattcatgccaccaaacatactttcactgtttcctcaagcctcatcgaatcttgcatgtcttctgggcttagcgagattaaaaaaaaagaaaataaagcaagattgaagtgaaaccttgaattgagtaagacaactgatattgaattgaggagggaaaaaaatcaccagtttgtgttctgcattcactagacgaaccgaagaaagagtgggctaaattgtgctttctattggttaacatatgggctattttttttttctctctgaagcatggtacttaagcaagtgcattagaattcagggcctcaatttgtagggtgtcctatacagctggggctgcagg

SEQ ID NO: 75664 - DNA, 2892 bp, Oryza sativa
tggacatgtggatgcagaatctgctcgctgccgccctgttcgtgccatagcgcaacccagctccgctcttgggccggaacgggattccggcctacgtgatccccgttactgttgggccggaacggcattacggcatccgtgcgggccctgttatggttgggccgtaccggggattccgatctccgtgcggccccgggaggggggcgtggtggaggacgaacgcgacggtggcaaaatcggcgacggcgacggcggcggcggcggcgatggcgaaggggagggacgcgcggtgggagtagatactgtagtcgtgcgtgctccggaccagcagcaggtagcggcgcggggaaggaagctactggtgggggacaacccagatccctcgcccgcgactcttctactcgcgctcgcacgccctcgtcggccgcgccgccgccgcggtgatggagtcgccgccggagtcctcctcctcctccccggtcctcctcaacatcggttcgctccccttctccctttcgcaaaaactcgctccccatccccaccgctcgcgtgaatttagaggctgatggtgatggtggtggctatggcgcagggggcaagaggtacgcgaccaccgtcgagacgctcacgcagcgggagcccagctccatgctcgccgccatgttcagcgggaggcacacgctcccccggcacccggacacggtacgccgcgtactcaccagtggagctctcttctcgggagctgtagcctcagaggatgaatggtgggtgcagggcatggtgttcgtggacagggacgggaagcacttcaggcatgtcctcaactggctcagggacggcgccgtcccagacatgtcggagtctgagtaccagcagctcctgcgagaagcggagtactaccagttgctcgtaattggaattctcgatcgtttcttcgattcatcaggttgcagcttcccaattaaccagccgttgtgaaaacatgatggtttgttttccagggcttggctgattgcataaatgatagattgggttggaaaaatgatgagaatttctcggaggccgaattgacacgcaaagatgtgatcaagtgcatccaagctccgagagtcagatttcgtggtgtaaatctatctggccttgatctatccaaacttgtaaggtctttattgttgttctctattggagttgctcattttttgttatggttattaccactccattctagttgctcttagcaactctgatttcgtgtgtgttcaacagaaatcaataaagcattttattttttttctttagtttcttgtaattttgtgacttttacggtctacaggatttatcagaggtggacttcagctatgcatgcataaagaatgccaatttttcctctgcttatcttcgtaaagcaaagttcagggtatgccattcacacctaagttcttcgttgtttaactgcttttgatgaagtagtagcccttaggaactatgctagttatcataatattttaaggcattttagttctgtcacaaaaaaatatctaagtctttgttttttgtatgactgtcaaatgttgtatcagtaataccttaccttgtatgttcatgacagctgacagaagctacttgttcttcattccaaagtgcaaatttacatgagtaagatggtccaaccagtttcttttagcttatagataggctctaagatgaaacacggtctctccttttttacttttgtgttttttttttgtgttggatgcataagcaagcagctaaccatctatttcctcctttttgtgttatttttgtttcgctgtgttattgtaattgcttgatttggaataacaggtgtgagcttattggagcaaatcttgaaggatctgttctagataaagcaaaccttcaaagtgcaaacctacagggtatgtaatccctttctttacctgtcttccgttttatgttatatgtttccaaaaaatactattatgctcaggattatcctgtttcttcattttcttggcttttgacatccttttcaccagggaagatcatcgtccctgtagtattagacaatgtagctatgcctattttgctttcactctctcctattcagggtgtgcttatattcttgtaaaaactaagtaggaaatgattgagttgctaggcttattttgcagatgcatgcttaaagcaatgttgcttcattgaaacggatcttcgttctgctcatctacaggtttgaaagtttattgtacatggtgtgtttcatgaatgttcccagattctcgcgctgctattctgctaacatattgcattcctggtcagtatacaagaaaaagtgaaaatcatgatgaacattagcataaagcaaagcatttctgtttttttttagaagttagttttctgctgctagaggtgatcgaatatctagtttccatccttgcaatattttgtatcatccaaacttccaaagtttggctgcaaaattttgtccttgcccaaagtattatctgcaacacatagacatatattttgtccgtacaggcttgtatcgtctcttcctgaacatttgaatataaggcataaaggctccctattccaaatggttttcagtaacttaaaatacgttgatatttgggttcttattactcatttcctcagtgtcttattgtcagtccaactggattttcagggtgctaatcttatgggcgccaacttgagtggagctaatcttgaaggggccaatctcaaggtaacaaaaatggccccattcaacctgcactttcatcctgcctgtcatatgtaacttaaggaaagctacttgagggggttaaccacagagctcttacacaaagacagaaaaaatgattctaatgtatccaactcttcttttac

SEQ ID NO: 75665 - DNA, 622 bp, Oryza sativa
  unsure (1)..(622): unsure at all n locations
atatattattattgattaagaagtggtggttggcgagaaaaattaatagtgaagggttgtgattggttgaaaagaaaatgttggtatataaattgttatattttgaaataattataggtgtagttatattttagaatgaagagagtatgttttttttaaatatctcgtcaatatttcgtaataaatggagcattagagtgcattaaccaagaggtcaaagatactacccagtagtaccaatcagtactggcaacgccacgccgtttcccgattggtcggtggttccggtcttccggttagcagagaccattctcctctccggacaaacatttccgcgtccgtaacagtcaggaaaagactgtgcaggcgtactgcctactggagtggagtacatctacatgcagtatnntnnnnnnnnngccagccacagccacatcacatctcttgtcaacaatagcattggggccgttgctgatactttcatcctcgtcaagattaggatgcttgttttcaaaaataaaaaaaaaattaaaaaggagattaggatgctcgaccgctcgtgtactcgtgtttctcttcacgaatgatatatggtaatcgttgcactgtgtgacgacagtgt

SEQ ID NO: 75666 - DNA, 3601 bp, Oryza sativa
caaaatttcttcaaaaaagaggggaggtcatgccaaaatttatagtgaatttattttggtgattacatacaaatcggaggtgcctaaaaggtttgcaacttcatcctccaatgttttttttgtcatattacatttggagctatgttttgcacacttttttgtctccaaaatttagttgtcagttgatgagagagaaaatttgtgtggggaagaaagaatatatagaaatttagttgatttgctaaagaaggttttataaaatagttgagaaggaaaatatagtgaaagttaatcttaaataatagaaaacaaactaaaatgaaaattaaaagaagtaaaacacattaatattagtttaaaactttagaaatagtaaataagaattatttggtgtaatattttatgatttttgtataaataaagatatgtcattattgtatgactcttgaaagagtttgtaattatcttataattattgtatgactgtcattattgtaagaataattatttgtgtacgattttttttcatgtcatgtagatggatcggcaatggatgtacgctgaccggcggtccaaagagtttattgacggcgtgcattattttttgagagtggccgaagctaacaggcaaaagggttttatttgttgtccatgcaataagtgtaagaatcagaaggagtattctgcatccaggactattcatttccacttgtttgagtcggggttcatgccaagctataattgttagacatcccacggagagtaaggtgttgaaatggaagaagatgaagtggaagatgacaatattccggactttgctcaatacgttggatttgaaggaaatcaaacgggcgaggaggaaagggatgctgatggtaataacgttgcggataatcttggtcagatgttgcaggacgccaaggaggactgcgaaagtgaaaagggggcccataaattggacaagatgttagaggaccacagaacgtcgttgtacccaggttgcgagtaggggcacaaaaagttggataccactctggagttcttgcaatggaaggcaaaaaatggggttagtgaaaaggcatttggcgatttattgaaactcgtcaagaacattcttccggagggaaacaaattgcccgagacaacgtacgaggctaagaagatagtctgccctctaggactggaagttcagaagattcacgcatgtccgaatgattgtatcctatatcgcagtgaggagtacgagaaactagaagcttgccctgtttgcaaagcactacaatacaagattagacgagacaatctaggagaagttgacgggcagctaacaaagaagagaattcctgctaaggtgatgtggtatttccctataataccacggctaaggcatttgttcaagaacaaggggaatgctagaatgatgcgatggcacgctgaagagcgtcaacaggacggaatgctgagacaccctgccgatggttcgcagtggcgaaacatcgacagaaaatttaaagactttggaaaggacacacgaaacatacggtttggtttgagtacggatggcatgaatccttttggagagatgagcagcggccatagcacttggtccgttacgatgtgtatctacaacctcccccctggctatgcatgaagaggaagtacataatgatgccgattattattcaaggccccaagcaacctggtaacgacatcgatgtgtacctaagaccactggtcgagatgttaactgttgtggaagaaggaaggtgtccccgtgtgggacgaggacaaacagaggaggtcatcgaattttgcgtagaatttattgaagaccttcgcccaatcggggtacctgaatcacgccatgaagggagactacggggaaagggaactctcggaaggaaagcaataatgacggtagacaacaatttattccgtaaagcccatttcacggttctgcaacaatcttcattggtagctccttacattgagaagcacttgctctagttcccgccaggaacatcggtaagtccgatgcatggattatacggcatcacattgatacttttcccgtgtggctacgacaacatctcatgggtaacgagtcgatcaaccaacaacttgccttcctggcgaggggatcgtctgggtcgatcgcgacattccagggatatgagatcaatgggtacacattctacacgagagcccaagacataaagagcacgaaccaaaatagcgctgttcgtgtcgatgccatgggacacgatggaacaactggcacgtattacggtgccatcgaggacatatgggaacttgactatggtcctctcaaggtccctctgttccggtgccaatgggttaggttgactggtgaaggcgtaatgattgatgacagtgggatgacaacggttgaccttaacaaggttggatactcagacgaaccttttgtccttgctaatgatgtaacgcaagtctttcacgtgaaggacatgtctagcaaaggaaagaagggcagagggcctgacgagcctaagcgtcacgtggttctcccaggcaaaagaaaaatcgtcggagttgaggacaagactgagaggattacgatcagttggatgggcaaccccctttcacggtgacgattgaccctagcatcctcctatcaaatgaagataccccttactcacgtagcgatcacaaggagggaacaatagtgaggagaaagtacgtgcggtcaaccgtcaccgccgatgtattgccgtaattattgtgtacacgatgtaaactattttggatgtattgattatccatataaatcaattgttgtatggcatatgttaattacgcacgattattagaggttttaacaattttaaatcatgtatatgctgctagttatatgcgataattacaatttttaaaagttttaaatcacgcaggtggcattttcatatgttaattagagtttttaacaattaattactatcattcatatgctaattatatatgactattcgaatttttaaaaattttaaatcatgcatgtggcatttacatatgttaattagagtttttaacaattaatttaatatcattcatatgctaattatatatgattattacaatttttattaattttaaatcatgcatggcgtatgtatatacatatgttaattagagtttttaacaatttaatatcattcatatgctaagtatatatgattattagaatttttattaattttaaatcttatatttgtttattacgttttatccacttaatttattacatacaacaataatttttcgaagtaattatcattaatttttctacattaaataattttaatgcattattttctattttagaaacacatatgtaatggaaattaatattcagtgcgcttattagtagtcccagttcttaaccctaaccgggtttaaaaagaatttcgaaatagcgggaaaatatctttagtcccgattgatgagaacaaccgggagtaaagatatctttactcctggttgttctcatcaaccgggggactaaagatctaggggtatatatattcccgatgcgtgacctcgtcttctccaccaacactta

SEQ ID NO: 75667 - DNA, 30550 bp, Oryza sativa
ggaatggttggcctgggttggcttgggacgagctgggacccagggtcgggttgccagttcggtctaaatcatagaggccttgggttaaggcaggttcgtaagggttcccggccttgattaataatattgtgtagctctaggatcgtctttataaatggctttgagcaactaagtgacttttaaatgcggttttctgcaaaacttaaccccgatattattatccccttgtactcccttgcattaatcatgcatctgccggtgtgacttgctgagtactgtggttgtactcattcttgctcaatctttcccccccttcagttagagaagctttggagaagaagtcttaggtggagtcctggcttataccccagttgagcgcctgtgaagatggagccgtaggcccgctagtccgctgctgtttatttttgtttgtcaggtcttatgtgcctttgtaataatgtaaatattattgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatggataaaacctaaggacatattttataaatgaaactatttgcgaaagtccctttttcctcctttcccctgtgctatttgcaaaatgtttattctcttttcttcctccttcggattttccactagtactagatggttagttttgcaaagaagaagatgtcgtcaattgtctgccgaagctccagaaggctgcaggatccgctagtgaagtgagggaagcagtgaagccagctgtgaagccggagtgaagatcttggagaacccgtcgcagaacctaagccaccctctagggtagagtcgttagtcgtgtgctcctttgcttgtgtgtgtagcgcgtggtttgcatcggtgggttgtgatgtaaccatgctaggttgtttgcttaatcaacttgcagaataagtgaaacaaacaacacatcaacaagaagagttagttcctttaaggtcctatctctagttctggtctattctttcctggcttgtttcctctctcacctcaatccctgtaacagatgtttaacagagaaaaaggaaagaatgtcagcgggtatgcctcaagtaactcaagttttcaactcaatccaccactggcctcaagagagttaaccagggcacacccttggtccattccgagcatgctgcttggttcacagctaccattggttggaagtcaagaccaaaatcagtatgtgtttgatcgagcatttgccacccaggtcgatgagcttccaatgccagaagaggatgtccccttttgtcacgattgtagagagcaaggacactatgccctgaattgtccatgggtatatgccaaagaagctccttcctttggtttagcagggcaggcatcgctaaaccagcctcctcgcaccaagtcaagcttgcagcctagtgtgcaaagtagagagcccaatggagagaatccattgaatcccgagaattgctttcctcctagcctttcgtaccacgtggggtcacgtactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcatgacagttgacccagcacctcctaagccatggtggcagagtatctgatagtgaagggtcagatcaagtctcctcggatgatgaagatgagtctccccgacatctcggcgaggaagaaatggaatcaaaggcatgcacccgttgtggagaaattggacacgttgctagcatgtgtctcacactctgccctcattgtgaggaagaccatccaccaggtgaatgtcccacccgcaaggtgacatgttttctgtgcgaaggtacaaaccatgtgcccaaggattgccaactcagtgtgttgttgaccaagaccgcagaaatccaacgaacaaccctacggttgtctcatcagctagtcagctccaatagcaacatcgacaatatcatccacaacaccaatgctcctcctgctccacctgactctgcaataaatcatagcaataataccttcagcaccaaccattctctgcaccgacagcctcagcaaagaattgttgtcgatggaagaagttgtgtctctccccgacctactccaggccgagcaaagggcaatcaatctcaggagggcgataccaagcagaataccgttctctgcttcaaatagcaatcagaaggaagcttctcctgtgaatgatagcaatatgcagtcctaacacatcatcacagaaccaatcaaggatgcagtcactagaacaatgccagctatatctctccagaatcaaaatgagcagccacgtttgtggtttttagttcgctacttatcattgtgtaatcgggagtttgcagcaatcatgtaataaataaatacattcatgattataaacaatgagtttgttatgtttatggatgattcatgttgaggatacaatgtaccgatgataagcaccttccctttttgtttaaggcagtgccttgtattcgtgtaataagggagaaatgtgtaatacagacaagttttaagaggattctattggaagatgcggatatgtgatcatgtgtataattgtttactgataaaggagacctagggtctcatttcagaggaatcatattctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcgggtatacctacaaacagttaagaagatccaggggacatcaatatttgagaacatagtagtcgatggttggtaattagtctatcaggtatcagaaaagggtcaaaggtgatatggcagaagaacaatttggatgctccccatctcgaggaagcactaaagaggatcatcggcaattaaaccctagtggcatagatacagatagcaagcaatgtatttccctgaaggtagtcagtgcagctttttgacgaaccacatcaaggtttcactgaaaggcagcaagccaaaggacttcatcgtccccagaagcgtccgcaatccacattaaagagtaccacctgttagagataagccgaaagaagattgataaaagagattggcaaagatgttctctagcaggaaagaagtaggccgaaaggtgattgataaaggataaacagaaacatgctctgcatcgctcaaggaagacccctgatagtaattgccccgcaacagtcacctggtcattgaggcatcatgaagtaagcaagacgacctaggtaaaagtgtttctttgaaggcaaggaatgaaatctttaactcggtatcagatgctacacggagtgaaaagtgcaagcaccggttaccaggcaatgccatgtcttgggagatgatccaatgggaaagagcacatcaaggttaaaggtgtaaaggaatacgttgaatgctaactaaggacaacctgaagataatagtgggaaataaactgaatgtaaagaaagtgaatccgagctgcttgtttgtgggagctattcccagttatgaaccaagtgatatgttcgaagatagtctacagaggtcagacaacgaagcttcagatttggcaggataacgatcaaacaataagaaatccagcaataaagccatttgggaagacgtcaaagtatgtcaagtgggataagttggttctcttgggaagcataattcaaaggcaacgttatcgacccttgcatcaaatagcagaagtagctattacccggagaccgggaaagctaatatgaggcagctggtggcaagttagaagtgaatgacaagcatgatattcttatgatgacaaacatggtatcctagtaatgacaagctagtgttgacgcatgacatgaagtggtaacttccatgaggttgacgccaaaaatatggactatgcgaagttctggaactgaagcaccatcttcaagtgccgcaacccagtcgaagtcagctaaaggttcaaccagggacaagtcgggtgaagagaagattccatctgcaacaggagatcgagccaagcagtccagagtggagaagttttgttaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccgaattaaaaatcattcgctaaaaggaataatagaattaattaaaattcgaaaagaaattggcaaacactaaaatacgtacaagaaaaattcaaatgcggcccggagaatttttgttaaattctccttggtctaaaaggagccctcaaattttacttgaattttcagagcacaaataataattattaagaaataaacaaagttaaaaaggttttataaaaagaaaaaccctaaaaagtcctttttccccccttcccctcttgggccggctcggcccatctccctccctctctctcctcctccccgcggcccactcggcctctccccgcgcgcgcgccgctgacgggcgggcccgcccgccaccctcgctgacgggtggggcccacctgtcatccctatcctcccgccgctcccgccgcctcgcccgtgccctagcgccgccgccgccgcgaatcccgccgcctcccgccgtccccgcgcgcaataaagagggggaaatcactccccatgattccctctctctttccccccatttttccctccctctctccctcggattcggttggaaaccgctcccctaatcccgccggcgccattgatggcggccgacctcccgcgccggtttcctcccttccccggccaccctctctcgccccggctctatttaaaccctccccgcaccccctccgtccggttccgcctctcgccgctctctctctccgccggaatcgagctcgcgccgtcgctctctctctccgccgtcgccgccgagctccggtccgccgccgtcgtcgccccggacctcctcccgtttcggcgtcgccttcttcgggttcgccgcaacctcgccgacctcgtccacccctccgtttcgcccgccgaccgccggaacgccgccgtcctcgtcgacccgagccgcgccgccgccttcctccgctccggtcgccgttcccgtcgccgccgtcgacccggggtgagccgtggaccgccgtttcgcttcccccttccctcccctctctcgggcgccgctccgccgcgccggtggtcaccggcagcgaccatcggggcgcgggtgcgccgcctcccgtcggctgtgccggcctggccgccttcgggcgcgccccgcggctgccatgtggggcccggccgtcagccgcccgcgccctcgggtgcggctgacacgtgggacccacggcgccggccggtgtgagccgggtgcacccggtccaccgtggaccgagaggctgccgcgtgggccccactcccgtggacccggtccgcgcgctcctctctcccggctgacgcaataaatctattttaaattaaaatttaaatgaagaaattcgcaaatatccatttaaaaagcatataaacttcaaattgccataacttggccatttgaactcggaattggaccgttcaagtctctaatttttccttaagaagtcaagaacccatttttgtgctttgtttctgcttgttatatggagtttattagagtaaaagccgtttcttttccgttggacgtgtagacgctgcagcttcggaagatccgctcttcgtggaagttgaagccgacgtttgggaaagcgagcaaggcaagtcacatcatccttgagcatattgaatcccagtttataaaattattttaatttaaattaatgcattatcgctttatttaaattcccgcgttatcactgttttatttagccatgcctatttacctttgttatgacattattattgctattgttattattaccttgttcaccctaggaaaataaaaccccaactagtgggtactctatttatggttccactagtgtgaacttaggtagatgtttcgctggttaattaggcaacattaggtggttttataactttagactctgggaaatctcatatcatttggacattatggaattgttggattatggtggaattggacatacccctcccttcctctttcaaagcccctaaaacctgtttttcggtggggtttgggtgcatgccagttgtgggaagtagcaccccggccactataaggattaagctcgggcctctgttgcaaagcactatcgtacttccacatgtctagtgggtaaggcttagtttgtggctcactctggttataaacaaaagtacacggatggagatggacgaagtcgggggtcgatggacatctctaggacaaatgaaggctacacgagctgcggcccggtagtcgagatgtcatggcacagggctggtgtcctgctgctagggggctcaatcctgcctgcctgtcccgggggttccggccgtaggtagggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtgtagctctaggatcgtctttataaatggctttgagcaactaagtgacttttaaatgcggttttctgcaaaacttaaccccgatattattatccccttgtactcccttgcattaatcatgcatctgccggtgtgacttgctgagtactgtggttgtactcattctcgctcaatcttccccccccttcagtaagagaagctttggagaagaagtcttaggtggagtcctggcttataccccagttgagcgcctgtgaagatggagccgtaggcccgctagtccgctgctgtttatttttgtttgtcaggtcttaagtgcctttataataatgtaaatattgttgatataataaagatgtgtcttttatatcatgtttatgtggtgtaccccggcttttcctgggacggggattaatacactagcgttcgggaaaaggcaattttcccggtcgcgccagtagggttctaatatacgacagttagactacgcatatatgactatttaagttttagtataagattatttgagttttaatataagattattatatttgtaattagacttagtatataattattgactagctagggtcctataatatacgtcacctagacttagcatatatcactatttgagttttagtataagattattagatttgtaattggacttagcatataagattgtgtagggttctaatatacgacagttacacttagcatatatgactatttgagttttagtagaagattatttgagttttaatataagattattatatttgtaattagacttagtatataattattgactagctagggtcctataatatacgtcacctagacttagcataaatcactatttgagttttagtataagattatttgagttttcgtataagattattattgttttaatatacgattattagatttgtaattagacttagcatatacgagagttagacttagcatatacgatagttagactaagcatatatgacttcgcatatacgacagttagacgtagtatgtatgacttagcatatatgattgttagcatataagattgttaaaacataaatgtctcatgacttagcagcagtttcctgtatgaacatatggctgatcgcgatgagacatagtatgtatgacttagcatatatgattgttagcatataagattgttaaaacataaatgtctcatgacttagcagcagtttcctgtatgaacatatggctgatcgcgatgaggaacagatattgtacgatacaatcgcggagggaagcagccagtactggaacgaagaagaggggaacgaggatccaaaccagtatttgaacgaggaagggaacgtggagagggatgcggaggggaaccaggaggagcacgtggagagggatgtggaggggaaccaggaggaggaggctagtggaagtcaaccctccgctggacagaagagggcacgcgggcaacgaggtgccgcaaagaagcttgagggtcggcacatcataacggaagtggacgaagacggccgacctagtgccccggcagaagccgccaagaactatgtacgtcacagcggttgggttgtgcgggataacgtgcctgtcagtacggtgtactggcgcagaacaagggcacgcagagatcatgagagctttgtcccagattcggagaaagagatgatgtggaccacaatgctcgaaacattcacccttcccgcgggtacagaggacaaagtgaaaaggtggactctgaagaaaatggcagaacagtttcagagcttcaagggagatctgtaccagaaatatatcctgaaggggcagacaccgaacttcaacacattcccaaagctaagggatcactgggacgagttcgttgcatataagacaggtgaaaaagggcaggcgatgatggaaagaaacaaagaaaatgctgccaagaagaagtaccatcaccacttggggtcaggcggctatagcatcgtgatgccgaagtgggaggagatggaggctagcttgcttgagaggggtatcgaaccggccaccgctaattggccggaacgatcgaagttctggtactatgctcacggtggaacgctcaacccagctgatggctccctggtcttcggcgatcagatatgcgaggctgcgtgttgactaacagacgcagtggaagcctcttcttagggcacgttccgaccggacagagagaaggacgagctgtcactcgccctgcagactccagagcatccaggacgaacacgagagaaatgggtgattccttggaagattgggttcaaggaggacatccacacgtataggagtcggatgaggagcaagagagataccgaggcgaagattgcagatcttgagttcagggtatcgagctacgagctcagcatgcaagaggaggtggcaaggaaggttgatgaacgcatggacgcacatcggtcccatgatccctagccgaccatttctcctgcaatggtgagcccgtcaggaaatcgtagcagctgcgcctcaacggggcaggtaggatcacagagcatggacgccatgcaaacccaggacgaaaccacctgcccggtgatgacatcactcagcggacaccatgtgagctgcatattcccttcaagaacttatcaataaaggtaagctcgtagtttatagatgttagatttggccattccgctagttgctgcttatatatgttgattactaataaataacctctcaccacatgaaggtggcgtcgggcatggccatcccaacggacccttcaggtacttaccactgtaggccgattccagcaggatactccaaggtcaaagttgagttggtcgaaggcgcgtacgaggacctcgagctggattaccctggaggagacggtgagacgcatctacgagacacaagccacgccattattctatggcacaagcggtacatcatcctccctgggtgacaagcggcgtctcgtgcaccatctcctccggctccgccatctcctcctcaggctcctgcaccgactcctcctcaggctcctacaccgactcctcctcaagctcctcttccggcaccttccaagtcaagggcccccaagctccaccgcctgcccccacaagggcaacgaagaaggcgaaagttgacaccgccaagaacaaggacccagggtacgattgcacgcaagaggagcttgacgcttacgtggcattagaagtcaggagacaattgaagcctcgaagtccagaaaagaagattcctatagacccgagtgtcaggaacttcttcaggggtatgtatgcacctgccaaggaggccataaagctatcggactatgagcgaacactcaagaaagcatcttctggaaagtccaaaccagtccctcagcttggagagcaactaaaccaggagatcgagccgttggtgaccggtgaagattttggaatacaagactttattaatgacaccggactaactacggatcaattgctacgagacgcaccaatcgaaaaggcggaagtgaaatacatgtacgaactcggtaaaccgcttgtcaagcttgagctgctgtagtccctacccacacaaatgtacaagtaccattagctgtacatggagatgagcgccaccggtagagagatgatcggagcgaggatcagggacacggacttcttgcaaggagatgacattctctggatcaatttcaagggattctacgaactataccagctggacgccctcgacgtctttattatgagttgctggattttgtaagtatatcgttcagttagatttcttacaacgtttcctttaattaattaggtccttgtatataagtagactatataaaatatatactctcttttatcgttgtagaatggagattcaaagggcccgacggcggggggttttcgatactggattcatcgaccctcggaaagtaaacgttgcaatgctcgaccaatatccgcaagccacagaggacaatctcgtccatctcctgaaggcgcagcattacaagatgttcatactgttgccgtacaacacagagttagtttaattttactgtcttcctataccaaatttcattcccgtacgaacatgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagataggtactgtcataagttcctatgttaattaagaatcttgttatagttaatttctactacgaatcatagctttaaactccatgtggggcttggtattggttccgtcatttgattcgcggcaaatggagagaaagacttagcggaagttcaaatttcctgtgagtacacatgctctacatttatatttctccgcttcaaatacatacaagtatatattaattagatctctcgttgtttgtcatttatttatagtgcgcaaagcaaaagcagggaattaacttgtgcggctactacatgttcgagtattgccactgccttgcagaccaaatcatcaccacaagagagcttgatgtacgtacaaataaattcaaaatttcattacgtatcggtttgttgtttaattactaatcaatttcatacattcatatagtttattcgcatgagggataacctgatcacacacaaggaatttatcgcggcggttcaagaacaactcatgggattcatcaacgaacaaatccttgatcccaagggtgaattctactacgacggaaatacaattcataggtccttatcgtctgagatagcgactactactacgtcaaaatcgtagctagctaggacatataatggattgtaattaatacatgactatgtttctatatgcatgtgtacacattttctataatgtaaatatatattttggtcatatatatatacatatgcatttgcataacatatatatatgtataaatacatatatattatgcatgtacatatgtattgaaacatatataaatataatataatatatatatatatacatatatatgtgtatatattgaaacatatatatgcatggtttatatatatatataaaccttgcagcaacagggccatgtaaaaaaaaaaggtcagctcgatctttagttccggttggtaacaccaaccgggactaacgatggctcagccggccacgtggttgagccaccaaccgggactaaagatcgatctttagtcccggttatttcacccgggactaaagatagcgatctttagtcccggattggtagtcccggtttggaaaccgggactaaagggggtttacgaaccgggagtacaaacgctttctccaccagtgctagttcaacatctaaaaatctaaatgtcatgcaatccgcaattgtgatttaagatatatatatatatatacatatatatatatatacatatgtatatatatatatatatacacatctctgtggtcggtaggagggagctcgctagctgcctttcttttttctttctgcatgcggctgtaaatataatcctatgatcatgtcagcccatactcccatgtgaagatttgagtacccaccaaaaatgtgttttttctgtcgagagtctcggacacaggcatgaagtacagtatctagctattttgagctaattaatggatgtgtgctcacaagagcaagttaaatattagagctcactactaattataagcctatactatagcttatatatataatcagaaaacagacaacggtatcctattggaacgggatacccttttatgagacagtacctgatacctctgttatggtaccagctgcatagtactcgatacctgtgatacctattactcggtacttgtgatacctaggatctaatatctgtgatacttgtgcaagataatagttaatatgtctatgccattgtcgcgtcccaaaatgactctaaaatacatcctcgaaattatgcctagaataattaaaatccttgtgaaagcctcccacaagtaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaatcctaaaaagtcttttcccccctccccctcttgggccggctcggcccatctccttccctctctctcctcctccccgcggcccattcggcctcctccccgcgcgcgcgccgctgacgggcgggcccgcccgccaccctcgctgacgggtggggcccacccgtcatccccttcctcccgccgctcccgccgtctcgcccgtgccctagcgccgccgccgccgcaaatcccgccgctcccgtccgccccgcgtgcaatcaagaggggggaaatattccccgtgattccctccctctttccccccatttttccctccctctcttcctcggattcgttcggaatctttccccctaaacctcgccggcgcatcaatggcggccggatcttccgcgcccgtttccccctcatccggccgccctctctcactcccaaccctatataaacactccccgtgcctccctccaccgtttccgccactcgccgctctctctctccgccggaatcgagctcgcgccgtcgctctctctctccgccgtcaccaccgagctccggtttgccgccgtcgtcgccccggaccttctcccgcttcggcgccgcctcctttggtttcgccgcaacctcgccgacctcgtccacccctccgtttcgcccgccgaccgccggaacgccgccgtccccgtctacccgagccgcgccgccgccttcctccgctccggtcgccgttcccgtcgtcgccgtcgacccggggtgagctgtggaccgccgattcgtttcccccttccctcccctctctcgggcgccgctccgccgcgccggtggtcgccggccgcgaccatcggggcgcgggtgcgccgcctcccgtcggctgtgccggcgtggccgccttcgggcgcgccccgcggctgccatgtggggcccggccgtcagccgcccgcgccctcgggtgcggctgatgcgtgggacccacggcgccggccggtgtgagccgggagcacccggtccaccgtggaccgtgaggctgccgcgtgggccccactcccgtggacccggtccgcgcgcccctcccctcggctgacgcaataaatccaaattttaaattaaaatttaaatgaagaaattcgcaaatattcatttaaagagcatataaccttcaaatggccataacttggccatttgaactcagaattggaccgttcaagtctctaatttttccttaagaagtcaagaacccatttttgtgctttgtttttgcttgttatatggagtttattagagtaaaagcctatttacctttgttatgaccttattattgttattgttattatttccttgttcaccctagattaaacaaaaccccaactagtggacactctactcatggtaccacttgtatgatgttaggtagatgcttcgctatttaattaggtaacattaggcggttttacaactctatactttgggatattcatatcacctggacactttggaattgttggagtattgtggaattggattcacaccgcccctctattcaaaattcccaaaatggttttaggctgggctcggggtgcatggttttgatagtagcacctcggccatataaggaccggtcttcgggcctctgttgcaaagtactaccgtacttccacatgtctagtgggtaaggcttagtttgtggctcagtctggttataaacaaaagtacacgaatggagatggacgaagtcgggggtcgatggacatctctagggcaaatgaaggctacacgagctgcggcccggtagtcgagatgtcgtggcacagggccggtgtcctgctgctaggggctcagtcctgcctgcctgtcccgggggttccggccgtaggtgggattgggtcggtactcttgtctatggctaggatgggttggaaactatgtcatgtcttccgtccatataccatggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaatttttaaaacctgcttaacaactaaaatgtggaatggttggcctgggttggcttgggacgagctgggacccagggtcgggttgccggttcggtctgaatcatcgtaggccttgggttaaggcaggttcgtgtgggttcacggccttgataaataatattgcatagttctaaaatcgtgtttacaaaatagctttgagcaactaagcatctttaaatgctgtttactgcaaccctaaccctttatattataactcccttgtaatcccttgcatttattatgcacttgtgggtgtgtcttgttgagtacggtggttgtactcagtcttgctcaatttttcccaacccagaagaggagcccctcgttgatgaaggctttggtgtctagctcgtgcctgccgtcaagcgcctgtggtcgtcgccctagtcttccgctgtttctcgtttgtctttgtgtgtgctgggccttcgtcgcccatgtaataaattatctatttatgcttccgcttgttaaactctgaattgtatcaactcttggtgtaccttgcctcctgggacaaggaataatacacgcacgaaaggaacgcccgttgggttaattccggtcgtgacagccattacaacggaatcctgttttgtagcagctctctatagattttgccttgaaaactactatcacaatatcataaaacttatagtattttatattctaatataaaaatgccacgatatgagcacctaacaccgacctgaacattactagttctcatgaaaaaaaaagaacattagtaattaattaattaattaattactaaatttgcatgttctagagtcacatccgatgcaagccacgcacaagtctgatccatcgttgcggccaccaaatcaatatatatatgtagctaagtccacctctgctccctactggtgttttttgcgccttaaagcgaggataatagtaagctacaaataagctattgttaacttggcggttcccggtgactcctcaattacgattatgggatttactgacatccccaaccgtcattagcagctataaaaggatgtcactctcttacttataacacactccttaaggagctattctctctatttcatattgtatctttataatatttgtggaaataggttaaaattatcttcggtcctatagttttcttgagatcccagtatgcctttagcactttacttttcttgtaagactatagttgaattaatagaattattatttatatattcttattttcataatttatatactgctttagtagttatgttctttatgaataggatgtaattcatttatatgtttcacttgactaggtaggccagtcgatctatattgaggtaacggtccaacgaccttgatgggttgctctagctctaacttgtccatccgaaaggtgaaagtcccgagggagttagttttattatttactaccataaatatggtgcttaggttagataaatgccattgggtgtgggtgtgccccacggaaagtgagggaggcaacacgtggtgacaatcctctgtatttctccacgattgggtatgacgtaagagtgcataaatgacataaccaagctggcagactagcatggagtgattttttagtagtatttgaataccaagaactaagttctagccttgtgagcatgtatgtgtgcatcgcactaccccttaatcatatttatcctaacccttatttagactatggtaagttaattaattataggttgactaatgatgtataaactatgtctttacactaccgccttctctgcaaaaatataaataagatacccttagaaatactcatgggcgaagtgctataatgatattcgtgtgcttgtgaatttaactgtgaacgtaagaaataccattagctataagcttatgtgaaagaaagagagaaagaaaaatagaaagtcttagctctcgtgcaagagctaattctatcaatgttccaaaaaatatgcattaaattcatagtgtgagaaagaataaagagggaaaaacatagctaacctattcagaaaaactacctaacggcatcccgtggtgacgggataagtggataaccatccattcttatcagttctctttctgtctctctctctctctctcgccgatcctcgcttcgtcgtcatccttcgccccactctccctctgtaacttctcttttcgttcctagcagaggttgggacatgattccatggcaagccctttaacaagatcggaatagtccagcgcttgctgtgctaatgtcgcatcaccgacggtggccatggggctctcgcatgccagggtcggggaagagatgcaacaagttcaaggtgggagatgagttgaggtgtgtcgcagatgatgtctgcaaccatcacacttgtgtgggtgtcgaggatctgggcaacgatgctctggatcgaggatgacaacaagaatgaatggcatccctccacctctaaggaagtaaccatctcattttcgcgcttgcctttgccttctttcctttctcttcatggctctcatcagtgtgaatacatagtactcacagagtatttgatgcctgggtatcaagttcctgatacctaggtatcgagtaactggtacccagattatccggattagtaccataagtagcaagcctgatacctcaggtatcagggtaccaggtacctagggtctgacacccataggtaccaaacctagtactgatatcgggtacctaggtatcaagtacttggtatctagatcaatttgatacatgtaggtaccagatacctagattgatctgacacccataggtatcagacctagtacgggtattgggtacctaggtatcaagtacttggtatctagatcagtctgatacctgtaggtaccagacctggcactgggtatcgggtacctaggtatcaagtacttggtactttgatcagtataatacacatatgtatcagacctgatactaggtatcgagtacctggtacctagaccaatctggtactcaaaatggccctggtgttagcatcataacaatcgaaacgggtgtgttgtgtctctagtgagaagacgtgcactgacgtgttatcccttgtgaggacacgaagagacgtgggctgacacatgaaccctcacgtggggtgaagttgataaaataataagagaggttagttggtcaaatagtcatgctcattaaattatcccgttggaacgggagtcagtgctctagcagtcctcaaatctatagtatgtatatatattttaaaactatgcattgagaagttagtgatggtcatttttaaaattttgccgaagtcttaaccttaaaacattcatcactggaggaagcggatatattccatatcagccaagtttctcaggagaagtatttaaagcatcttcttttttatccaccctaaatcaactagtacgatacattgaagaacaaacctttaaacaaatgccagtgctaacgcaatgccctgcaccgaaacacaccgcataccttatgtgcaaaccatagcaattagtgaaaagtgcatagctatagagatactagaactttggaaaacactagtatgggacgtccaatccctaacaaaaatttcaatgttcccaattcaaattgactacccattcctcttcccatgaaatagctctttttagcacctttttaaattattttttcctacactatttatctgattcatcttattcatcgtaattaaatctttaccataagatctcacaagcttatattttgacaaaaaaatatttgtttcaatcattaaaatttgatgtttcacatgtaaacaagcaagtgtttcaactagaattccactttgttgcacttttttaatggtttttttaagtgttgcacatgcactactacaaaaatggtttttcctggcaccacatgttttaatttgttggcgggtaaaatagaaaaccccagtgaaaatacaacatgaggttcctagttagtgaccgccattgaaaatctatttttgcaagcggtcgtcttaagagatctgccattaaaaataacactgtttttacagacctcttaagtgaccgccaatgaaaatcgattttcgctagtagccactgaagagcatcgtcgtgaaaaactacagccctattaaaactctccacgccctcccccctctagatgtctccagtgacccctccaagtctccttatccctcctcctcttccttcctccttccgcacgtgcagggggttcggcggcaacgaatcgcgaggagggccggcggcggtgactcgtgaggcagccgatccgatagcaactcgcgaggcggcgggtccggcggcaacgaggtgcgtagagggtggatccggcggcggcaactcacgctggaggctgatccggcggcggcgagtctagcagcaacaaggtgcgccgatggcagatcctgcggcggtgagtcacgcgatggtagtggcgactttcgtgtgtaggggatccggtgccgagttaggcggcgtcgactcccaagggcggtagtgggcggctcgccgacaaggaagacgagcggtggcggcagctcggtgacaaggaggaggagtggcggtggcatggcgatgaggaggaggggcggctcgtcaacgaagatgaggagtggtgtgttggcaactttttgtgacaagtcgataagcacgatcgcagcacataaataccttgcggtgatatagagtcgccaacctccttaatctagccaaaagaccaaatcaagatgggttttctagaaaaacggctaagccggctagcggagccgatttagagatcaaaatcagcctctaggccgatttttctaggataatttcctgtcttgtgggaaaaacggaaggttttcaggacaaacctacaaagaggtgtcgcactctcgcagcggtagcggacgatttacagcgcatatcgacaaagatagactaaaactagggtaaagtagaaaacatggtaaaggaacgattcaagtagattatattcgggattttacaatgaaccggccttgacccttaaataggggttggtcttgccctctacaggcccttcttcacatccaactcgggatagaaataaaaggaaacatgaaacatagccttctcgagcaaactcgggctcggactctgccggtcagaccggccacacaccgccagtctgaccggcccactgtcggaggtctgaccggccaacacacggcggtcagacaggccctcatagagaaaaaccagcagacttccaaactttgaaaattttccctattttatccctaggtgccaaatttgggtgtaaacacatctccccccctccctttttgatgaatatcgagaacctaaaagcatagaacatgttgtcttagggcgataatccaattacctgccatggaacttcctaagcatcttgccaaacgctaagtatttcttcaagtatttcctattaattgctctctgaaaacaccatcttaaagtgcctccatctctttcaaagtgttcaaacacttaccgatgacgtcttcaaaattacctcccatcatggtctttaatcttcaaccgacaagtcgtcttacttgaaataccgaagagagccaagacttacctcaactggcaaaatggcttttgtccagaaaccaactcaaaaggagtgacttcggtagcaccatgcttagatatcctatgagcctataatgcttccgaaagcacttcatgccacttcttttgacgttctttaatcttctctttgactaaatttaacaatgatttattactcgactcggcttatccattggcctgagcatagtaagaagaagaactccacaacttaatatcataagattcggcaaaacttctcacctccttggacataaaagaagctccttgatcaaagtttaaggagtaccgaatctatgaacaatatgcttcaaaacaaagtcaattacctccgtgtaaataaaattcatgaacggcacggcttcggcccacttggtgaagtaattcatcgcaattagcacgaaccggtgcccctttgatgacgaaggataaatttgaccaataaaatccaaagcccaacctcggaacagccatggtttaatgataggattcaacacagcggtaagcgctaattgaacattgccgatccgttgacaaacttcacatcctctatagtacttgaaacaatcatcaatcacttttggccaatagaatccaactctcctaagcaactaatccatcttacgggccgatttatgagttccacaaatcccttcatgtacttctcccatagcaaccttagattgatcattatctaagaacttcaaaattactccatctatttttcggcgatataactctctatcaagcaaagtatatttgaacacttgccgccgaattttccgatcaaccctaagactaggatctttcaaatattctattcaaagggattctctagttttcttttgactcttgggcacaaatatccgaattaataattaattcggcctttgaatcaattgtaacgtgccccctagctctctacccaagatcggtcagaccggccacgcaatgccggttagactgccttgtctgcacggttagaccggccatgcagagccggtcagaccgtaggtccaccactggtcagaccggccgtgcaatgccggtcagactgcccctggtcacccgaagattaaaaatcaagcaccgacttttctagtataaaaaatactcctttcttcatattatagccagatgcttggtgtatcaaattattggaccaaaatttcttatttttagacatacgaaaaattataacatccaactaatatgtctagatgaatactaactcaagtggcttttgaaacaataaacatcaaggcatcaaaaacacttagccacttgaagtatgatcaataatgaatcaccaaagtcatatgtgtcacatgcatagattccaataaactacaaatgtaagtaatcggcttgagcatgtatgcaaaatattaacaatgccaacgttcctaaagaaaaccactctagagcaaatcatcacattgaccattgacattagccaaattactaataagcaaaactttcatggtgcaataattatgaaatctatatcctctgtggtgatccataaaaaaaacatgatttggcttttaataaatatcaaagactcatgagccaaatcatacctcaatcaaattatatgccaacttaccgattctactacttagaactggcatttgcaacatgtatgtgtaatgtgaatttgataagcaaacacatgtgctagatagcaagcaatgttctaacatggcataggcatataatataatgatgaacacaataaacccataccttgccttagcatccaacaaacggcggctcaaagatgaaatgttatatccatcaccgttcatcttctcttgatttcttcatgagcatattaatgtcttgccccccgagtaaaatcgattttcttgattgcacgatttcgaaggcaagatgtataccgcactaacaaccatagcatcatgtgaaggcaacttttctctaatgaccgatgattcttctctcaccaaattaaatctatcactactttgggaaatcactagtctcttaacttttacttctttaggtctccacatttgcttagatgctgttcgaggctctaaattattacatgttttgttctccacatcttcggcctccttttcttttttatctatggcccgaagacgttgtagcctcctcttttgagagcgagataagccagaaggtatccactacggctgtggttgtttttcaggagccaagcaatgattcttgatatctttggttaaagtagaagctcctgtgttactctcaattttctcactcttctctaatgccgcccggtcagaccggcctctgggcccgatcagaccggccgtagtctggcggtcagaccagccagacgcctcagtcagacctccgcttttgacaatcacggtgtcggcttcgatctcctttgcttgtatgatttccaccgcatctacagtaagtacttgaacatcttgagactcctccttgataataacgaccgccagagctttggcttcttttctcacccacaccttctttacctttttcacctttgatccaccggaccgattattttacgagaaacggtcttgtcttgaattagatgaatgacttggtactgacctaggtgattccttccatccttgatgaaacggcgtagagaattgaggcatccatggcatgtaatacatgaaaggataaccaaacggtgacattggatatggataccttggcatcacaaccggaggtttgtatggagttggtatagttgatggctgcgattgctttggtgtttgtccaaatctcttcctacgagatgatcttgatctttttgaatcactagtttggttatgaaatcgttgaccagctaatcctttcttgtacttagccataagcatctcaaaagtgagcttcaactttttagttttttgggaactagatgactcatcctttgcaactttatgatcttcggcctttgaattattgatcctaattgtcttgggccgaggatccctaataataacacttttccatttctttttgtcaacatcaataggactaatagagagaggatcactaataattccggtcttaggcataggtgtaaccgaaatagttccacaagtgaccgatgaatcatcaatcaacctttgctccatcaagcttacatctttaaaataatcatgaaactcatactccatttgtgaccatgtagagattgaactaggagcaagtaaactataccatgtagatgcaaagtttgacaaagaaagaggaaacaactttaacttaagcaaatcattactaccaaccttaccacattgatcagtaaattggccaatatgctccattgtagtcatagcattctgacctgttaatttcgtgaagttgggcacctcaaatccttgcgggtatgggaccgaatctacatgtttaggatatggcctttggtatgtatgcatagctacttacgattctatttcactgctataccgcaagacattgtcatcatcttttccaacattcacatgaccgatttgtgattcggtcttaggtaacaatgctatttcagtttcgcttgtgaaacaattcgaaccgtcatttagtttagttatactctcaatggtgtcattgtctaaactagcaacacaatccgaaccatcacttggttcggctattccatcattgtctaaactagtaacataatcataatcatcgcttggttcagctatattggttattgcattgttatccaagttagtaatacaatccgaaccaacatttgtttcggctatacttattatggcactattgcacaaattattagcacaatccgaaccatcgcttggttcggcaatacatgaaattgcactattatctaaactagcatttaagctattgtcatccactcggctttcctgagccagagcttcatgcaacacatgatcaacatcaagaaatatctggccattcaatctctctttaataaaatcaagcaatccatcatatgcaatgtcggccaaatctttgtcaaatattttcaaactaacacatcggcttttaatatctctaaacctttcaatataatcagcaacagattcattgtatttatgcctaatcgatgataaatcagataacctaagctcagtttcactagtgtgaaaataatcatgaaatttttgttctaattgagcccaagtatgaatagaatttgccggtaaagaagttaaccatgtaaaagcagtaccggacaaagataaaaaaacaaacgcaatttacatgtatccatattactagccctaccacattgcgctaaaaattgacctacatgctcgcatgtggtcctactatcctcaccactaaacttggtaaattcagaaattctataatcacgaggatatgggagaatatcataataatcaggatatggcttttggtactctctagcacgattccttggctcaactgcgaaattttccctgataatatttctaagccaatcctccacagtttcaggcctcggtgaatctagtggtgggtttggtggcctaaggggtggttgttgcggcacaatattattatactggccatacccagtgtcatgagaatatcctccattaggatcattgtaagcattagggattagggatgtgtggagtagtatgactaacggtattaataggtttataataattaaaatcagtactgctagtcgtggaatgaaaacctggagaaatttccagggaaccggtctgaccggctatagatagcccggtctgacaggccaagcacccggtctgaccggcccatggcccagtctgaccggtggtcagtggtgcggtcagaccggccacaggaggcgctatctggtcaggatagggcacggtctgaccggcgtagtacacggtctgaccggccatggtgggtacggtctgactggcataggatgcggttagaccggtgtcacgaccggtcatgtcgttagctaggttctgcatatagccgattcctgcgtaatcggatgtataaacatccattgacccccatagcattataagcatattgtataggagcaaaactagaagtagcatatgcatctacacaacgattattaaccttttgaatagcaaaggacgagttgggcgaatcggaggttacctttggtgaaactacaacttgaggtagcgggacgttctttttcacgacgccttgatcggtcctaatgtattgtgtagtaatattgttgaacccgtttccgctcgtcatagttgatgaagaaattccttcattaatttcggccatatagctcatagccgaaatctttgatcgaataaatttgatttcttgatatgtcactgtgtttagccaattttatcaaaaactagcctttgttgattgatacagggtactcggtactgtagcaaatataccgaaaaatcaaccgatctattagattcgatcggctgctatgtttttttttttttgttttcggtatgtgggcagaaaaaaatcggcttttgatagcctgatctctcttttttttttagaactcgtatactcagcaaaccgaattgagtaagattcaaattttcctgccgtgtacagcaatacctgctgctgttgatcggtagatcgactctagtagcctgatcttttctttgttgccgtgtgaaacaaaaaggaaacgttgctaagccggctgctgcttcctgataattatcttcggtacacacggcaagtgctatatgaatttgatgactaccaaatagctttgccgccgaatagatttagcgataagaacagtgcagcggctataacaattaaggtgtagattaatttcggccgtttggcggaaacaaactgatttgacgagatgactagagtaaaccaaattcggctgtaatatgaccgaattgatcgattccccagggagtgctcaaaaatcgtattggcaacttttttgataagtcgataagtacgatcgcagcatctaaacgtcttgcagtgatatggagtcgccaaccacctcgatctagccaaatggccgaatcaagatgggttttgtagaaaaacggctaaaccggctagcggagccgatttagagatcaaaatcagcctctaggccaatttagatcgatatgaggataactacgcgtctcgtgggcaaaacggaaggacaaacctacaaagaggtgtcgcactctcgcagcggcagcggacgatttacaacacaaatcgacaaagatagactaaaactagggtaaagtagaaaacatggtaaaggaacgattcaagtagattatattcggggctttacaatgaaccgtccttatctcttaaataggggttggtcttgccctctacaggcccttctccacgtccaactcgggatagaaaccaaaggaaacacgaaacatagccttccctagcaaggaaactcgaaacccgatgaaacagactcgggctcgggctctgccggtcagaccggccacacaccgccgatctgactagcccactgtcgacggtctgaccggccaacacacggtggtcagaaccggccctcacaaagaaaaaccagcagacttctaaattttggcaattttccctattttatctctagatgccaaatttgggtgtaaaaatggtggtggcggcttggctcctcagacctgtggtggccgggcttgatagcgacagcctagcgtaaccagcaggagagaagatctggagttggtgacccacctcgtcgtcgacctccgtcctccctaccgctgactatggtgtcatgtagctcgattttcatttttttttcaaaatctggatactgttttccatttttttaatccaaaaaatattttcacttgtggttgtctttatcttgccgccagtgaaaatagtttttttttttgctgtcattcgtcgatgtaaatccattttggccatcagcgaaaatgacctttgtagtagtgatggtgttatttggatgtttcaagaagtactttttgctgtttcacttgtttcaaatgcaaataatgcatgcgttgtttttggataagcttaaagtatttagaaatgtttcacaagctcatttataacgattgcacatggtattatttgagtgtttaagtaaatattgtgtgatgtttcaatggttacaacttgatgattcatgtatctaataaaaatgtttcaatatattttttatccgaaatataaccgagtccgatcttattgtaaagatttaattataacgaatttaagggtgcacttggatagcatattcgataagtaatttagaataaaaagtgatttaaagatcgctaataaagtataaaagagaaaagataagaagagaagatactgcaccaagtgtatgcatgcatgagcaaatagcctaaacacaagtggttgaaaatactatagatttgtagcccacgcaaaaaggtatttgtagcccacgcaaaaaggtagtaagcagaagatgttggcatacgcgtaggctacgatagtataaatcaaaattttctatcgcgtaaaccaggaaccatgcaagtattagattatagatcgttaccactcgacgcgctgcgcagcgaaagaagacgctgagaagtcgaaggaactctcgcgaagaagcacaccggctcgaccttctcctcctcgtgcgttctcctcgccgtactcccatgccgatcagcaccgcaaaccagcagtgcctctaccggtatccacacgtacagggacggaacgccacgcgcagatgtgctagcacccgcgcacggctagggttttgctcgggggagggaagtgacggctagggtttctcgcatgatgcaatgcctccgccggccacacccctcacgaatatataggatccatcactcgggcctccaacgcccgtaggactcctattcggatccctatccgaattaagctcatattggatctccatccaatccccttattccggcccattaagcgtccgaccctgtaggttcatgtatacttggctgtaacccgaaaactctttttcggtccacgcgtcaatagcggcccctagtagaacgtattgacacaccgggcatacataaagatcatatcggctgaacctctagtgtatacttgtatgaacccctttgcctcatgatatcgattaagctcaaggctagatatgtgtcatcctctaatagctcaatcattcactcgaacctgttgatagattatataacttgtgattgactcctcaatcacctttgccatggccatgaacttccataatctacaacatcgaggggctcagagatatctctccataggaggggcaaatcccatcttgattattcatatccaatacatgtttcatagcatacccgaaaactacttttataacaacccaattacggagtagcgtttagcagtccctaagtaagctacaacacatgttgggaaccatgataatctcaggtctaaggattcaacaccaacactaaatgagataactgatgacacaacacatatggctcttgcagtgtctcatgttgggtctatccaacaacatgttcactaacatgtgtccacattattaatttggtatctctataccatgatccatgagacatgatcatcaattaatacatgtgctgatcatctaaacatatttgttccacatatgatatttgattagggatcctttagaaatagcaacacataacataaagagtctcatgaaagaatcacatattcattaaccaataatgagtttatctatttcaaggaacaaagtcgaataaatatgtaaacatagtatgtgatacaatcatctctatgattgcctctagggcatatcactaacagtctcccacttgcactagagtcaatcatgaacgtatcttatacccattgccctagtgtgtgcctcatgcttaggctgagggagtggctttgtcaatggatctgcaacattcaaatccgtatgtattttgcatatcttcacatctcctctacccactatctcgcgaatgaggtgataccgccgtaaaatgtatttagatttttgatgcgatctaggctccttggcttgcgcaatggcaccactattatcgcaatagaggtccatagggctagaaacactagtcatcacacctagttgagaaacgaatttcattatccaaacagcctcctttgctgcttcagaagtggcaatgtattcggcttctgttgtagaatcagccactgtatcttgcttggaactcttccaacttacagcgcctccattcaggcagaacacaaatccagactgcgatctaaaatcatctttgtcggtttggaaggttgcgtaagtgtaaccatttacaacgagctcttcctgtcctccatagactaggaaaatatccttagttcttctcaagtacttaaggatattctttaaagctatccagtgactctcacctggatctgat

SEQ ID NO: 75668 - DNA, 9361 bp, Oryza sativa
atagttggcaccagcctccattaagaaatttaagcactcagttgaaccatcattgcccattgcagaatcaagtgcagcagttgagatacaatctgagttgacatcagcaccagcctatcacataaaaggaatgtttctttaaggcgaataatgtaaaatttaaaggcttccaaactgaagtgtttgaagaatgctttaataaagtaagcaaccccagagcaatggtagaacttgacaaagctaagatgaggtacaatacctgaaccaggagcggtacacattccactgatgaaacatttacagcctgcaagaggggttgtcatatgatacaatccaaacattatgtacgttatgttgcactagtgagagatgtgaagcacattacttgctattaattgattataataactggatggagaaaaatatcaaacagaaagggtaatatacatgaccatatatctatgccaagctttcagtaaaaaagaaggaaacatttcccgtgatattgcaattttcaaaaacaaataagcacaatgttgcatagctgccttattggtcaactcttgactagtagatttttcttatttgagtgattgattccacatgacacttacataggaatggcaacatgatagaaaatcaaccattatggcaagtgcataaaagggcaatgcacccagaagaaatcgtcccatgcatgcaattggctctttgaaaaccatacatacatgaaagcatgcataatagattttcacataaaacaatagtggtgatcccagttaacattaaacattactcttgcgtaagaatggagattataaagctatagactggactatagctttgagaatacatcgttatggatttaaacagaagcaatgaagtatttctgattattgtaacagctgctaccaaggagatcttgaagaataacatgtaactagaaaactagacagctaggaacaaacatttgaaaatttaattgtgctgcaaattaaagagccatgatcacatttcacatcttaacttacattgcaccaaaaaagcaaaacaacgtcaagggatgaaagtaccaaagagtaactacaatggagaatgagaacaacacagctaacaaacaaatgaagaaaaagcaaatgttcaaacttagtttatgtttacagttgaacatgcaacttaaggcagaagtagcatgatcttaagcttacatctgcattatgatccaataaaaccttcatagcaccgacttgtcattccttagtagcaagatgtagtggcgtcccacattcatcagctaccggatcaatatcagccccctttgccagcaacgtttctatcatttcacaatctcctgcatacaagaagcaatgatggtaagttttttttttcctgaatctttttttcttaatttgtatctggctcttggcagacctcagttttccctgcatataggctacaaagatcattctaaaggggttaacgtttcatagaaacaacaacaatccctactcgccaagtcaaagaaattgggtggactgataactgttgaaatcaagcaaagggggacattttggatgtggacatatttttcacacaccattgaataacaaaagaacacttatttgattaaaaaaaacattcagagaatacactgcctgccatagacattgaaatgtttaaggctgagttcggcacttcatgttcccaactcatctctttcattttccgcacacaacggtgtgttttttgcaaaaaaaattctatgcgaaagttgctttaaaaagtcatattgatccatttttcaaaaaaaaaattagctaatacttaattaatcacatgctaatagaccactccgttttgcgtgcaggagggattaattcccatcctgcactaccgaacacagcctaaggaataaggatgttgtgaatgatagctcaacagaatttagctatcagctttgaagataatctacttccacactaacataagggaaagaaatataaattgtcctggaacgaggtcaaataaaccttagttagaacataataccgccgcctaatatattacaaacaaaaggaaaaaaaaactgtgaacctgtggtgcacgcgtgtaaaacagagatgcatatgaatagagaggacctattccagcagcggaatgtagaggggttagcccgtcatcatcagctttgtctggatcagcaccatgatcaagaaggtacttgacaatagcagcattttcaccgatcaccgcaaaaactagaggtgttctacctgtcatgcacacagatcgatgcaaacaaattcaggatcagaaaagaaatgtacatctgaaaacttttcactgggcatcatatttagaaatatgatcagcaagattacaaagcatggaaccacacatacatgaaattcaggaatcacatgaaatggaatgtggaagggcctgagactgtgtttggaaaaaaggactaactatttcactttaaaagttctaacagacccgtaagtatgcagaatcaactgtaggaaattaatttccatccccgtgagatgaaattgaagtattaataacaccaacgaattcttttggggcattttcgcaagtgcgagtaaccaaacaatcacagagaattccctctcaatcggttacatgtttgtatctgatagtgataggaaatatttcattgttgaacatggcatattttaatgaagcatacgatgatgaatgaggataacataacaagacaatgaagagtaaacccatgcttatcattttgtgctttttctctgctaggaatagacacaatcacacaaaatttccagcgtcccgtgaactcatcaatcatatctaaaacctagtacgtatcaagcaaccgatcaacttaattaattacacaagtatatcatcttataagttgcacgacagccaatacactggttaattccccattgtgcaatcaattaactattttcccccaccaaaaaacacaaaacagagcaggtttttagattcacaaatcctaaaatgccagcacaactaactacggatcaacaaaacagaaacataccctcatcatcggcggcgttcacatccacgcgcagcccttcgacgaggtagcggcacacctccagctgctcgttgcccgcggcgagctgcagcgcccagatgccgccgtccgtcctcgccgcctccaccacctcctggaggcggcccctgaccttatccagcgcccgcaccagccctgcgcacattcaaaagcaattccgaagattaacgccacccaaatccccaaaatcgcggaggctgggggtgagtgagtgagagagtgagcgccgcgtactcttgaggtggcggaggtcgccgctggccgccgcctcgaggagctcgtgctgcatcgaagcggccgcggctgtatagagagagagtgagcggatttagttagggtttttggcgtacgggtcaaggcgcggggaggagggggggtgggggcttaccggaggaggacgtcggagcggcgaggcgagatcgccgcgccgccatggcggatgggtcggggaagcgcgagggagtagggttttgcgaatgggggtgagactgagaagaggagggtgagagagagagagaaaggaggcgaggtggggaagagagaggcgaaaaatggttgggcatttgatttttgaaaactgaggcgagagaagacgagagagagggcgtggaggaggcgtacgcggcaagccagcgcgtgggacccgcccaacccctgtaactgcggacacctggaggcggtaggccaaaatgcccaaccgattccatcgtttcgtctaccagtaacctgtgcacgttactgtgcacgtgtagtacacgtcgtaacctgtattaaaattatattatttttaaaatcaaatttatagtagtatataattaaaagctacgacatacatttaaaaaatcaatatactttcacttataagtttgaataacataacataactatttttttttgctatttagtaccaaggaaatcctcccaatcttgcatcataatacttttatatgaattgagaaaatatgaattgcgcttgaggtatctttaatgataatgaaacaagtcacatatatacataactttttaacaaaattatcagtcaagcgtcatgtcctacaagtcaataatattatatattttaaaatggaggaagtaatattcatgcatcaaagtgtgactgcaatcttggatttttcatcagcctccttgaatgagcaatatagctgttagaaaaacttaagagaaataaaatttgctcatgttcagtataaaatttcttagaattttaactgttccctatcaccctatgtgccaagggggcaagaagactaaagggaatgccttggttaggtataaaactgctcggatttttgtttaacactaatttatttgaaaattgtaaacataatccctttctcactccatgccaaattttgcaaagaacaaaatataaagtcctgctaggttgctatagagtacaaccaattcaacattggtaacacttgatgaattacaacagctagacagctagacgattgtaagggtacaaaacaccagatgagaaaaaaaatagtttaacctaagataatatattgttcaaaacatcttcctcatgtattgcctttctccaactgaatcatgtattctgcactttatgaattacagtattgatatccaagatcctagcatggtcaattggatcaccatggaaaagttgtttccatttcagtttcttaacaatgagtttccctttcatttatgcctatgaagacatggtcacagactaactgtgcccaaaaatagttttatcactgccctatgtttttgccttttgctcttgagcagcaacctgatttttttttcaatctcaaacaataaaagccacaaatggataaattttgatttaacaaagttcatataagtaatgaaagctccttatgacagaccatcctagattcaaactgtagctattagagcggcaatcttgtgagttgtgataagaaagtgatctagctagctgcatacaacttccaacctgcagataggactgaataaatatgtaaccctcttttcaatttggcaatttagaaaagtatgaactggcatatgatgaacatcaagagtttctccacaattccagatttgcaacaaagtggacatgcaggaacggaggaatggcaacgtaggtgaaaaaaaaacagtagtttttttttaaataaattcagctgcaaccaatcaatagaatatcagtagcatagtgcctcgtaaaaataaagaattgtaaatatgtaccaatatgttcatgtgcatagcagaaaaatgttgggctacttctttatgcgcaatcaacacaatctgttaaatatatcatatatgtcaactctcaggtgttctggagtaaagaaaaactctcagattgttcaagtattacatagcatggagttgagctgatcagtttcatgctgctaattctaacagccattattgtaagaggaaatacctagctagtacgtatgcagcaggaattctagtgacaagaagtatatagtaaaatatgaatgtcagatcatcaaatagcagagctgagatttagaaattacctcccaacccagatgacaagtactttgaagaggtgagtccaaaataactactatgaaacttgataatgttgtatcatacaatttaagagtaaattggagagatagtagaagtgggaagctaccaaggtattttggacatgtagctcttgtactaattttgcccaaatcttaatatcaccattaaaggaccagaagaaaccatgataattacgtttagaatcaaacaatcaactttggtattgaatctgcctcagctaatggcattcctccttttgttggttctaatggcaaagcagcgggataaagcaatatcaaactgcaaattattagtggtcgaagaaattagaacagacaattaagagtgcatgagtgcatcgaaggaaaaaaagaatatggcattccatatttcaatggtgaatggcagagaaacaaaaacataccagtgggctttagctcgtaatggaataaatcaattaacttgtaatactgtagacaagtggtgttattaacttccttggatttgcaactcatgggaatgcctggacaagaaacatattatcaagatctcaaagaataataattctttcaatgcacatcgtctgttttctttccaaaaaaatgcaaattaattcttgttagcaaaatagagaatgcatctattgaattgcaaagggataaatttctgaccacacgtacatataccttcctaatcaagatttctccgataaaatcctttccaatcattattgatccaataaaagtacaattcccagcgttgctccaataaaaccctttccaaactgccccgcaaaatactttcccaataatgttttaaaacattttccaaacagctcccgacatatatagccttctcgacatcgacgcaagtaaacaatttttgctcattccataataaaacagatttcagtcattccacaatgattcactatgacgtatcaggataagagcacattcacctacaagaaaacaacgatagcaactataacaacaaaaactactgaaccaccattatgtcgtgtatgctagtttattcaacaaagaagtatttaaactacttgatttctgggggtgtagcaactatttcctttgcgcgcacctgaaccggctccatcaccgaagaggagaaaactcaggtaataagctcgatccacaaaaatctgactgattagtgattagcccccacgcctccagtacatcctctgtacctggttcacctacaaagaacatgaaagaaatgagggggaagaaagaaaatgtttcatcgtaattggacatggtggctagggtggctgcagtgcaagggtgggaactcacctggtgggcgctggagatgggtgctggcctgctcgatcgggcggcgagccagcgagcggcggtggcagttgatgacgcccgacgatgggcgacagccttgatccaatagcgagggcagtcaacgccggacaacgacctgcatccaacagcgacggcgatagacgccgggtggcagccgatgatgggaggggatccggcgacgggagggtgagcagcgaccgacggatcggcgacgctccctgaggaagagagaggagcttagggattccgtggggagggattctcggaggagagacttttgtggggccggcgcgggcttcgcatgaagctcaggagctatttgcggaggagcaatgggggcgtgcgtccatagtcgtcgggggcagtcccaggcgtggcaccggcggaaggggatgcgattgtgcggtggtggctcagcgctggtcgagtgaggagcaagcgagagaggatgcgcacggcggagtcatcgcggctgggttttgtgtggcggagtcaccgctttggggcgaaattggtggaatcgatggaattagtggagatccaacagcggcggaatcggtggaatcgccgtcgctattggaatcagcgaggaggagcagcgtgagaggagcgaggcgtggtcaacgcgcggtcatcacgggagtcacgtgaggagcagcgggaagcaggggtgggcagaaaaagaccgaacagaaaagatcgagaccgagaccgaaaagaccgagaccgagaaattcggtcatcaattcggtcctaggtagtgaaagaccgaattttgtttggtcaattcggttagtctcctcgggtaaccgaatagaccgaaaagaccgaattaccaaaaaatgtctaaatgcaacatacaatccactatgtttaataagattaaactctaattttcacatcctacttcttctagcatgcaacctattaagagtctttactcataagtgcttacgaattttttttgtgatttttgtgttgaaaatttctattgtttctttgcatatatgaaaatattattgaatttcggtcaggaccgagaccgagaccgaaaagaccgaggccgaatttgtcggtcctgacattttttactgaaattcggtcttcacttttcaaagaccgaaaagaccgaaagaccgaagaccgagaccgaaattttcagttagaccgaatgcccacccctagcaggaagagccgtgcaaggatcagcgctcattaggaggacgacagaacggattaggatagaagatggacggtccggattagtagatagatgtggacggatggtagggattgatccaagtgaattggctggtaggattggaggggggcaactcctcctttttatattagtatagatgaattgaataagcgaaacggaatatttataaacgaaaaataatttgtaaataaaacttttaaatatgtattatttgtgatttagaagtaaagtatgaaaaataaattatgataaaaaaccttaaaattaacttcaaatttaaggtttgacatttaaatttcgtcttataagcataaattttggctgcaatgcagaatgagtttgtatcgtcttaacattgcatagtaatggcaggggtggcattctctccatcctaatcatccacacccaagatcaatggctaataatgtagtaggttgttagagcaagtataattggaggctataagtcgactaaatgttgagatgaaggagagaagagaggagaaagaggagaagcgggctataaatttatagccggcttgaacacaagaaccaagaaatttgggccatatattaattgtaaatactattatatatgtgggctaagaaaagattgcaaaaaatattatagccaacaagttagctatattattagcttgctattattgaagtgcttgttagttatccaaaagctcacgcttctttgtttctagcggaaaacctttttaccgctctcattcttgccgccaaaacatgagacggtccacattccttaatattagttggtattactatcgtcaaacatgtcaaaccagccacatattgcaatacttagattgaatgaaagacaccaacaaaaatagagacgacttgcagtgcgattcattctccattagatggcaaggaagttcatctcatcaacaatattctgttccagttgttacatctagcaggtaagcaatataattctttcacacgatcaacagcatttgttccatgtgaagaagttttctatgttctattttctacagagaagaactgcagcatgattcagtatgatgggcagcaagaagattcttctcttcaatctccctgtcctgtttctacatctaacaagtaagcaatacaattgttagtt

SEQ ID NO: 75669 - DNA, 19146 bp, Oryza sativa
  unsure (1)..(19146): unsure at all n locations
ggaaagaaggcttttctggatgctcttgaatgcagagaaatgcggcccgattggccaaaggcctgctaccggcttggtgctgctctgatgaccctgaaggtgcaatagaagatccttttggctagttttttgaccaatgcaaagtgttttaaataattcacaaggccttcatcatcaggacttcgagagcgcgtgcgatgcactttttgatggattcaagttggacccggacaatgcagagattgagcgtgcattacggtatacataatactcttttgcattgttgcatgcatgtttcagcacatctcactgttagttatatattggaaacgtgttattttgatttctcttatgtgcttactttaggatgggaattttacagttgctcttgcttcctaaaatcttcatctatgctatctatttgctagatttgtgccatatcctgtttttgtatccttcaattggtaggggttgattcataacatgccatccattacattggtccacacaacaccatttacatgcatagagtattaaatatagataaattaaaaaactaattgcacagttaggggggaaatcatcgtgagatgaatcttttgagcctaattagtccatgattagccataagtgctatagtaaccccacatttggtaatgacggattaattaggctcaaaagattcgtctcgtggtttccagatgagttatgaaattagttttttcattcgtgtccgaaaaccccttccgacatgcggtcaaacgtccgatgtgacacccaaaaattttcttttcacgaactaaacaggcccaagctttctaggctgaaaaggaaagggaaaaaaaagtcaaaatagaactatggaacacaaaatggtgatctgtggcccaaatgatgtagatggatgctattccctgtattgcttcttaccgatgttcttctgtacttatgtggaatgccaatgttgttcatggcatgaactgaattatcccttcaatcagaagtttcatgttttattatacaaaaaggggtaccattacatgtgaccatattgtgatcagtcacgcatctgtgcctaaagacgtacagtacaccattatccaacactgattgtggctgtgatgtgcagggaagctatggaatctctgaagatatcatctaaaggcaccaaggcaacatgaactctgcccttatgttgagacacatctcgtgaatcagatgtgtggatcgcgtcctctttttctagtcaagtagtgaccgcagaaatgcttactgcgaagcatttcccatgtttccgagggcgaaaatatagcgaagttgcttttgtgcattacccaatgtgtcgccactgcttctcgtttgttatcttttgtgcatccgaggtggtaatgtttagtactagcaaatttttgtttctggcttgatttttgctgtgaagcgtctgcccgtatacgtcggtcataaacactgtcggtggtgggtgtgttaatgagggaaggccgcctcatgtagtcatgtgccgccgcctaagctgctcctcgcggctcttttacatggaccgctgaccgggttcggcagtgcgatcgattaggaataaaagttttatgtatactagaagtataagcgcggcgtcatatagagttaatacgaagcatataatataagtatatggtgtacggtacagaaaaatgttgtacaataaattagtagaaatacagaacacattgcagctcgttttgcccgcaaatggaaataacataattttgaatttactcatgttcccgagttccggcggtataactccagtaagtttgttctcatgtaaatatctgaagagaaaaatgacagtaagtgctatagaagagaacttactttcagaaaactgaaaatgcatagtaagatgcacttactttcttctcttcttcttctccttgtaccgtgtaagagcattatctctgctgcctccagcagatgaactttcaggaccaggaggatgccagggtggctcacccataaggatcattgacaataccccacaatcttaaaatctccagcactactttcaccagtcaaaccagagaaggaaagggatatgctggacatagccttcctaccaggaatacaatggctggaatcagcccttgcagctgggtttgacatcccagtatcaacagatgcgacattgttacattctggctggtgcacaggtttgggctgctgaaagtacaagaatttgacaaaacttgaacattcagagtcagatttgctgataagatgaacgaaaccttaaaaaaaatgacagtaagtcatggcctttgaacaaacaatatcatcagaaagggatactccaacaacagaacctggagcccctaaattcaacaattatacaaggctaaaaaaatcattccaatttcaaccaaacttccaattttaacgtgaactaaacacacccttcgtcaacctctgaaaggggacatgaaaacaagcagtcatgtacgaacataaaaatcaccagaagagttgatctgagcttctctgcccaacaagaaaaattcaagaaattggtactgcacgaaataaatgctaacataagttctaaattccaactgacattaatgaatctggagcccagaaaattcagaacacaaaacgtagtacatacatgaaccttgtctagtagtaaagtgtaaagttcagaatgtccatcgatccagttgaacaaaaaaaaatcaaactcataaacggcgctgaggtagtagtatgtgtataaaaaagaaaataaaacctgtggaagagatatcagatatagcacctgtaaacttggtccatgaaataaaaacacaactttcctgcagaaaaattggacatacagacatacagtaagccaacgaaaaaaccaggacaacacgtagaaccaatcggggcagcaaaaattaagagatttgctgccgttcgaagaaggaaaatttagtcgaacaaaattcagaatcaaccaccgctgacgcattgacaggtaaaaaaaaaaagaacagtggattctctgaagaacacaaaagaaagattcctgcagagtataggcggatgtgcttgctccagatatgcaccatatgcaacacaactcccagttgcttgatgccctccttcctgcacataacagcaaacttgccaactgcgttcatcacatgctccgcgcacctatagaggaaaaaccattcagatgaggaagaaagggtcaggacacggaaagtgcaaaaaaatcagatcttgtcaatcaaacaaaacaacagaaaaacaaacactttcctctgctccatccaacggcacattctgggcaagggcgttgacgtccttcagcggcagactccgtcactatgatgttgagggaggcgcactccagtcgaaggctcggtgctgagccagcccctcgttatctcgcaggttggggaggacacttttgggggtcgttcgagtggtcgaggcaggtgaagtcgtcgtccctttcccactgcggtgctgctccagccggtggggatggggatgagctgacccggagagagaagcggcagaaagcaataggtaggaggagtggtggagaggtagagagcgcggcgcacggagagacgggttgggagggagcccgcggagaggttggagggccgatgtgccttgtcgggttgagggggaaagaagggtgctcgccgtcgcatgcacctcccctcccttgccaatctagggggtcgagatccactcaatccagggggaggcggacgacgaaggcagcgacagagggaggacgcaccacggcgacgacggcggccggcggagcggggcgcagtggggacctccgccaggccaaggtccacctcccccgatctgcacggtgtgggaatggcggcaggaggcatcacttgagaggaggagatgcgggagggcgagcgccggcgctgatgggccgacgacggaggcggattcgaggggaggacaatggtggtggtgcttagggaggtggcgaggacggaggaaggcggtcgacgatggcggcgacggagagagggcgcacaccacgtcggggcgagggaggggggaggggaggcggacgacgaaagcggcgacaggagaggccttaccacggcgaggacggcggccgggcggcagccccaggctggcggcggcgcggggcgtagtggggaggaggtgggaatggggaacgatagggtggggatggagggaagcagatcctacgttagagggacgtacttcgcttcatcagcgtcattccgaatcctacggcgacggcgcgatttcctttttcatcgtccttcggcccagtagctgtccagagttcggcccagttgtcagttgcggaggccgaaggggaaaaacagagcagcgaaaatgaattagaaagtgaaacagagcaacgaaggtgagaaagattagtcatatggcccgcccaaccggcctacaattataatagccaaagtgcccaaccaaacatccccttggtcgctccctctcctcctgtctcctcccgacctccgccgatggcgctgctgcccgacgtccggaggcgagcagccatctgcggatgctccaggaggatcttgatcgtgccggtgtgtagttctccgcggcatcggtgacggctgcggccggacggcatgaggcttcagctccagccagatcgacggtgccctcgccgccgagcctccatggagaccaggtacggggtacgcgcccgcctctagtgctaaggtcgggtctgcgcgacgcgctttggctcggactgaatccatcccgcaatcagtttttgtcccacgtcgcttagagcaaggctaatagtatagcccgctgctggctaatagcccatggctaaagacaattactagtacaatagattgtctattagctagctgcatcttataatcaaataattaattataacatgcacatatcaatatatgtgatcaggagtgaattgtatccttgtagctatttgtgttgtgagatgaactttgttcaccaaacaccaagatcatttcacagatcatgccaaccaagttatctgttgtataaaaattacttcatacaaagcactagtgtttcgtgggcaagaagagctcacgaggaaggagtatatttcctagccggatttttgttgaacggtgtggcgtgagagtttttcaccggccgagtctttcgctgatgcatggacgacgattacgcacggacgatggagatggattcgcgcacggtgggggggaaggggatcgtgcgcctcacgggatcgggctgaggatgtgcgggccccacaaaccgcgttgtttagcgctagggtcgactgctcgcgagcgatacggcgtggagagaagcgctagcgcccggcgacaatttagtcgctcgcttcattctctctcatcctttctctctcatccacataggaaaatgatgatgtggcactgttttggagcccgctgagtcagcctattgtacctgctcttattctcagaacgcgcgacctctttagagcacgtataatagtgagctataagcttactataagcttaggtggaggagagaggtagtgaaaaattaaggatgttggctctcatgcaagagctagcttatcacaagctccaacacaaatgcattaaatgtgtaagtgagagatagagagaggagaagaaaattgtagccaaccttatagctaatctattatatatattggctttaaaataggctaatagtaggaagtgggctctattattatccttgctcttataaacgctagttgattatgtggtgtcgcctccccggagacacccacaccgactagatacaacagtaagatccccaccgtggccacggcttggcggataccttctgctgtaaaaattaaaaatggagcagtcataaggtcccctcccattacggggcacggcaggcgcctgccggttaggctgcatccataatacgttaagatgtcaaatacggcatacatatagtcgggtctcccggtggaggcagcgctagacattagcgctttgctttttgaaattttgtatgatcaaattattatttttccgttgattaattatacaatagcagcaatggaggcctgcattagaaccccctctgcgtttgaattccaatttcctttgcgtttgaattatacttaccagcttaacttatctgaagatgttgtccttttttctttttataattttctcggagtgaatcaaccatgatgccataatgcatgctaacgatggagtgtttaaaatcttgtcttgattgcccctgcaggaccttattgttcagcttctatactcattttgtttctgccactttctagagttaaaccctggctagataggtcttctccatgtctttgtattttaaagcattctaaaactatgctctacctttgttagcacattagtgtgtgcatctgggaatttgggtctaggggtgggcaaaataaaccaaaatcaaaaggcaagcatgccagaaccgagttgctacttgtggagattatggatatcccatatctacacggcgatggtatttggattgaatacaggataccaaatatagatagaatatcttatttgtgtctcgggtttgtctctcaacttgtacatcaaggaaataccttgagacttagtcggttacgactgtattttatctgtatctgcatattccgttagggatatagattatcttttgtaacacggactccttcccatatataaggggggtccgggtgcctctaggggcatatgttgattttctccaaatcatacaatcaataagacactcggcggattcatccccggacaggagtagggtattacttcttgaataagaaggcctgaacctgtataaatcttttgtctccaaacccatacacttctccagcttgatagccacccccttttattattgccgaaatctagtttcgacactactgacattgactgggtgaaaattaatatcttcaggctggaaattacttagttggttatgaagtgaaaatttgtggcatttgcttgaatctgaggttcttttgtcgagggtgagcttctttgcttctcaaggatctgatgttgcacaggtgacaaggcaaatgttcttgggttatgcaagcggactgctgatgacgtccttgtaaaatcaaaggtgtttttgattattattctgtgatgaacaattgggcattggagattattgattttgttatttggaatttattcacgaagtggttttggagatgattggattcataggtgatcgcagggttcattattttatgtgaccggtcagaccgggttgtgtatgccggtctgaccggcggtgatcgagcggtcggaccggccagcccgcggtctgaccggccgacgctgtgtcggtttcggtttcgggttgtttgtttggatatccgagtttatttcttgattatgacttctagatggatactatacgtatgtaatactattgtttgctgctaatgagtcaagttggagatagcttggtctcggaatatggtttctttgtttgttccatgtgtaggtgactcgatgtctcgggagagtatttgcggtgatggaccgggagtcggcttggggataaggcgacatccgtgatggtcagagatcatgcgggacacttaggctagagttgatgcacatggttgatggagattctatatgtcatacgatggagttattgtgtgcatatgggatgcggagttgaatttggaaggagtccaaatttggtacgattggttatgtaaagtttctttcttgtactagtatgagtttaggactcttagtatgagtttggttcgtggctttaggctgcctacctcatgtataaatagagggggagcgtgaggcttcccggtatcgctttagagagcaattgagttgagtttggagttagggtttcgagtttagtcgaaatttttgtaaggagtgctattggtgcactttgtaagcacagagagaatcaataaagttgtcatctactttaagagttcttcgatttgtgtttcaccgggtttcggcggtctaaccggcaactcaccggcggtcagaccggcggcattgcggcggtcagaccggcgggagcacagcggtcagaccggcggcgacgacagcgagcggcaggcgatctcggcggttagaccggtagatcaacaccggtcagaccagctaatctacttcggtcagaccgatttcatcgaaattaagggtaacttttatttccgctaaaagtttttggtttttgggtataccaatcattcaccccccctctggttggcttagttcttgtgattcgttcctacaagtggtatcagagccttgttttcttctttggatttttatcgatctagagtttttgccatggctactcccgcaaggttttcaactaagcctcatgttttcgatggaacggatttttctcattggtgtagtaggatgcaatcttatattatggctgaagattatgatatttggagaaaagtttctcatccttattgtcgaaacatgataatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactgtagcttcttgtcgtcgaatagtcattgcttgattgaagatatgtgttgaagatgtccaagtagaaatcctgaatattggagagccacttgttgtagtaaaataacacggcatcgcatgccgagatgtcgagattcacaacaacgtcatggttggtgatgtagcaaaacttgttaagtagcagcaatagagtttgctggttccgaagataataaagatgaagtcgctccaccatgatgacaaagttgtgttgccgtgatgaagtgaaccggtagtgaagacgcgcagttgtgaagataaaagcactagtcggcggcggcataacacgagtcggcggcggaagacgatgatgtccatcagtagtggtagctgtataaaccaaatgtagaggcgagggcactagtcagcagcagacgagacgaccggcgatgaagatggtaaggccaatcaacactggcagaatcatgcagccatggcaaatgtaggcagcttgtgttgaagatactgatgcctattagtagtgacagcgatgtagccagtcgtgaagaagatagcatcagttggcgttataacaggccagccgtgcaggcgatgacaccactcggcggcggatgcggcggccggtcggtgaagacgcagacgcccaacaacggcagcataataggccagccgtgcaggcgggaacaccagtcggcggcggtcgaggtggccggtcggtgacgacgtagacgcccaacaacggcggcataataggccagccgtgcaggcggaagcaccagtcggcggcggacgaggcggccggtcggtgaagacgtagacgcccaacaacggcggcataataggccagccgtgcaggcggaagcaccagtcggcggcggacgaggcggccggtcggtgaagacgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacgtaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcatatgtcgcgaccgggaaaattgccttttcccgaacgctagtgtattaatccccgtcccaggaaaagccggggtacaccatacaaacatgatataaaagacacatctttattacatcgataatatttacattattacaaaggcacttaaggcctgacaatcaaaaataaacagcagcggactagcgggcctacggctccatcttcacaggcgctcaactggggtataagccaggaccccacctaagacatcttctccaaagcttctcttactgaagaggggaaagattgagcaagaatgagtacaaccacagtactcagcaggccacaccggagatgcacaattaatgcaaaggagtacaaggggataataacatagaggttaagttttgcagtagacggcatttaaaagtcacttagttgcccaaagctattttgtaaagacgatcctagctatacaatattattaaccaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgatatagtttccaacccatcctagccatagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttataactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgagaattcccaaagtctaaagttataaaaaccacctaatgttgcctaattaatcagcgaagcatctacctacattcatactagtggaaccatgaatagagtacccactagttggggttttgtttaatctagggtgaacaaggtaataatatcaataacaatagtattaaggtcataacaaaggtaaatgggcatggctaaataaaacagtgatcacgcgggaatttaaataaagcgataatgcaataatttaaatcaaaataattttataaactgggattcaacatgttcaaggatgatgtgacttgccttgctcagagagaacagccttccgaaccttcggcgacaaccgcgaaccacgcttcgggaacctccggaacgacgaaagctacgcgaagcacacaagcaaagctacaagcctataaagaagcaataacaacacataaaaagaaagcacagggttctttaggttataacaaacattaagagacttgaacgggtcgattcggagctcgtatgaccaggatatgatcatccgaagtttaatgctgttatatggagatttgcgaattattataattaggttttgcaactatgaaacatgtgtaagcgctagcctggaaaggacaggaaggctgcgccgttgacatgtggaccccacatgtcaacctaaaggaccgcggtagaccgggtacacagagacggtccacgggtcgacggaggcggaccccgtgtgtcaaccgaggcgagtggccaacaaacggactccactagacaccacacgggatgcacacgtagaaaccacgcggctaccgagcgggcacacaaacacggacaccacacgcacaagcgaacgactaccgacaccggtacacgggtaccggtgtcgacaaccgcacaacgggtacggggcgacaccgaaaggacgagggcggggaagcgagaggacggatccttaccaccacgcgacgaggcgcgggaacgacaacgacgaacgggcgcggcggagacagacgggcacaacggagacgaacggcgaggggacggcttcggcggcgatccttgaacgaaggcgagacgcggccggcacgaggcttgacgacgcggagccgaggacgaagacgaggacgggggctgcagcgacttgcttgactgatgcggacgacggatgagaacggcttgacggagggacgaacgccacgacgagcgaaaccgggaacgacgagaggacgatgacgacgacgaccggaaccggcgaggaggcgacgaggacagccggcagcggctgcacggagacgaggacgacgtgggacacgccgctgcgatgacgatgacggaggcggtgccgcgagacgacgagccgggcgaccgacgggacgtcgacgacgagaacgatcggagacgacgatgatggaccgcggaggggtttggatggaggggaagcgaggccaagagcgaccttgccgctgcgatgccggaggtggtggaggtgcagcgagccgacgagccggggaggaggaaggggcggccgaaaggacaccggcgacgaagaggatggagagaccggcgcggcgacggcgttccggcgaaaaccgaggagcagccggggtggagggcgatgcggcgacgccgagggaggagacggtgacgtcggccgacgctcaggcgaggcggccgggacagctggagatggtggagtggtggcgacaccactagtcgtcggtgaggacgcgtctccggtgatttccccgcgaaacggaggcgaagccgggaaagaggaggcagctgcgaggccgagggagaagacggcgcggccgggcggcgctcgggcgaggagaggaaggcggctggaggtggccggcgcgaaggaaagaggagggcgacggcgggaacgtagttccgggggtctcctcgcgaaacggagggcaggccggcgtggaggaggtggcggcgacgctggaggaggcgatggcgcggccggccggcgcacgggcgaggcggcacaggcggctggaggtcgccggcggcgtgggagagagagggcgacggcggggatggggctagagaccacggggaggctcgggatggggttaaaacggtagaacggagtgcggggatcccattttatatgagagaagagggagccggccacgggggaggtcggaacggcggcggaaaagccggccggcggcaatggaaggcggccggacttggcgcggccgttcccggcgattgggggcggcattcaaaggggaaattagggggaaatgaagaggagtcaatggggattaatttcccctatttaattttggaattaaccaagcgaatcaagcggatttggaggagggagcgagctagggttcacgggagaggaagaaaggacgcccgggcgggaggaagggaacgacgcccggcctggcgcgtgggacccaccggtcaggcggcggcgtaagcgcgcgcacgcgcgcggcacgtgcggaaggggagcggctcgggggctggggcggcttgggccggcggccggcccaggaagagaggagggagaggcggcctgggccgggcaggccgggaggggaggggaagagagaggcagcccgggagggagagggaagagggaggtgggccgaggggaagggggcccaagaggaggagggagagaaaagagggaggagaggaggactttggactgggcttggcccaaaggaggaagaggagggatttttaggttttctttttattgacctttgataattgtttttgttgtttaataattatttccggtgctctgaaaattcaagtgaaatttgagggctccttttagaccaaggagaatttaacaaaaattctccgggtcacatttgaatttttcttgcacgtattttagtgtttgccaatttctttccgacttttaattaattctattattccttttagaaaatgaattttaatttggaatggatttatcaggacgtgacagcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacgtaggcaggccggcggtgaagtcgtagacgcccaacagcggcggcataataggccagccgtgtaggcggaagcaccactcggcggcgacggaggcaggccggcggtgaagtcgtagacgcccaacagcggcggcataataggccagccgtgcaggcggaagcaccagtcggcggcggacgaggcggccggtcggtgaagacgtatacgcccaacaacggcggcataaaggccagccgtgcaggcggaaacaccagtcggcggcggcgaaggcaagccggtcggtgaagacgtagacgcccaacaacgacggcataaaggccagccgtgcaggcggaaacaccagtcggcagcggcgaaggcaagccagtcggtgaagacgtagacgcccaacaacggcggtataaaggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaatggcggcataaaggccagccgtgcaggcggaaacaccagtcggcagcggcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaacatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcgatccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcggcagcggcgaaggcaagccagtcggtgaagacgtagacgcccaacaacggcggcataaaggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcgtgaagtcgtagacgcccaacagcggcggcataataggccagccgtgtaggcggaggcaccactcggcggcgacgtaggcaggccggcggtgaagtcgtagacgcccaacagcggcggcataataggccagccgtgtaggcggaggcaccaatcggcggcgacggaggcaggccggcggtgaagtcgtagactcccaacagcggcggcataataggccagtcgtgtaggcggaggcaccaatcggcggcgacggaggcaggccggcggtgaagtcgttgacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggataagccggcggagtggactcgcggccgatcgaccggaaagctgagaagcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaagaaagtgaaaactcccaaagcgaaagcgaagtcggcgactcatgaaattgattccatcgcgctcgttgataggaaactcgacgcaacccctacctggcgcgccaactgtcgaaacatgatttcggcaataataaaagggggtagcgcacgagacctaaaagtggatggatgcagagacaaaagatttagacaggttcaggccctctcaatgagaggtaataccctactcctgtttggggatttgaatccgccgggtgtagtatagatctgacgatcaggttgtgtcatgccccctagagggcctcctgcccaccttatataggatggggggcaggattacaagatagaaaccttaaccaatacggtatcggtttcctaaatctattttacaatattatcgaatcaggactttaggccactccataatataaaaggaaacgtaacacccaagtcatgatctgttacatattacataaatataagttatcccctataactagtcggataaccatgccgtgtgggtatggggtacccataatctccacacttatgtgattcctgaagctattaatactactgctgaaaaaactgcttttgaacaaaattgcaaagctcgcaatattcttttgagtggtatttctcgttcggattatgatcgtgttgctcatctttaaactgctcatgagatttggactgctttgagtaattttcatcaaggaacaaataatattaaagaactttgtcgtgatcttttcaaaaaggagtatattaaatttgagatgaaatccggagaagctttggatgactatctttctcgatttaataaaattttgagtgatcttagatctgttgattcttcttatgatgttaattatccacaatctgagatttctcgccactttttgaatggtcttgacatgtctatttgggagatgaaagttacatctattcaggagtctgttaacatgtctactttgactttggattcactttatacaaaattgaaaacacatgagatgaatgttctttctcgaaaagttgattctaagtcgaatgctttggtttcttcttcttcctctttggatgttgatgcttcttcatctaagtcgtcttttcttgctgtttttaatgccacattcgatgatcaactcgaacaaatcgaggaggaggatttggctttggttgctaacagaattgctcgagctatgaataatgccaggaacaggaaaagaggtggtccaaatcgttgctttgaatgtggttcaattcatcatcttcgttggcattgtcctaatcttgggagaggcaaagagaagcaaaagatggtgagaagaccacaacaacaaagcccacacnnancaagtcgaagggttcataccgagggagaaagatggagaatcttagaaaggcttttcaacaagtttgcgccgccttcgagccactaagtgatgtagatggtgaaagtggagatgatgataagggaaagaacatctccgatgtttgctttatggcgcgtggtgaatctgacacagagtatgaagataatgaggtgaatgcttttgaggaagctattaatattttgagtgcaaaaaataagaagtgtgagaagatgtatagaaaacaggaatttatcattgaatctcttaaatctgaaattgatagattaaaatctcttattcctaatgatgatgattgtgaaaattgtgaggttttaatgaatgagatttcaaaaattagagatgttaatgctgcacatgatttaaaaaatagatcttctcttgcttgtagttttgccttgcatacacgcactttggatgagttgtttttaactaaaaagttgttgcaaaaatatcaaattgcttttcatgctagtttgatgtttaacatgatttctgctaaaaagttaaaacaacctcattatgttttggattgctcaacatgtaatttgaataagatgaaactaaaagatgctttaggtcatgttgagtacatggaagatgctgtgaaaaacaatgaagtgctttcttgccctaaatgtcgtaaaagcaaaggtatcatggtagattgtgaaaattgtgctaatttggaaaaagaggtttcttatttgaaaaattctttgctaagattttctgatggtaaaaagaacctcaacatgattttggat

SEQ ID NO: 75670 - DNA, 15386 bp, Oryza sativa
atcctttttgacgcagttagataattctttggaattactacaatgcaaataaaaaggtgcccaacagaaaagtgttatactaattttgtaggcctttttaggctacaaagctgttcgggtcttattgagatgactgattttgaatagtcattctctcggcacgttatatgctactttggtaatagcgtgagatgtagcttaggctatttagactcgtcgtttatcatgttttataccacatttgatggatctttttgagagtttttactcggatttttatcatatgtattgatttatagacctttagagtgtttctcactcgggcctcttctatgtctcctttttggtgtgttaaagctaaggcagtcgactggatattttattaaacgccgcatatgcttagctatatgatcccttggatgattcggttgtaaaaccacacggatggatgttcatatgcactttgactatatgattggtttttagttaactaatcatatagttgggggctacacctaattaggtacatctagtcgatgcacctgattttttctattttcagcccttcacagtctttgattttagtactcgggagaccaaggcagaggaagttgaagcactcggattatcattttgaatgacgagagaagactatttcgtcgactgtaaaggtctcaggggctactgtggagattatggataccccatacctacacggcatgtatatccgactgggtatggggtaccatgtatagatagaatatctttaaagggacttgggttaaattccaaacttgtatgtcaaggaaatacccgggatcctagttggatacgattgtatcttatctgtaactacctattccgttaggaatataggctgtaccttgtaatacggaccccttcccctatataaggaggggtccgggtgcctcttggggcacgatttttctcccagatcatacgatcaataatacactcggcggagtaatccccggacaggagcagggtattacttcttgttaagaaggcctgaacctgtataaaattccttatctctcaacacatccacttttctagcttgatagccacccctcttagtattgccgaaatcttgtttcgacaaacggagagacgaattttacgtggaaaacccttgtgggaaaaaaccacgggcgccgaccgcaatgatcactatagaggagttggatatgatacattgggctatcgcaccctccccgtgcggcttacaagagatatgtataaaagaaatctaggagtcctagtgggaaaaaactgagtcatattaggaactgatcctaatagtcaagttctattaattaggaagctattccaaatatattgtgggctcaaaatttgaatcacatatttaacagagaagatgattagtgcctcagttatttgaatgtccattattctgaaatctgaaacatatattcatatggttaagtttaggattcctaatacgtacgtatgtatgcgtatctgctctgtttttcatctcctgtcatttgtctaaaatgcatgctagcctgagacccagaactatatatattctttcacgcgtatacgtgcagcttcatgttgaaacgcacggtggttgaactatcgaccaatttcttcctgtatatgtagatagttctgtggattacttttaaattacgaatggaaattaaaacacataggcatccatatttggagataaaactttacggtgcatgtattggtctcggtctacgagtaacaacttttacgttaaaattggaaatttggttgaagttggaacgatgtgatgaaaatattgaaagtttatgtgtgtagaaaagttttgatgtgatagaaaagttaaaagcttgaaaaaaaaagtttggaactaaacacggtgtaaatatatgaaaaaaaacaaaatagcataatcactcaccgcgtcacacagcgggaacagcgtctagtctccttcactccacggtctccacctctcctctcttatcctctcctccacggctccacgtctattctccgagcggcgttggcgccttggaacatcgtcaacactagttgaaaatggaagtggaaggatcctagtaattgctgattgctgtcgccttaatttcaaattgttgacgcgcatatgcatattatttattcattccatgaggagaggggcagcatgtgccgtgtggtcgccggccgtgagcagtctcatactctcagttagtactctatcagtgcagcagctaagcctcagcctcagcctcagctagctcgcccgacgcccggcccctcctctgacctctctctgcggccggcgccgctcatggagtacggcatcacgccggccggggggtttcggtggagaagctaccgcgacttgatccgggacgtgttcatcgccggcgacatgtactgcgggccggcgaagctgttgttcccgcagatcactggtagtgccggcgaggatcaagcgaggtgcggctggtcgagcgcgagctccgtggcttctagccccgtggtgtcgtcttcttacatgtcatcctctggatcccctgcttggtcctcggcgtcgtcttctcccgtccacaagctccgcgtcatcgctcaacagatggtcggcgacggctacatacaggaactcatccgggcgttcggccgccgccgccccgacgagctcatcttccagaggtggttctcgcagctggacgtggactttgtcctggtcctccacaccgacggcatggtgcgagctgacagcttctccgtggaagacctgatggccttgataaagcggtggatccgagctctcctgaccatggtgcaggtcctcaatatcacgctgctcgagctcccactcccggtcgccggaagtacggaacggatggcggcggcggcggaccacgcgcagttcactgggttcgcggaggagagcatcctcaggatgctggccttcgtcgacgccgtcactctttctgctctcaacgtcaacgacgaccaccgccaccggacgccggagctactcccggggatgctgcagctgtacgcctgcgtctccgaggcatgcgatctcctcgtctcagctggcatgggcaaggacgagatcacgaagatgcaggccttggacgccatgaacaatggcatcctgatgcaaagcaggaggaagctgagcgatgctatctgggtcatgatggagaaggtccgggctctcttcttgatggacgcctgctggcaggtctcgcaggaggcagccgcatccgggacccatgagaccacggagctgacgatgaactacatcacgcttctctggcgcaaccataccatgctcgactacttcagcgtgttcgtctccgacgccgacagcttcagctcggtggcgagactcatcgccgagatgatcacctgcctcgagtgcaagctcgaggaaacctccctctccatcccggacctgggtttgcgcttcatattcttgctcaacaattggcaccgtgtcttgcagcgtgttgaatccttgcgagacttgccagcggccgtccggcaagaacgaatccttctcctccatgcctcggacagcaagattaagaggtacatagacgattatcttaatgcctcctggtcgcctctgttacgttgcctgctcatcgacaagccttttgttgctctcgggaggtctcatgaatctaaaattgagacacaactccaaacaacctacgcaacacaaaagttttggaaggttccgaaccctcagcttcggcagagactgcgtagagccatcatgagcaaagttattccagattatagtaaatacatagagcaaatggataggcagaataaaatcaatcgacacctcgtggtcactagtcccgagcagctcgagcagcaaatagaggaattatttgaaggatgatgattattaattcaactaggaaggtaacccccgcattcacgtgggtaagtatgttttttttcacgtgtttgaccatttatcttatttaacgtttttatgcaaacatgtggaaatgtaagtcatgcttaagttataaaccaagtcacaacaaaataaataataatatttatttttaatatgctacgtgagccgtggatctcgcatccgacggcggagatctgtagttagctgcagtacgaactccaagatgtaatgtgtgtatgacaggtgagactagatattaatagtatagtaagcaactattgtaagaattgactattacattggctatagatgatttagagttagtagtaggctatactattaaacttgctcttatgcattcaacggcatggtttttgacggaaggtacacgtgtttgaccatttgttttatttaacgtttttatgcaaacgcatttgaccatttgttttatttaacgtttttatgcaaacatgtgaaaatgtaagtcaagttataaaccaagtcacaacaaaataaataataattatttatttttaatataaataaattgccgaacatgtatcaaaaattcaacggcgttatctatcgaaaattgtacctttaataatcgtacattttttttgaaaaatattctttatcgatattgattatttttaagctatttgttatatatttaaatatcaatactcactctctaaagtataagtatatttggattttcgtacggtgtctgagatgctggattttttttacaatttggtctttctaaaaacttaatttacaaatagatccctaaaaaaatttattttagaaatgatccttttttttacgccagagtggctgatgttgtcatccaatagagctgtgcctgccatactggcgccaaccccccaccaccccaaggcgctagcgcctcttgcacgcttctccggggtgggggtagcacttaacccatgggccccaccccctcccctctcactccccacacatttgccccttctcccatgctcgagcccgagaatacctcttgctctctttcccctctcacttcctccttctcaattcgactcgttttggagccattttttgcgggaactttcaagacatcgaagagcaagatatactcttccattccccctctcaaatagacttcaataattgttttgtcttttgtgttggtttttagtcactctttatgtagttgcctgaatgcttattctctttatgagattattgtaataagtggctgcagcttctttgaagtaaaggccaggatttattccattatctaaaaaattcccccctctttttttcgttttaatcggtgaaattcgtagatcggacggtaatcttataacccattgttcccccaaatttatgaatttgaacgttaaaattggggatttgtttataatagtgttacatgtgtgtaatatactcattggtgctacgattttttagagtatgtatgtggtaatgttgattaagtttaacatgtttgacatgccactattttaaatatgcttatttttttagttttggaacagaagaattgtatgataggataatcctaacatattaaattgttctctaatatttgcacatcggtttttggcatgtatagtgttagaatatgcatccatgtaccatatatttcttttaatttttttatatgcaattattaagaaatactaattaaattatgcaattattaagaaatactaattaaattatttttatattaattgttagctagaaaataggaggttagctcaaaagaaagagaggatacgggaggggagggagtacgtacgtgcaactatttctaaacataatagatctaatcaatttaattagtgggttcaccaagggaaaatcaacacttgatattattttcagaatatttagaatctttctaatttattatattgccacatggcggtttaggagtgtttatagaaatcctccattgcggcttgagagcgtttgtaaaaagtttaatggattttagtatataatagatggaattgtttgtaacattttgagaatcgtggcaagaaaaacctataaaatttagaactttctaaaactttttgcacttctttgtttgtttgagatgtcaggtaatccattttaaaacaaaccaaaacatatatattgatctcggagtataattaatatacattactttttaagcattcatgacactactagagaagtaatctttgctgggattgcaaaaatcacattagtcccggttcgaataggaacagggactgaagattatttttagtcctgcttaaaaagccgaagggaaccttttgatctctagtcccggtttgttattttttcagtcccgatttaaaaagtcatcagacccccactgtctttagtcccggttattgttaccaaccgggactaaagattaatatttagtcctaattatttgggaaaatttgctacaggacaccccaaaatcgtgtaattggctgtgggacaccacaaaatcttggctttgcccacggacactacgaaagttgtgaaattggctgtgagacaccggaggcaatattttataatttccgaggcaaaagaggtcagaaaattttctaaatgaccaatctacccctgcgcgccgctacctctaagcctgactgggtctggtcgaaccagacccagccggcgctgtttccatcctccctccctccacagcccgattcccgattccccattcccaaacctaaccctaggcgacggcggcggcggaggcggcggcggcagcgacggcggcggcggtggcggggccggcggcggaggcggcagtgttgaggacggcggcgacggcggcctagtcggcttcggttggtgcggcgatggacagctcggcgtcatcttcagtggtacggcgccgtggtggtggcgagttgcccttgggcaaatgtccattgtgccactgatggggattgttggctcagaaatgaagggagttgaaggagtgggacgaattttagtgtaccttggagttgtgcaagctttattattactgttgattttggtagttgtcattagcaagtaatatggactgtaataggcaatttagtatttggaagcaatgtaatgttgaacttatgaatgccctgtggaattaatgaatgtagtatggttttcagatgaaatgcagccattcgaatttggtttgatatggcatctgagcaattggaatttttgcagtactctgtgatgttgctttgatatggcattgagtaatagtgcacagcatttgcagtagtatatggcatctgagcaatttggacaacatgttgacaaaatttggccagagaaaaatttggacagcatgttggcaaaatttggccagacaaaaaattggacagcatgttggcatctgagcagtaaatttttgctgtctgaaacattggcaaaaaatttgcccagacagcaaattgacagtttggcaaaatttcagacagcaaactggcatacatccatacaacaaacatttacaagcatgttggacagtaaacaaaattttagacagcaataatttagaagccattccagaaatactcactgccattccacatcaactagtgccatacatccagtgccacacatggtactgccactgccattaagcttggtctatacaaaagccatacatgaaagtctttaggcacattttgcctagcaaatatgagtagtactgcccattggctccataacaaaagcagtgcacttagcacataaaggagtccatgccattaaaagctaacatcagtgaacatagcatcctacatttatacaaaagcaaatttcatgtcattgaacttcagtcttcagatggcaccagctgccttgttgcttggagcatcaacatccaaattgtgagctctagccctgctccttgttattgggcttgtttgagttaccccagatgcttgtgatcttgaaggtgtggacctgcaaaaaaatgaaaatcaacataaatatgtagagtaaatatagcaaatgtatggcataaaaaagaaattttgctgttgacaacatacacagtagctgttgggacttgtataacaggatcttgcacagaaagcacaactttcttcactctttttctcttgggctttggtggggctggtggaggggcagatggatcagcaactggttcattgcaagtcttcttgatatggccaaactgaccacacctcttgcatctatactttctttttcctgaacctccttcttccattcctttaatccttctgcttctaggtctgcctgctgacctcttcaacagaggtggatataacttgaatcctacattaatcttggcccattgagacttgtctgtcattggaactacatgtcctgcatatgccttcttgaatgttgcaacagagtagcagtcatccacaaactgttccaattctagccccctccgtgaaatgactagaaaaatggcatgtgtgcaaggtatacctgttacctgccattgcctacaactgcattctcgagtgttcaagtcaacagtgtgcctccatgtcttcaaatccctaccagtccctcctatttctcctaggtgactgtgggctgagtacagcttgtatccaaggtccctgctcctagcatacagggacttcattacactaggaagaatagtaccagtcaacttgacagcaagccttttcctaacagacattctctccatgatcatttgcctaatcttatccatcaaatcaactacaggcagtgatttctcatgcctgatccaactattgaaggtctctgctatattgtttgtgacatagtcacatttactgagagtagagaactgacatctagtccaaatgtgcttatggaagttatcaatccattctgtagcttttggacatgcctctttcatctcattatagtgactctcgaatatgtcctgcctataggcccttgatgcaggccacagattcctctcaaagacctcaccactgaacctcttctgaaagttcttcaccaaatgtctcatgcattccctatgctctactccattggtgaagactctggtgactgctgtgtcaatgcctttaccagcatctgtggacagaaccaacccctctggggacccaattgccgagtaaagcttatccatgaaccaagcccaattatctgtactttctgactcaaagactccatatgctacaggaaacatccagttatggccatcaatcccaattgctgatgccaattgccctctccatttgccagtcagtacagttgagtcaatacctaaatatggcctgcaaccgttaagaaacccatcaacacatggtttcagtgctacaaacatcttgctgaaatgattcttcccatccactgtcacatgatcaacctccacaattgatccgggacttgtcctctccaactctgctttgaagttgtaagctgcatcgaagctatcttcccatttgccaaggatttcatcaagtgccatctgcctaccgtcccaaacaacgtagtaagaaatattgatcttgtacttctcttccaagaacttctttaaagcagtagcaccaagggttggttcttgtctcaacttgttgatcacacgatctctcacccatgaattggtggccatgcaattgttctccaaaccagctgtgctagcacaattatgtgcgtaaggaagcttctttatctgaaatgaaatagcaaaaatgttataaatggcagaaaacacaatgaatagacaaatcagtgaacatcaattatgtaggcctacttacttgccaagttctcccatccggtagtctagaagcatgtatcctccacttgcaccgcttagccttacagtatgccctatacctccttgattcgctatatggcactgcaagttcaacctcttttagtactgcatattgtctaatgcaccttttaaagcaattgccatcttcaaaagttacaccaacggctatcttaggattgtctacatcagttacatgagccactgactcacaaccctcctcatcgtcaacggctaaatcgtcttgatcttcgtcagaaccagggtcatagtctgcgtcaactgcctcatcatctgaaaccaagtcgttgtatttctctttctcatcatctacaccaacatactcaacctcatcactctcaccccaatcatcaaccttttccttaggcttcgtaggtttgctaggtttgctacgtttagatgcaatgacttggctctcttgagtggctaatacaatgtcagtacaagcaacttgtccatctcctgcaacagtactagccggcccatcaatgctgccttgatccatacaaggctcggtcctatttcgtgggtcatcactcacattaacaagcaaagggagcctcctcatctcccagtacatatcaaatgcatcaagcaatgaactatccgaagctatctctgcatacctctcaacatttttgtcccaataggttacagttatctcctgaagataactatgttttacctccccatcaagatcattaataaggtcaatccaacaaattgtatccttgtctattacccacttaatatcacgagagacatgataatccggtctaccgttctcatcaaactcaacgtatggaccaactcgaacatcaactctgcaagctgcgctagcgtccatcctacgcgacaaaaacgcagcaataaaatcaccaaatttcaatcactttaaattgcaacaaaaactctacaactcgcaacacatatcactgcaaacaattccactcataatgcgaggcaaaaaggaatcaagcttacccttgaggaacccaagacatgtccaatgccttcaatggaacctcactgctcgtcagccgcagggacgatttcttcccagcacacttcttccttggcgacatcttcctagctgccgctcggccgcctaccaatatgacagctccatcggcctccgccggcgccgccaccgccggccccgccaccaccgccgccgccgtcgctgccgccgccgccgtcgcctacggttaggtttgggaatggggaatcgggctgtggagggaggggggatggaaacagcgccggctaggtctggttcgaccagacccagtcaggcttagaggtagcggcgcgcaggggtagattggtcatttagaaaattttctgaccacttttgcctcggaaattataaaatattgcctccggtgtctcacagccaatttcacaactttcgtagtgtccgtgggcaaagccaagattttgcggtgtcccacagccaattacacgattttggagtgtcctgtagcaaattttgcctaattatttataccaatcggaaccaaagattaaaaaaaagcagctgcacacgcctcctcggcaaccgcgcgcctactcgttcttatcccttcttattctttttcacaaacgccttatcccttcgtcctctcttcctccactcatcctcttcactcctttcccgatcccctctcctcctctcaatcccctccccttacctattggtggcaggaggtggcaggcggcggtcgggcgggtggaggggaggacggtggcaggcggcggcccggaggggttgtcgcggcactgacgagcgggctgatgcagcgctgaagacgacgatgtgaggacttgtttttgtgatgtcgttgtagatgtgtggtgctgctgtggatgattaattttgtgaagtatgtgaatttgtgatatcaatgatctgtgaatttgtgttgtcattttgatctgtgatgtttatttgatctgtgaatttgtgatgttggtgagttgggctgtgaatttgtgatattggtgagtttggcgtgaaaacaataaattagagggtaacctttaattccgcaaaaaatttgggtttttgggtataccaacaattcacccccctggttggcttagttcttgtgattcgatcctacaaacatttttgttctctctgaattagtctgaacagttttgaactcgtccatttatctgaagcttgaacggttctgaaatctattgctccaaagtgttacctggaactaggcaaatttgaacagattggccagaaagaagctctccactgcagctcaccaccatcttcctcagcatgttgtcactgtaaactgcaacgaggaaggcagaggccaccaagtgctgtagtgagttccactcaactacatacagcaaactccctaaaataaattgctgcaagccatgtgaattattactgcattgcttccttcaatcaatttctagctaccttagctataaaaaaaatattcgcagtgttgtgaacttaccttctgaaagcggtggtccctaagtccggcaggatcgaggagtatgtgcaggactgtaggaacgaatcacaagaactaagccaaccagagggggtgattgattagtatacccaaaaaccgaaaacttttagcgaaaataaaagttaccctcaatttcgatgaaatcggtctaaccgaagtagattagccggtctgaccaaagcgtaaccgccggtctgaccggtgttgacctgccggtctaaccgccgagatcgcctgccgctcgctgtcgctgccaccggtctgaccgccgtgctcccgccggtctgaccgccacaatgctgccggtctgaccgccggtgagttgccggttagaccgccgaaacctggtgaaacacaaatcgaagaattcttaaagtagatgacgactttattgattctctccgtgtttacaaagtgcaccaaatgcactccttacaaaaatttcgactaaactcgaaaccctaactcaaaactcaactcaattgctctctaaagcgataccgggaagcctcacgctcccccttttatacatgaggtaggcagcctaaagccacgaaccaaactcatactaagagtcctaaactcatactagtacaagaaagaaactttacataaccaatcgtaccaaatttggactccttccaaattcaactccgcatcccatatgcacacaataactccatcgtatgacatatagaatctccatcaaccatgtgcatcaactctagcctaagtgtcccgcatgatctctgaccaccacggatgtcgccttatccccaagccgactcccggtccatcaccgcaaatactctcccgagacatcgagtcacctacacatggaacaaacaaagaaaccatattccgagaccaagctatctccaacttgactcattagcagcaaacaatagtattacatacgtatagtatccatctagaagtcataatcaagaaataaactcggatatccaaacaaacaacccgaaaccgaaaccgacacagcgtcggccggtcagaccgcgggctggccggtccgaccgctcgatcaccgccggtcagaccggcatacacaacccggtctgaccggtcacataaaataatgaaccctgcgatccacctatgaatccaatcatctccaaaaccacttcgtgaataaattccaaataacaaaatcaataatctccaatgccctattgttcatcacagaataataatcaaaaacacctttgattctacaatctcccccttgatgaacacattggcaaactcataaaaatgttttggtgtttggaaaaataaaaacaaaagtggtaaaaagcacacttcgtacaaatgtacacatcgtgctcaaaaatccaaaagaaaacttctccccctttttaaaagaaagaaatttccaattgaatctcccctttttaaaagaaagaaattcccaattgaaccaaaaacatgctcttctcaacaactcctccaaaaattcaccttgcttctccttgcttctccaaaaatctaaaaattttcacaattacttctcccccttttgacaatgatttcatcaagtataggaattatgttctttaatggtcaagagcttagcatacatatagcatatcaagtcatgtgttacaataaaaagaagataaacccatctagaacacaataagcatgcattaaagtataaccatgaaccaaagattttacaattaagcttgaatcaacaatcaaaattcatgatatcatacgatttataatacaacatcttaacaagcacataggttgaagaataaacactaaacacatatacctattgcatttatcactctttctcaaataaactttagcacaaaataaccaagataattttttaactttttcttttcttgagcctttttactcatatttttctcttttattccgggtacgtccctgtcgtcaaaactgtttccagagattcggcacccattattttgctcacatcgaatacgtccttgtcgtcaagactgtttccaaggattcagtattcattttttttcatattttttattctctttttcacaatgagcaattaaagctatttgaggaataacaattcaataaagcatatatatagagcatttataaatcaaaccatatgctagcatcaacattgcatatttacttaattcaagtagaatttaaatgttatgcatcatctcccttaaaagcaaaatctaaatctcatgaagagactagaatacttacaagctatgctagagacaaataaaccttcaaagtattgctagcatgcacaagaaaataccatatgtataacataaagctctcttttctcaatttttctcattgcaatattattgcttgataaaaccatgaggtacaaactctccctcaaaccatgccaaaaggatgatttatgcccaattcaccacgaagaaaagcaaagagattagaatccaaaggtttagtgaaaatatcagcaatttgcaactttgtgtccaaaaactgcaattcaacatctcccttctcaacatgatccctcaaaaagtgaaaacgaatatcaatgtgctttgtgcgtgactgttgaacaggattcttagcaatattgatagcactagtattatcacaaaagagaggtactttctcaaaagtaagaccataatctttcaaagtagataaaagccaaagaatctgtgaacaacaactagcaacagcaacatattcagattcagtagttgattgagcaacactagattgtttcctagaagaccatgcaattaatgatgtaccaagaaaatgacatgttccactagtaattttcctatcaattctacaaccaccaaaatcagcatcggaatatccacttaagcatatagaagatgaagtagaataccaaattccaaactcaagtgtatgattcaaatacctcattattcgcttgaccgcttgacgatgtgaagcacgaggagaagcttgatagcgagcacacaaacacacagcaaattgtatgtctggcctagaacagttagatacaacaaagatccaatcatacttctatactctttttgatcaatagcttcaccatcttcatcaggatccaacactgttg

SEQ ID NO: 75671 - DNA, 5869 bp, Oryza sativa
cggcgcgctgcagtgggcgctgtcgcaggccgtcaggcgcaacgacgcagtcctcctgctcgccgtcgtcaggccggcggcgaacgcgtcgtcagacggcggcggcggcggcggcgagtcgtcctgcgtgaacatatcgaggacgaggtgctaccagcagctggacgccatgaggagcatgtgtgaatcagccagaccagaggtaattaattaacaaacacatcaacttcttagttaacttgtgtaatttaaatctccttgggttcattcgtgctatgcttaaatgatttgactgttcaattagaccccctttttaaaatgccagaatacattttctacagtaagttgtcctctaaaaatatgttacagcaaagtttgagaggttagtatactcctatttgacaagaaacagtgatcccaacatgtaattagaagtcaaagatgcaattaaatcgtctctccagttcagccacgtgttgattggacggcttacgttgcggccataagtagttcagtcgattatctactaaccattagcattacaataaaagttttttaaaaaaaataaaaagaaaacaaagctttatagccttataggcagtgatccacttagcacatttcgcggaatggaggcgtcaaaagctattctagctaagcatgcagcctccggatccggatatttgcttcatcgtccttcatccctttcaaagcaaagaatattctaaacttaatttttttcagagtttcaattcaataaaataatattcagaatttcaaaaggacttatatatttttcataatttttgtacacttcaaattttactagaaatataagaaattctactagtatttgctaattaagtggcgttgtgcatgtgtgtaggtgaaggtgaaggtgtgcgtgatggaggcggccggccgggagcgcgcgccggcggtggtggaggctgcgaggcgccacggcgcgtcgctgctcgtgctgggccagcggcggcggcggcgggcggcggtcgcgcggtggctgcagctggcgctctggccggcggtggcggcggcggcggcgaagagcaagtactggcagcggaggggcgcgcggaggtcgacgacgacggtggagtactgcatcgagcacgcgccgtgcgtggcgctgggcgtgcggcggcggagctccggcggctacctcgtctccagcaagcgccacaaggacttctggctcctcgcttaattaattaatttaatttaattaattactagtgctttgtactagctaattgctgcgtagactggtcaatttgattcacatgatgctggataaggaagatgttatttacgggtggtttcatatcctctatagtaatgggaccctgatatgcgaggtactagaaggtggaactcacatatcagtaactgtaatggcagtaatattatggtagaggatcctcgccttcacggtggggttaaagcgcactaaaagtcggggagtatgctgtaatgtataagtgattggcataccaaatatcagacggttaaactacaaaccaaaaatatgacacgataaaaccctgctcgttgttgcgagagttaactatgataacaacaagaaaaaaaaatgtgtaagatagtttaaacaatataaacttacataaacataagtttacataagttgatgtgatttaaattcaaatagtatgtatacataagttgatgtgatttaaattcaaatagtatgtagagtgatgatttaaatgtaaaagaaaaataatgtgtctttgtgatagaacacaagaaggaagataatttagaccatatgagggaagaaaaaaaaagataatttgaaccatggattaatcatctaaggactaaaaatattgatgtgatatgacttaacaagagaaaaaaaaatagcatgaactaagtgagaatgaactactcactccgtttcacaatgtaagtcattatagcatttcttacattcatattgacgttaatgaatatatatatatatatatgtgtagattcattaacgtcaatatgaatgtggaaaatgttagaatgatttacgttgtgaaacggaggaagtatataggtatataggatataaaaaaataatggagatatattgatatattatgtgaatttaacatgtttatatttaaatctctaaaatttaataaattattaaattatagataatatatcatgcttgcatgatacttaaatgtaataattactagaaaaaatatccgtgcgttcaactggtgaaggatattttaatcttattattattggtatactgtttaattaaagtgaaatttaatgtgggatgaattcgttatatatatatatatatatatatatatatatatatatatatatatatatatatatatatatatatattagaaaatcatgagttgcagttatgatcgtctcaaggtagcatgcgagttttttttaaagtgatttcttatacaactctttttgtattttcaaaagtgaacaaacttcaaaaccgattcaaatatggatatgtatttccaaaaccgaacggacttaaaatcgactcatacacagatgattaccaaagtatcggtaaaaacatctttaatttttataatagtaaagattagtggatgatgatgtgtcatctttataaatgtgactttatagtaagagatgattagtcatgtacctgttacgtagagtagcgtagttgaacgttctaaacatgaagttttacatatttgcatgggaaaaaatgataatcattattttcaaaatttacctggcaaagtttttggataataatcaaaagatattttttaatttttagaacttgattttaggattgatgggaaaggctcgaggctttgcaacctacctggtcttaggcttaatttcagcggtgtaggcatctcctggacttcgcacattgccggatttgctactaacttctatcaacatatgtaaaatttgatcaatcgctgtaagacgctaatagttgtatggaccttagatatgagtgatattgtgatctaagttaaaccatatagaatttgacacatgagagggttcaagcatatctcaccataacaagcggccggacagtgacacagaccaggcaaatgaatagaatagttcaaaatgataaatattatggggattaattgatacgattctattacaaccataccatacgatgccttaaaaactttcaactctattttatttttttaaatcaactcaattttgaattcttctaactcggattttgaagctttcagctcaaattttgaaactttcaactcaaaatttaaaacttttaacttagatttgaaaactttcaactcaaaatctaaaactttcaacttaagctatgaatactttcaactaataattttaaatttttaacttgattttcttatatattactccctccgtttcaggttataagacgttttaactttggttaaagtcaaactgtttcaaatttgaccaagtttatagacaaatatagtaatatttataatactaaattagtttcatcaaatcaatagttgcatatattttcataataaatttgtcttgggttgaaaatgttactatttttctctacaaacttagtcaaagttaaagtagtttgactttgaccaaagtcaaaacatcttataaccaaaaacggagggaatactttattacgaaaaatgattcaaaaccataattaatgttaaacgctattaacgctaagcgcgtaactaggcccgcgtgggcacgtgatgtgcgcaccaggtcgcctcctgctgcagacgcgctgtgtcagagggtgaattcctcaagtgggggatagtaaggcccccttgttagttcggctgggggcagcgggtgagaatcgaggactcggtggaaggtgtgatgtagagggggtcgggcccctcaagaacgatgagacaagagcggtctatacaggttcggaccgctgagaagcgtaacactctactcccaggggcgaagccaggatttatagctagggggtgtgggcagggtgaacaagtcataagtcaagggaatcctctacgccgataaaacaatacacaatgtattctgccataaaaaagcttgaatttagctttttagttgtatcattagatgtttgacagtttgagacttaagacaccatgctcaataacgagacgcaatgggaggacagagagacgtgtgaagccgaagcaatgatgacgaggagttgatttgcatcgtctctccgtctctttcttattaattgattttctataccatgtttattaataatggactaattaacatgctaatgcgctagttagtacaataagcatggggtcggataggggggtgttggcccccttcggcaccccttgtagctgtgcccctgcctactcacgtgcttggttgatcgagtatggaatacaacccttgaatctctgagacactagtgtgagttagccaaagaatctttctctttctctccctccctcacgaggcctggacctccttttatatctcaaggggctgccacatgggcccaaaagtctacctagggatgagggaggacattctctacattaaatgcatgtcttgtcgcttaacttggaagccataagcacgggcgccatggcatggggcccatcaaatcgcaccggctgacacgggggacgcctgcgtcatttaccatttaatagatgaagacttctgggtcctcatgcgcgccgggaaacggaaaccccgcgttgaccaggtcagacgaactgactccggctaggatgagagactaaaaaacctttgatcatcatgacattacggggcatgttaggtggcacgccgcctgacatgtgaccagtgcgcaggcgcactatctcggtactattggtcactcgactggtcatagaccagtcaggcgcatagcacgtcgcattaagtgcggcatggcgcgcccgctcaggtcgccttaaatgcggttaggtaggcgttgggaccgcccacctaactccgtacacgtggtgtcctgcagagggggtcggggcccgacccctaggcatggagggggcggccactgctctaccccgggcccgacccccctcgagggagttgttgatgcgaaaaacacacactggcctggaagatctgcttaacttcagtgcaggtccaaaatcttacttttaggttcgtgagcatgccggttgatttgatcctgcaatcaacaagaaacaaagacaagaaaaaccatggttaaatctataaacgatagctgatcggccagccgccgatgacatatcatttattttcaagccgatgtcatatgtgaatcgatcagtagttgtaaacaagcaagatatgactaaatctgctcgatcggctgtagatattaacgatatacaatccttctatcgatgtatatttaaaccaagtgattgggatagatcagtcatcatgccgagacagtataaatcacttagatcaaaatatacattaacatgaggactataaatgtttatagcatagccgatcagatagatctagcatgtatcggctaatactccgataccactttatattaagatattaaaacatatataatatatcaaacaggagcctaatatactttattgcgaataagatcttaatataaagggcagatctagcatatcaattaagcatataagatatagaatagctaaatcaggtaagatcggctgaaaccccgatactatctctctcgacaatcataaaacaagccagatatcataataataaatattacttaatagatcgaactcaaccgatgcagcattaagcataaaaataagtacaagatctaggcaagatgatgaaaata

SEQ ID NO: 75672 - DNA, 6712 bp, Oryza sativa
gttcattgaaaaactatttttcaacgatgtcttaacagattcatgcataggaatatcattcccaatctataatatgtcatctacatataggattataaacaccagtgcgctccactaatcttcttgtatacacaaggctcttcttcgtttttgacaaagcccaacaccttgactacttcgtcaaaacgaatattccaactccgagatgcttgcttcaacccataaatggatttctgcaatttgcatatccttttagctgattgtggatcaacaaatctcttgggttgtgtcatgtacacatcctcatcgagatttccattgaggaaagctgttttgacatccatttgccatatctcaaatcgaaataggcagcaatcgctaaaacaatccgaatagattttagcatggcgactggcgagaaagtttcatcataatcaacaccttgaatttgtctgaaacatttcgccaccaatcgtgccttgtagatgtgaacattttgtaacatactgaaaatttagaattttctaattatgcatcatgccagttcttatgttcttattaaccttttaaacctaggaaaatataattagagcgacctcctaaaactaacttgcataaaatccctttttgatatttaaaagcttttgtgactttcatttaaaattatcttgggatatttcttgatttggttttaatttaaaaccttattctgacaaaattccttttattcaaatttagtttgaaaaccctcttttatttttgtgaattgaggtccaaggaaaatccttcaaaccaaatccttgcaattccaatgttattggaattatttgttaacccatcctttgattctcgatccaaatatccaaatcatttcttttaatctagccaccaatttaattcttgtggcttgattttcttctcggcacaagaaatattattattgcaaatattatgaataattgctctttgttgacgaaaaaatcgaacacactggcctgagagatctgcttagctcctttgcaggtccaaatatgatgagatgcgggcgtgccagtcagtttgatcctgcaactgacaagatatgcaaatagtagattaaaacagccgatcggctgacaagccgatggattagttccagccgatagccgataatagccgatgccgataccagccgatagtgatagggttttgtgctatcggctatatgtccaatgtagataatgatataaaggaaatcggttgatgatgatgtaataaaataacaatataatccagtataaactaatcagcaaataatgatatgataaataagcattgatccgaaggttaaagcacacatcggcaggaggtccgatgtcatgaaatccacaagattagattaaacagtgaaacatttgttgtcatcggctaaatccaacttatatgtatatgcaatccttatgagccgatgcaacgtccagataactcaccggctgaaaccccgatgaaacccttattggcaatcaagaagcaggctagagattatggcaatcaaacgtatctgatgcagcactaagtatgaaaagaaacataatatctagacaatcaaaccgttgactgagttttcagggtggtagatgtctaagctaatctaactagcaacgcgattaagccgatactggcagaaaccctaaaacgagaagcagccgatagaactaaattgatatgctaagactagattaacaaagacatatgataaataggtaggcaaaaatatcatccaaaccagagcaatccaataggtcgaatgtactgatgcaaccttaaatgacgccgacatagacgatacaattgcatggaccgacagaacattggacttacctcttagccagagatcgaacaccgatgcaaccccacgtcaggtgccaaatcccgccggacgataaaataaagtagaaaagataaaaggtggcgatgtgccgaattgtattgatcgtaaagataaattacatagaccccgggtgtacatatttatacccatgggttgatacaagtccttatcggacaagaaagaaattttcctaaatataaaaggaaaagataaagtccttataggacactaaacacactttcctaaagataaaaggaaactaacaaactattcctaattagtagataacttaccatgccgtattctctttgaactcggtctcttctagataagcttcctttagtagatcaatttctttaaccgaatatagcaagaatccgacaactgacgacttggcaactctcatcggctaatctcagaactttgaagccaatgctgactctaagccgatgattactccgggcttaccaaatttcactgttaacactcttgtgctaagaaaatagattatatctttgtcatccaaatttcctattagcctcaaacaattctttgaaacccatgccatatattttgaggctaaaaccctacttatccttctccaattatcttcttcccaccttcctatttacacattcaatttcattcatatatcccttaccctttcatttgagtgcatcaaataaattccattatatgctacctctaaaatattgcactcaaataattaggaaatctctctttggaaattatctccaaaataaattcatctcaaaggttagccacttaaatttcttccaaatattaatttggatttaaattccatccctcaattccctacacaaattagaaagccttcctattcatttgggcggaattttctctctcttccttcggcccagaccggcccaagtcggcccagcccctcccacccaagccgactccctgcttctcctcccatgggcgcttccaggcgccgccaccgtgcgccattacctgccgccgtgcacgactcagctaccgccgccgccatcttgctgtcgacgcgaaggaaccgccacccgacgtcagctacacttcattccgccgacgtcagcaacagggacgaaccgccatcgtcggccgatcagaggacagagccggcgccgtcattcttttctccacgtcgctgcagccgtgtcctcatcgaccttctcctctgaaccgccatcagccaccgcctctcgccgcctataaatataaggcgagccctccccttttctccacacatcaacagagcctcgagctccctttctctctctccatccatggccgatcgtcgacgccgtcggtcgatctccccatccgtagctccacctcccctatcctcgcgccatcggcttcgcctccatccggagagtccgtttttcccctttcccctctccctccacctttaagtgaagccaccaccgcattcatccatgccggctcgaggtgagcccttgccgccgccgttccggctatatatctctcactctcggccagccaccgacctccccgggtgcgcgtcgctcgggaacacgcgtggccgctgccgtcgaggccgttcatccaccggagcatcggcgcccctcctctcccttctctctgtttgctcggctggaagagaagaagcagaagaaggaaggaggaagaagaaagagaaaagaagaagaagagacgaagaactgacaggtgggcccctgtatagtactatttcgtaatttccctatttaattcaaattctattctttagaagcccatatctcctaaaccgtagatccgattccagtgaaacttggacctaaattcatctaaattcaaaatctacattttgatatcaaattttctattttaatattttatttgaatttattcaaataccgtttgaatttatatttgacttttcaaatattttcttttatcccaattaccctttagccactaaaaagccgccggttggaactttacgccttccgtggggacgttcacggttttctatccccaacatcgaaccgttagttgtaaagcccggcataaaccaaacccaaggtcgaagtgctgctcctggcaccctacgccttgatgcgtatagcggtcggagtttcactattctatcgacctccacagcacgccgcacagttagctctcagtctctgtgtgatcctagccgttccgccgccacccacggttgtcagagtaacacttccgccctactaaacctacacccacctcctattccctctggccgatatgctgtctgctgacactggcaagagaagacactgaatctagtcgttatgctgccaactctagcaacgactagcaaacaaccaaaccctagctgataccctgctagtcaaatcccagttgtcatccaaattccataccctctacaatatcacctatccaccatactctcatccacctactttctgtctaccacaacctatacataaaatatagagcctggccgatatattgccctactcctcaatcggcctaaatataaccaaaccctaggtataatcttatccaaacctactatcagccaataccagtcacatatctgctcaaccaattcaattatccactatactccctatccaccaaccaatcaaagtctgcacataaaatataggtgatcttagccgcttaattccttctccaccccagctgccaactctttagaaccgacacataaaatatcagctcagtaatccatataccctataaaagagataggctataccctaaatcctaaccctcccaactgtttatctctttctcgctattttatggcttttattgaatttggttcttcctcttctgtagtagagtctattatattttggatggcaaccggtggtatttcaaggatcggacaatcaggttgcgtatctcggatttatttgcgttggagcaaggcaagttattattcctctccttgagcataataatcctatattctatatctccagtatcttgtgcattagccatacatgattctaaatgcataacctgaatatatagcaaaccagatatatgctagattttgcttagccatgcctagttagattacataaaatataataaacttagattggaacagtacggtagaaatggttgatttatgggtggctagtactgtttcaaccgacataaaattgccaagtacatgtgaagaacatacgagtacgaccgcaattctcgtatgggcatagacctagctgattaagttatctagcaaaggtggtacatctgtacattggttctattttaagtcctcgcgcaggaggcaaatttacaccgagcagggcgattgtgatatttaccgaggcgtaggtaaatatatgagatttattgatgtcgacttgtttgtgaaccctgattgcgatgacatggtgtcatacaatcagttctctctaaagacctcgggaacgccagaactcctctcgctgttgataacgttacgttcagagcgtatggggactagagttcatggaacagttaccactgatgttagtaaccgaaaagctttgccatgacaaggctaatgtgtttggcacgtcatggattgcgggtaaagcgtacatttactgcagtagagtataaatgaatctattcgaatagccgtgctcacggatttgagcattgggactcatatggtatttggttagaaacttaattctaaactttattaaatactgttgcatttaaaacattctaggctttcttcctttttatattatttgctttctgcaagtaaacctagctctactcagatattaccatttcatgcattcattattgaatataatagcttgctgagtatgttgtactcacccttgcttcaacccctctttttcagagtcattttggagttcttatcgaaattgggagttcaatcacataagttagtttcatttcaatctaattctcaagtctagattagatagatggtttaagtctatagccaaacattagagctaagtcattctatagcttctgctgtattagttagccacaagtttgtaaatacccatatgttttgtaataatatctcctttggagccttattcaaacgtatgcaatgaagatccagagtgttgaacctgtatcaatttactaatccagggcttgatacagtctaaacatgtcgattaccaaatcattagttttgggacccgacacatttccatctacatctgtcttcttcttaaagacccatttgcactcaatggcttttacaccatcaggttgatcaactaagttccaaacttgattgacatgcatggattctatttcggatttcatggctccaagccatttctcagagtctggtcccaccattgcttcctcataggtagtaggttcatcgttgtctaacaacagtatatcacgttgtcctgtagttaacaccgcatacctcgtaggtgtacgtcgtatcctttcggaccttcgtgaagccggtgcttccacaactggttcaacaacaacttgttcaacctgttgaacaacatcttgctcagcttgttgtggttgtgtggacgttgaagcgttttccggtgtttcctgaatttcttcaagtcaaaccatgctcccactaacctttcttgaaataaactctttttccaagaaaacaccgtgtcaggcgacaaacactttgccctcttcccaattataaaaataatatccttccgtttccttgggataccccacaaagaagcatttatctgatttaggtgtgagtttgttcgattgcaaacgttttacatagacctcacagccccaaatctttaggaaagacaaactgggacgctt

SEQ ID NO: 75673 - DNA, 17796 bp, Oryza sativa
caatgtacgattcctccgttcagacaccccattccactgaggcgttcctggcggagtgagttgtggaacaattccacactcctttacatgattaccaaattcaaggctcaagtactctccaccacgatcagatcatatatacttgattgtcttgcccaaatgattttgtacctcattctgaaattccttgaacttttcaaaggactcagacttatgcctcattaagtagacataaccatatctactaaagtcatcggtaaaggtaataaagtacccaaaaccacctctagcagttgagctcattggtccacatacatcagtatgtactagtcctaatagttcacttgccctttcactttgacccgtgaaaggtgcctttgtcattttgctaagtaaacaagattcgcatgtcaaatgattcaaaatcaaaccagtgtagaagtccatctctatgaagcttctctatgtgtttctcatttatatgacccaagcgacaatgccaaataaaagtgggattcaaatcattaggacgttgcctttttgcattaatgttatagactgaacatccatcaagattcacaatgtataagccattcataatgggtgcatgggaatagaaaatgtcattataatagactaaacaaccattgtccacagatctaaaaccataaccctctgcttgcaaacaagaagcagagataacgttcttgcacaaagctggaatgcaataacaattatttaactccaaaactaatcctgacggtaaagataatagcatagagccgaccgcaacagcagcaactcttgctccattgcccacgcgaatgtccacttcgcctcttgctaagttcctacttctttttagcccctgcaatgatttgcatatgtgagcaactgaccaggtatcaaatacctaagaatcagtagagaaagtagcaagattaatttctataacattaatacctgagatggaactctttccatcctgctgcttctgcttgagctgctctaggtatttcttacagtttctcttccaatgacctgtctccttgcaaaagaagcactctgcatccttagtgggccctgtcttttgaaccttggtcttagagttgctagtactcgtgatctcatcagagtttagctttatcttttgaccacttttcttgttgttgggcttgcgttatgtataaccatcacatggttggagtttttcttaatgctttcctcagcagtctttagcatcccatgcaattctgccaaggtcctgttcaggttgttcatgttgaaattcattatgaatggctcaaagctgggagggagcaactggagaatcaaatcagtagccaactctcggctaaggggaaaaccaagcttatctagactctcggtgtaaccaatcattttgatcacatatgggctcactggattaccttctgtaagcctgcacgcaaacaaggactttgaggtattaaacctctcagctcttgcatgctcctcaaacatgttacgtaatcccgtgattatcgtatgagcatccaatgcctcatattgcctttgaagctcaggagtcatagtagcaagcatgagacagcttatatcaagataatcattgcatcgcttttcatgctccctatgttgagcagcaggagcattattgggcaagtcagttggaaaaggctgtgtaagcacaaactctttgtgctcttgtctgaacaattctcaggttgcgataccaatccatgaagtttgttccagtcaacttctctttctcaagaatagaccgcaagttaaaactggatggtgcaggagctgccatgatctacaatagaaatatatgtatgcaaaatcagcaccatgtttacatttaacctttcattaaacaatttaacaaaagatacttccactatgtattgtgaaacaaaattccctctagtaacatagtgagtcaagatcctcattttattagtgtctaatgagctttggcatcacaactagacaactatcaaaataggtaaccaacaccttgctaatcacatcatatgtgactcttgtgctgttggggtgatatctccatgtccaacccaacctatgccccaaggtccaaaactgttttgataactttgtcaagtaaaccaataatctccgcatatagatgtctgacatctatcctattttatcatgataaaaagtgacactttgctatggcaaaccataataggtgcaattattggaagagcataaattaaacataatttttctgagggaatctatcctaccatgtcatatcaaatatataataggaataaagtaagatagatataaagccccaagcgaaatctaaggggcaatgcacacggcggtcccgctatgtgaaaaccttaacggcgtaatcaaattatgccgaaaccgagtcaatctcattggctcgtttttctcattggcgtgtggttccagtggacatcggactatccgatgaacacaatcgcgctcggccttggtgagtactagacattccagtgaagtcaccaacacacataccgattgatctcatcaacccatgcggctattagctcatctcatgttccgatcacctaagaactcatatacaacataatagatctcatctactacacctgcatatcaattatatgcaatgatctagatcataaactatacaaggcggctctgataccactgttgggatacgcgtaggctacgatagcataaatcaaaattttctattgcgtaaaccaggaaccatgcaagtattagatcataaatcgttaccactcgatgcgctgcgcagcggaagaagacgctgagaagtagaaggaactctcgcgaagtagcgcgcgtcgatgtagaggaagtagtcaatcgcaccggctcgaccttctcctcctcgtgcgttcttctcgccgtactcccacgccgatcagcaccgtaaaccagcggtgcctctactggtatccacacatacagagacagaacgccacacacagatgtgctagcacctgcgcgcggctagggttttgctcggggagggaagtgacggctagagtttctcacgtgatgcaatgcctccgctggtcacacccctcacgaatatataggatccatcactcgggcctccaaggcccataggacttctattcggatccctatgcgaattaagctcatattggatctccatccaatccccttcttccggcccattaagcgtgcgaccctgtaggtttatgtatactcggctgtaacccgaaaactccttttcagttcacgcgtcaacagcggcccctagcagaacgtattgacccattgggcatacgaaaagatcatatcggctgaacctctagtgtatacatgtatgaacccctttgcctcacgatatcgattaagctcaatgctagatatgtgccatcctctaatagcttaatcattcactcaaacctgttgatagattatataacttgtgattgactcctcaatcacctttggcatggccatgcatttccataatctacaacatcgaggggcccaaagatatctctccataggagggacaaatcccatctcgattattcatatcccactacatgtttcatagcatacccgaaaactacttttataactacccaattacagagtagcatttagcagtccctaagtaagctactacacatgttgggaaccataataatctcaagtataaggattcaacaccaacactaaatgagatcactgatgacacaacacatatggctcttgcagtgtctcatgttgggtctatccaacaacatgttcactaacatgtgtccacattattaatttggtatctctatacgatgatccatgacacatgatcatcaattaatacatgtgctgatcatctaaacatatttgttccacatatgatatttgatcaggaatcctttagaaatagcaacacataacataaagagttatgaaagaatcatatattaattaaccaataatgagtttatctatttcaaggaacaaagtcgaataaatatgtaaacatagtgtgtaatacaatcttctctatgattgcctctagcagaagaggggtgttcaatattttgatttttatcggatgtccgacgtctagtcgtctcgtagaacttccaatcattagattagaacttttaatttatatgtaaaatccatcgaatgctcactagagaggggcccatctaggcaagcatatgacagtgtgttctagtttgcctagcaacacctagcgcatcctcctctatcatagattctaacacttctagctaatgcatagtcggcatttgaactatctgaaattaaaaagtcactgattaccaattacagctaattctgaaagaatatgctgcgttaatgcgagaaaacggacctgtaggggtgaggacaggaggaattgtggcggagggtgttaggttatcgtattagtgttattaaattgctatacatttgagaaaaaatatataatggggtaaaattaagtcacaagcgtgtttatatgcatattggaaaaaaaatgaccaaagtcgttaaatattgtaaaatagtaccatcaaaatctctattcttaattaataatatcaccgaggtagagtgatgaggtcatgcagtatgaatgcagcaatgttatttctgtgtctgatttttccttatcatgagcagctgctgcatgcctgcactagaagcagcagaaatcactgcatcagcaatcctttcaactatcgtgctgtcagggagtcgagagtcgagcaggcatgtttttactgtattttccgtcctctgaacgaagccacaatgcagacgtgcagtgtggactgtcgttttggtacatggtagtagatggtacgaacagtcgtcgcaggcaatgttgacgacgtaagtgtacatgaacccatcgccttgcctctgtagatgaactgcgccccccgacccctcatggcctgtgacgcccgtgcgatctcagtggcgcggcacaacacaagcgagcacggacgcctcgacttccataatttctctctcaagggtccgtagcagggcctgatcgctcgcttaggatgcgtttgattcgtagtcaagttttgataggatacagtgatccgttttttatgagtcggtggatattattatcatccaatttttttatggatagaaggaatataatgaaaacaataacaaaatatgttattatcggaaacggatcctctattgtagagctaatactgcacaggtgctgtagcgatcaaatcaagccatctgattagattaagcggctctgattccgtccttaaacaccgaaaatatttttgataatttggaaactaacaaactgattttaaggaggaaaagtcaagatcaccttgatggagggaaaatcacgaatcctctagagtacttggcgccaaaataatacaggttctccctttgctttcttcctccttgggacttggtgccaaaaggagatacaaaggtttcactttgccttgttctgtccagaaactttgatgatcagataaagtaagccatcagtctccaacaaacaggtatgtatgccatgtcttgtactctttttgtgatcatgtcctcacaaaaaaaaaaccaaaagcattgttgtgtgattcttatgattggagtggatacactctacactcgtgtagcgctaaacagagtatacctacagatctgaggccttatggcgaacgactcaaactccaaccatcataattcaaataggtgagatcaatttcattcaggtcaacatagttttatcatctacatttttcttttctctgactatgttgttgatctcattactgaataggatcttaatcatgaccacatagcaatccatatttaacactgtatttctttgttgtaaaaaaaaaagagttgatccctgtttctttttacagcacaaatatgattcctagttggattcctcaatttggcatgaaatttaaatctacaaaagaggcatgggaattttggacttattatggaggtcgtactggttttgatgttaggataaattatgaaaataagagtaaagttgatggagtaattacttctgcaagatatgtttgttccaatgagggataccgggcaatagacaaaagagatcacaacaccaagcgtcctcgtgctaaaacaagaacaggttgcaaagctcggatcggaatcacagtagatagagaagtggacgattattcagtatatgatttagttctcgaacataaccacgaacttcaattgccttcaacatgccatttgatgccatcacagagaaagatatcatcattgcaagcatttgaaattgaaacaatggatgattcgggcattggaccaaaagctgcacatgagcttgctagtcggcaagttggtggttcagtaaaccttggttatacacgtcgtgatctcaagaaccatttaagaaccaagcgtcaaagggagttgatgtatggcgaagccggaagtatgttgaagtactttcaggacaaagttgcagagaacacttcatttcattatgcccttcagttggattgtgaagaacaaataacaaatattttttgggctgatgctaagatgataatcgactatgctcagtttggagatgttgttacttttgacacaacatttgggacaaacaaagaatacaggccctttggtgtctttgttggattcaaccattttagatagagtcatttttggagccgctcttttgtatgatgaaacatttgattctttcaaatggttgtttgagacctttttagctgtacataatcaaaaacagcctacaacaatctacacagatcaagatattgcaatgggaaaggcaattgaggtggtatttacagaagcatggattgtgcacttttcatataatgcaaaatgctatcaaacacttacctcgtaccaagaaagaagacacaaacattttgtctgatttcagtgcttgtatgtatgaatatgaagatgaagcaacttttcaggaagatttcagtaccatcagaagcaaggtgcataagcagacttggctaaacagtatatataaggtaaaagagaaatgggcggaatgctacatgaggaatgtttacacattagggatgagaagcacacagttgagtgagcttaaataatgacttgaaaaaccatctcaagtctgatcttgacattattcggtttttcaataatcttgaaagagttatcaaaggaaaacgagacaacgaattagatgcagaatatgaagcaagaaaaaaattgcctagaattaaaatgagagttcctatattggtgcaagcaagtaagatttacacaccttgtatatttgaatattttcaaaatgaatatgaaagatccatggctacatacatcaagtcatcagaacataatgaattcattgttgcaattgaggctcctggtgaagggtcaacatttgaagaggagtgcaaagttgtaggcaattatgcagagcaataggcattgtgcacctgtggacaatttgaaaggactggaatattgtgcagtcatgctttgaaagtccttgatgtgatgaatattaagtctttgccaaagagatatattttgaagcgatggactcgagaagcacgagttggtgctattgaggactgttatggcaagattgtcgtagaagatcccagattggaggataggtgcctcttgaagtttcttattcacaaatttcttggtatagctattcgagctgctgaatctaaagagtgcagcacactagtggacagtgttctagagagcctgaggaaagaagttgatgaaaaaacacctaatagtcaactaggtgaagttgcatctgaagaagcaaacggctctttgcacactgcacgtctgaagaaaaaagaaactcaaaagtgtagcacaaggagaaagaaaaattggcttgataagcagcatcccaccaaaaagaaggtacaagttgtacctgacaaacaaaatatctcggtatgttacttacgaactattcaattagactatatatgtactattcaattagactatatatgtactgattatatatagagtaatattttatctggatggttttgcttagcagcaagtgaaggattgttccatagcacagaaccaaattctggtggagaagactaatggaacgaatgagaagggatctgaagaatatggatggatcaatagctatgcagaactactgagggtattccacttatatatactaaaacttatatatttagtgcatactgtctagcagcatcaatattatttttctaattactctaattcattgtatagggtgatggcatggagcagaacatatttgatactacctggaattttgggttcagtgcaaattttgatgggagatagctagatacctgggtatcaaattgacaataacaaatcaagccattgaacatttacttttgagaacatccattcattttttttcaatgccacagaaaatttatgctatgcattcttctgtcagtttctgtcagcgtttagtactgaactattggcacacatgcagttacctttgtacatgtttccatcagagtattatgtttaatcttcctgaaaccttttcatcagagcactattttgtagagggtgtaaatgaacgatgcaacttttttagtgttacacaacttttttagtgttacactttggaataagtgtagacttcacagtgaggcgatgctctgcttatgatatttgtagaagatgtgaaatgggaggcatattgttagatgaacagcacacacatatgtataaacagagtctgaagctttcatggccttagccatgtaactgtcaagtaagtggtgggcagattgagcaaaatcagagccatctaatgtaatctgatggcttgatttaatcgctacagcacctgtgcagtattaactgtacagtagacgatccgtttccgttattatcattaacatagtcataatcatggaatattccatcctatcgtcccttacccaccaaccaaacaaacccaaaaactaaccatatctagggatatctttttaaccaaccacacccttagaccaccgtagctcacggcgcgctatcgttggacggcgttgcatggccgtggcatgtctgctaggggcaccgtggaccggtcaacggaggcaggcggcctcgaacacccggttctctcacaccttgcgtggtcgcgtctgcctgctgctctactactgcacaacaggttttcgaattggggctttgctctgtttttatgttgtctagaaaaggagaatagacaacctagtctgattggtctatggtcgcggggtgtctggtctaggtagtctctctggtcgccaattcgttcccccctctccgattcatcccgttcagcaatacgaggtgcagagtggcagcagcgcaacacagtgtgtgtgtttggggtggggtggggtgggggggttgatcttctcaactccctccgtccaaaaaaacgaacctaagactagacgtgatatattctagtacaatgaatctggacagaggtatatccagattcatagtactaggatatgtcacgtccagtcaaagttattaggaccggaccggacgtggaaccggtgaagccctcggttcacggtttgaatggctcaaccggttggaccgccggctcaacacgagtcaaatatcttcacatattaatcaaaaacatcaacgagtccatagcacagtggtgggagattacttcttgtgaccacaggtaggcaatttgaatcctatgcgcggcccttttcctcctatttttctcttctcacccatcccacgttcccactgccctgttaccggcttattccccaatttaatgtacattttttctccagttcatacctaaaaccggcggttcaatcggttttcctccggtttaattacatggccggtcttttggctggaccgcactgccctgttaccaccttattccccgatctaatgtatagttttaatgtacattttttctccagttcatacctaaaaccggcggttcaatcggttttcctccggtttaattacatggccggtcttttggctggactgcactgccctgttaccagcttattccccgatctaatgtacagtttttctccagttcatacctaaaaccggtagttcaaccggttttcctctgatttgattacatggccggtcttttggctagaccgcggaccagccgaggccagttttctccagttcatacctaataccggcggttcaactccggtttgattacatggcctgtcttttggctggaccgcggaccgaccgaggccctggttcggatcgccggtccggtccggttttaataactgtgcgtccagtaatatattggttttttatgggacggaaggagtagtgtgtaattttgctggcatcgtagaaaaataattcttaaggcctgttcagattgtagccaaaataaacctaaccaagttttggcaatgccaaaattttggcaagatatcaatattgccaaaatgttggcaggatttcttatgtattggccaaattcggccacaactaaacgtagacattttttttggcaactttgccaaaaaaaataatatatggttgaaaatagcatctgcccttagcataagggaaggggcacgcggcggaaaaaaaaaagcgtgcatcgccgccacctgactccaccgccggcctaagctagtttagcgattgccattcataagttgattttctttaagaaaaacggaaaggcatggtttcagaaggtctagttgcttccagaatcatgcaaaatatggcaaggggtgccatgcgttctatatggcactcagcaagtgccaagtgccataaaaaaaaattttctgccgcgtgtgctcctagccttctaccaactcgcgtctacaatgcgcacatggatgagtcagtggcatagggtctagggagcgacttgtacggtcattattcgattaatccctcctacaagggatcgatgaaggattttggtggagacatatcatgagggccttcatccgaacctgccaaaaccaccaatgagctgtaaaacaaccagaagccaagtctggatgaaggcgaggcccatggcgaagcacgaaggcggagcctagggcgaagcagggacgcaacttcgcacgggcccaacccgagaaggctgttaggaggcccacaacttaatagacattggttacccctgtaaatgtcaccatcataaaggcattcatataatataccctataaacaataaaccctagagggtaacagcttatactagatccatgtaatgagggatcctaaaaattttactaagtcaaaacatccaaccaagtttcatgttctttgatgagacgcaattgtcatttgacagcagatttagagataatttatttcatttttattgtggtgttgaattattttttctcaatccactccgatccctcgctcttagggattaatcgacgccactttcttgctgttggatgcataggaattgcatcgaagatgaggtcctgacgggatgaggctgggttcaagagttcaagcaaaatttagttcaactaggccttaggtaaaatgctcaatgaatagcaaaacacaaaacagcaaggtcttgagaaatctaatgatataattttgttttgaacaaaaggttttccttccctatgcatcactccttttctttctaaaattaaactacattgctactatccactaatcatcagctagaacgaaattgcttatattgccctttaaagctttatattgcaatgaatgaatctgattcagaaaaatgtcgctcatccccagattagctacaaatcggactgcaccacaacttatacctgttcatatagggtggcaaatcatattagttttgcctggatcggtagttcaaaaaaaaaatcacaacttgtatccccgaacacaacctcccaaatttgcattctctagaaacttcatcacagtttaccttaagtatttgctagtgacaaatttcatctttttcccagcagcgcataccacctaaaccctttgaagataatgagccaatcattgccaaaaggaaactaaggtcagtgcatcaacaacagaaagaataaaaagctgtgcagtcattcatgcaatccttaatatgaatggcaaggcacgaaaaaaaatatatacagcactcattcgtgcaatccataacacgaatggcaaggaagaaaagccacagctacaatttagtttcaagagaagatgttaagcgcaatttgcataccatgcaaatctatgattaacatctagtaaaaaaatgctatccctatttgcagctctgaaagagacatatatattcagtacaaggtcaggtaatgggagtctctatcacttgacagtaaatcgtaaaaagccactaagtttgattgctagataatttcaactcgtgcaacctaaagttatcactgggtgtgtatacagaattgcaagaaatatagtaagccagacaattgatagtccagcagccaccaccttttcccatactaacttgagccagaggtgcgaagttttctgcattgcagagcatgtcttgcaccaacgggtctgcaatctacatgcactaagaattaaggagcccaagatgacgatggcaacggactactaagaatgaaggaacccatggtggagatggcaatggactgcttggtgatggatctgttgttctgcaacaaatcgatccatcctgaccatgctgaaaccgagtgttatcagctgaaggatcattgcagtgggtaaaacatttttgaccatatcgattgctccattgcaggcacaaaccattagaggtgggggaaagggaagaaagtatacctgtctttttttttcaccaaataccagcagagtgacgtcaaagcaaaaatggatacaagcaaagatccacttgctagatgcagtgctcccagaatgcactcaagaacgaacaagttccaggcagatccactcgctagatccattgctcttgaggatggcagcaagaacaatcaagtggctgggacatgaggggaggtttactttggagaattacctctgcacatccgtccggaccgcccaatttcctgagccgggatcaaccacctcgccgtcaacctcaagctctaatctcgtgaatggggtgttgcgctgggaccagattagtggcgtcccatcgatttccagccctagctcatgccaccgcgcctgctttcggctgccgccgccgccgttcccccaagctccttctcccttctcctgacaagctcgccagatccagcgagaggcatcggtgggcgggcagttgcggcgcggcgaggctcaagccacgagccaccatagcaggggaggaaggggaaaaggcagcggcagggagagcaagggaggatggcatgggaacagtggctggctagggtttcgtgggagggggattggccaattgggtatgctcattttttcaaaagaacccctttctgttcgatgttttcgagcgcagttctatttttggatttttctcttcttcatataaagttttccttcttgtgaagggcctacaacaaattactaacaatgtaaagggtctttttgcaaaatctccaccctcatcatcctaccgttcaatgaagccgatcggacggcgagcgggcacaaggagggaggctgcctcccagggcgcgggggcgacgtggatagttccgcgtgcgaacacgccgccctgaatcgctctcagctcgccaattcagggcaggttttaatttaaccgatgaagtaatgaacagctagcctagtgaagtaccaggctgaaattaattatggcatcgccacagcatgcatattaactctctcaaatcataacacactcaggcactttgttcattcgcgcaatcttcaggactaacgtcatttgaattaacacgccccgcgatctgatgcggtggtggccgcgtaaatttcatgcgtgcgtcgccgccgccggccgcttgcccgctgccgcctcatttctgtgtgcgtcgctgtcgccggcctcggcgagcctagcaatttcttcgctagtaaaactggaaacgtagaggtttagttgtcaggtgtcaaaatcttgtaatggatgccatgcattctatatggcatggggtgccattgaatttcagttttttccgcaggcacccaccgagaagcttagcgcgatcaatggaaccacagcccgcgcacgggcccctcttgaagccgcggcctcatctcggcgcgactcaacggcccgggaggctggcgtgttggggtggcctggcccatccgtgcgcccggggcaccagcgcggcaccggccgaaaaagcggctgcccacgcatctgcacgcagaaaatcccagaggaataagttcaccagaggtccctcaacttaacagcaagattttctgagatccctcaaccataaaaccagaaatgttcgctcctaaactcattcaaaccattcaccggaggtcccttggcagtatttttgcctgattttggggacgtggcatcctagtcagcaaaaataataaaaaatttcgtggggcccacatgtacgtgagaaaaaaatataggatcaaccatcttagtcagcaatcttctctcttttcattttttttcttcttctctttcggcatgagtgatagcagatatgacgagcagtgagagcagtgaggcagaggggcggcgtcggcgatcgtagagggcgagcgccggcgtgcggccggagcaggcggagggccggtgtcggcggctgcaggcgatggaaagcggcggacacgcgcggtcgcagagtgcgagaggcagcgggtgacggtgcgcggctgcagcaggcggagggcggcgtcagtgggcgagcgtggctgtggcggtggcaagcggcgggcaagcggcggctttgggcttgggcggagcagaggggcggaggacgcggggtgcgcgacgacgcagatggggagcggcaacagtgtgcgactggaggcaggcggagcggcgacgtctgcggtggcaggcgagcgtggttgcggagcatcggcgttggcgggcgagaggctgacggcggagtagaaaggcagcgacgggcgagcgcggagtgagacaaggtcaccgccgccgctcggagggaggcgaggtcatcgccttgggtgcctctcgtgctgctttgacggcgggaaagatggggaaggggagggagaggactccgatgctacagtacgggaacgacgcgagtgcgcacagcgccgtgcccaggacgaggagggggagcgggcggagagacgagcgccaagccgccctgcctgacaacgacgattacgagctcccagcgccgccacacccgctcggggacgacgacgacgccgccgaccgcctgccaccgcctccttcctctcccggtctcgcccgccgtccgctccgcccgcagcccgccgccgctatgcccgccgcctgcatccgcgctcgcccgccgtccgctccgccgcagctcgccgccgcactattgtctcgctcgcccgccacccgcatccacgctctcccatcactgctgcgcccgccaccggcctgaagaagagaagagagaggagataaaagagaagggaaggagaagaaaagagaagaaaaaagatgtgcagctgacatgtgggccccacgaaattttttaatttgtttttactgactaggataccacgtcagcaaaaccaggcaaaaatactgccaagggacctccggtgaacggtttgaatgagtttaggggtaaatatttctcgttttgtgattgagggacctcaaaaaatctcgttgttaagttgagggacctccggtgaacttattccaatccccgagggcgccgctgcggagcctcgacccaagaggaaaaagtcatcgctacgctctgcgctccgctggctgtccgtccgtacgcgcaaacgagcccggtgcgtcgttgggtctaggttgggcctgctggcagcgctgtgtgtgtatgacttgtgaggaggcgtggtcctcacaataatctgttgcgctgcaatttgagttgagacctgaacggggtttactgtttccagatgcgctggcagctttctttctctatcaagccagggatctttgccatgctatctccgcgcttcgcttcgcttcgggggctgcgccgagcgtgcgtctggccttgggtccttggcccacgttgccttgcttgttggctgcggcacaccaatgctgttgctggtcaaatatatacgtgtatgtctatattaatagcgatacatccatgctgttggtggtggcaagttaggagcgacctatcagtgatatgaatcatagagatgattgtattacatactatgtttacatatttatccgatattgttccttgaaatagataacttattatttgttaatgaatatgtgattcttttatgagactctttatattgtatattgctatttctaaaggatccctgatcaaatattatatgtggaacaaacatgtttatatgatcagcacatgtattaattgataattatgtctcataaatcgtggtatagagataccaaattaataatgtggacacatgatggggaacatgttgttggatagacccaacatgagacactgcaagagtcatatgtgttgtgtcatcagtgatcttatttagtgttagtgttagtattgaatccttagacctgagattatcatggttctcaacatgtgtagtagcatacttagggactgctaaacgctactccgtaattgggtagttataaaagtagtttccgggtatgctataaaacatgtagtgggatatgaataatcaatatgggatttgcctctcctatgaagagatatatctgggcccctcgatgttataaattatggaagtgcatggccatgccaaaggtgattgaggagtcaatcacaaattatataatatatcataagttcgagtgaatgattgagctattagaggatggcacatatctagccttgagcttaatcgatattgtgaggcaaaagggttcatacaagtttacactagaggttcaaccgatatgatctttatgtatgcccggtgggtcaatacgttctgctaggggccgctgttgacacgtggaccgaaaaggaattttcgagttacagcctagtgtatacgaacctgcagggtcgcacgcttaaagggccagaataaagggattggatggagatccaatatgcactcaatcaaatagggattcgagtaggactcctatgggcctcgaaggcccagtcgcggatcctatatattcatgaggggaagtgaccggcggaattaacacaccacgtgaaaccctagccgtcactgccatccccgagcaaaccctagccgctcgtgggtgcaagcacatctgcacgtggcgttccgtccctgtatgtgtggacaccggtagaggcgccgctggtttatggtgctgatcggcatgggagtacggtgaggagaacgcaagaggaggagaaggtcgagccggtgcgatcgactacttcctctacgtcgacacgcgctacattacgagggttccttcgccttcttagtgccttcttccaccgcgcagcgcgttccaatacttgcatggttcatggtttacgcggtagaaaattttgatttatgctatcgtagcctacgcgtatcccaacacaaccgagcacttatagttaataacaagagcaagaccttcctactaatataggatggctgttg

SEQ ID NO: 75674 - DNA, 22387 bp, Oryza sativa
atcccccccacctcgcggttctcctatgggcgggtaattggctttgtggttgtagaatgcggggggtttacgaggggttttgctcgattccccgagccgaacagagtttagtttggggatgatttcgtgtagctcgattcgtaggatcggtggtgtccggcatttgtttttttttcccttgatgaaatcgaaatgcagtgtagtgtggagttgatttgattggtgttctactgttgaaacggagatgctcacatggcgtcgttctactgtgtccgtgtgcagattgacagcgccagtctgcgccacatcctccgccccttcgccgcacagggagcggcgccgccggagcagctggccgcaagccatccgagctcgcagtacggccagcccgcgagagcggcgccgagcacctcgttgcttgctcaggtggctgggaaccatccccatgccacccatgtttcggaccggaaggcgttgtttggcatgctcaatgcaggcaatgctgctaatgtcattgatcttactcgcgcttccccgctcggaggcgcggagcctctgcccaagcatccgaggcacggcttggaagccagcagcagcgttgagcagccctcctgcttggggccgttgtttcagaacacaagtgcaaatgtgcagggtagttttccaggggaatgttcagttaacaatggtattgttccagtattccaggagtctcagtgacatgatttctgtcttcctgctgcagtcttttactgttagtgcttctttggacatgcagggatatcccaaggcgccatccagtttcaggactcgagcacatgcgcagtgcagaaattgccatcccaatcaacccctcgccatcatcctgcgcttctaggggatcagatatgcgtctcctgtctgaatgttggtgggttcaacttgcaacaatatctgcaacctagatcgactaccctctgtcatggtctcatgagggaggtagtcattgaatggctagttacagtaagcatttttaccccttcagaaacctgtgtctgcaatggcctaaatagagaacccagccattgaactatgtacgatgtgtggtgtgcaatcaaaagttctacacccatggaaataaaagttttctgcctcttgcttgtactgttgtacagcatgtagtcctcaaattactgctctgtgttatagcttcataatatgggttctgttgcttaatttggtagagattttaatagtgatggagctcttattcacagttattgttaattattattagaacaattcgatattttttatggtaaaagtgttcccacctgctgcttttaaccattatgatcatatattactttttttactaaagccttctgatgtgcttttgggatatgaacaggtggtgaattctttgtcggtgaagctgggatttttggagttcgttgcttttgtcaccggctgagaatgtctgtggctaagttctgtgaggtactatacaaatttatgattgttacgctgattccccatttaggcactactacagatgttcttactgataaaaggtatgtatatacacattttgtagcattcaggaggacccgcagaaaaagctggtgaaattgtcattatggataatggcatgactattgtacaatggctcaagtactgcatgggggtgagcattttatcttgtttcggttaatctgttaacttttagttggtccaagatatgtagtttaagggtaagtatttggtaaaaatcacatactggatttgcttgtttaactctaaaaggtaggcacctagtacaataatagttgtgccagcagccagtttgatatgagtcacaaagtgaaagttggcattggttgcatttttattttacataatggaaatggattacatctctggcctctacccgtaggcacagccaagcattggttgcatattaccagatagaaataaagtaactctttttttaacacatgtaaaaacccaggctaagttctacataagtttatttctggttgtcctttactgtgtcacatatcatctggaggctgtattagcagcagaaaaaagaagaagaagaagaatgctttagtagtattttctgcattatattctggaaaatatcattaaatgtagtctgtggtaacaggtacatatataaatttttaagtttttctttgtttaagtctacaaatgaggcattgtaaactcctgtattatagccttaaggatacagagatagtttccatcagagattggtaactcacaagtcacaagtcacaactagtacatgtcatgcaatacaactgtgtatttgtattgtgttgcatcttgtaagtattttacatattttgtgaatgaacaacagaaagcttattgaaatacattttcttcacacatacacttccagcctgtcccaatcatataacagccactctatatcaatttttttccttcttgtttacatctaggttggagcatccatttctgacactaagtgggactggccagaatgggcatatatgagatattcttcagaagaatactggactaaaagtctccttacaacgaacaataacatggaaaaaacagggctattcagtggacatggaaaaagcactggacatataaacaatccagtttattccagtgatatccacaatgaggttggacgattcacttctgttgagaagctagtgaataagccagatgaaacattttatagaaagagtgtcggtttacatgaagctttctcaaagaatccagctatacagcagagttcgaaaataaacttagcaaatcatatgatccatgacatgaacatgaactctattagcaggccaagtgaacgaacatattcaacagcaaacatgggaataacttacagtagaaatcatttggcacatgattatgcaaactttctggagaaaaacttaaataacttgtctcgtagtcctggtcctagttctacaagagttttgagcaatgacagtagggcatgcatgcctgatgtacctcacaaaataattcaagatggttcaggtagagcatcaaacaccgaactgaagctggggcaatcatcttatcatcaatctatggctaccctatttccatcggtgcagtcgacaataatcgaatttcagaaacctcagcaccacctgcaattcacaactccaagtgagctttcctgttattagctgcaaatgtaattgttttgttatccacattatcatttgggtagaatttaacttgtattaactattaatatggcacatccacacatgtgtagttctgtttgctttctcgctagatatgcaagagcttgttaattgttatgctaggtgctgactgaatacacaaaacgacaaaaacaccataagaagctgctagtactagcacaatgaatgtgaacaacaacatagttctggtatgattttataacacattaacaccatagaagaaacacaattttgcttagttcttttttttagtgtaaaatgagagcatttcccctgtaatgttcatataatgccagaatcacttggtgcagatgcttatccgaagcaaactaccaaagccaacaaaactatagaaaacattgagccatcatttggtacaggtaataggaaacgatcacttgatgtttctaatggaaccagccattctgaactcaatgagattacagatgatgcagcaaagaattcatttatttcattatttctttcacatcttgagagaaatagtacatctgagtccattgatgatgttctcaacagtaatgagcattaccttcttaaggctccagatgttgcatatagttccgatcgtttaaaaactgcaagtacacaagttgagacaagggcaaatgataatcagttgaagttggcacctgccattattcacacgaaaaggatatcagatagcaggtctcttccagttccagtggcttccaagggatatgttcatcaagatgtacttcatgcaaatagtcaagagcctttaataaatggggactgcctgccacatttgctgcctagtcaacctaacgccggaatctccaaaatttgcgcagaagtttcttctccagtgaattgcaggtgttgtaatcatgttgctgacaaatcccatcttgcacattctgagactggggctccctgtttttatgatagaacggtaagttgatcttacactttctcatagcacaagtaaccactgtcaccactgccaaccaccaaaatgtcttttgattcttcaagcattatgtgcaggccaggagatatatttcttttgaatgtgctgatgacttgtgcacacataaaagtttgagagctaccaattatcagtgtggaagagccttttgttctacagctaatgagtttctacctagctttggccaaaatgatcaatcgccaataggaaaatcaatgcatagatgctgttgcaaagctcaagaagattcttccaaacttggttttagagctggcaatttctgccgatctcatttctgtaatgatggcactccagttccagcccataggtctattgttgaaggttggtttcttcacagtgcaagtgatatgatagacatcacttcttatttctgattattttcttgaatgttgtcttgttttaattcagtggcacactttctcatatttcagggctagatgaagtgcgcacccgctctactttcataccaagatcctcattatgttctagagagcttatgttgcagtcctgttgccatgcatgtcccattgatgggtactacagaaggtattttgatttagggcctattcactttgatgccattttcaaccttaccaaattttggtaaagttgccaaaaaagtgactacatttagtttgctgccaaattttggtaactatataagaaatcctgccaaaattttggcaactataccaaaattttggtaatgccaaaaattggtaaggttttttttggcatcaaagtgaacaggcccttactcaatctttttcttatcttgaatttcacatattcctgttaatgactacttcctccgttttacaatgtaagtcattctagtatttcccacattcatattgatgctaatgaatctagatagatatatatgtctagattcattagcatcaatatgaatggggaaaatgctagaatgacttacattgtgaaacggagggagtatttcagttccatcactgctaccaagatttactcttcacatattcaaattctagccttgattctgatcctattggttctaatagatgatagctactgcctagtgtatgtataatgctaatttggcctgaaagcacttgctatttcctgttcttagcaatgctcttaagaccagccttttaattgatttgagtactggaaaatgggcaggcggcctgtcaaacaggttgtatagatgagcctttcttcgttgtttccattttgacattatgcttatgtgtgctgtttcacatcattacaagataaattgatgacatcaatttttgctgaaggttacacttagttttcaaggaaatgagcttagacgtttgtttgatgctatatctatatacacatgtcaatgatagcatacatgcgctatcatgcaaaatgtgctcttgaagctatcgctgtgctccctttcatattcttttatttacttattgcagttctatgggacacacagccaacagcttgactaagaacactctgcttgatgcacctaataatacagaatgtagtccttaccgggatggaaaatgctgctgctctttagccccaaaatgtttggcaggttatggatttacaaagcactgtgttgctagaatcgatcaaactgatcatacagtacaaaagagcaaggatgatggcatgcaagctgctgccagatgttgcacgctaggggagagtgaaaaattaatatgccagtgctcaagcgagataattgctagaaaaagcgactctaaagcttctttccagaatgaggtctctactgaagtattgaaccgaccttgtgttcctacattacagcagctgaagaatgtaacagaagcatcggctgtaggtggccattggccctatgaaactgtaaaagagaaagcgagtgcttgtagagattctggaatatttaaagaactaaaatccggtttctcttctggattctccagcgatgttgtgaccaagttttctgcatcacctgaattgaacaagtatggtcttgaacacaaaaatcttgtgtttgatgaagggtcacgaattgagaaatgttcctcatccagctatttgcctattagtacaggatgtgaagaagcccaaaatagtttttctagatttcacctggagccatctttagtgaagcacaaaaataatcaaatttctgagggaagtacacggaaagaacatgagaatgagggacaatgttctgaaatgtcaaagaaaacacgaacattgaggtgctgtgcaaacaaatcagaatccgatgattgtactaggaaaattgatctgtcatcccgggaaggggattctcaaccgcagcataaggctggtccattttcacgcagagtatcaaaaaccaagaggaaacatcctcccacgcatctgaataaacatgtgaaacggcttcacagcaactgcaaagttctcaatgttgacaatgaacggtcagatgatgagggcatttatgttggagaatcaaattcctctgatagaaaaaagcaagaagataatatgaccactttggatagaacaaaatgccaacagcaagggagtcgattgcttgtccgcaaactgccaaaatatgtgtctctgaattgcattgtaaatgaaactaacagtgaagatgcctgtagtgggagtgccagtattgattctagtttgattgctacaggaataactaatgataatcggaaatctcccaaaattgttccactcaatctgattcttaaaaaggctaagagatgtcatgctatcaaacccctcagtaagacagaaaatatccatttttctgaggaaaagagttcagatggttctgcagataaatcttcctctggtgacagaagtttcagtccacaagatgaactgtggtctcccaaaaagaataggtattcatctaatgtctcgaggccacacgtcaagactgactgccaaagtccctgctgtggtataattctgaaaactgcattacagatagtatcaacatatagctaagtaacttacagtgttccttttagaaaaatggaattgacaaaagaatctttctttttcagtacttgaagaagatgagcctcttagccttgcagatatggggacaagtcagctgtcagcatcaagaagtagaggtaggagtctaggacaaggacagccataacatatttggttagatttttttggttatttattggaaaatttgattccatttttgtcaaaatgatgcactgtgtgacattacagattaactagtaacatggtcattagttgtcatctttactgaaaaactgcatcgcatgcatagcaaacttctcatttgcttaatttccacatgagatgctaaagaagttttaccaacacgatctaccaaccatatgcaggaagtaagaatcaaagagcatgcatatctcttaataggatggagaggtgtgaagaatttacaaatgaatcagcatgcagtccttgtggcgataaacacgctgcggttcaagcctgtgtaacaaaatttgaaaggttgtaactccaggtgcattctacagatttcctttgaaggatatgttccatagaaaatatttcgtttttattaatttatcttgcttttacagactgatctgacaaagttctgcataataccttatgcagatatatacaaaggcctagtttagatgcttcatgttgtgtttgtggtatctcaaacctggagccttccaatcagttgatagagtgcagcaagtgctttatcaaggtttgtcatattcccttaccagaacctagtactggagtctattcacatagagccttgcattttttttttctgtaggtgcaccaagcttgctatggtgttctaaaagttccaagaggacaatggttctgtaagccctgcaagatcaatacccaggacacagtaagaaaattcaatttcagagtagtttcatttaaggcatttaatagggcatgatgtagccatgtaggccagaacagccatctttgtgcttgcagattactgtgtgcaagcactatagaatttttcactgattcttttagggctatttgtagaatgaagcttttattgaaatcaagataattacatcaaggtgatacaaccatttagggatacactgctggtatagatgtatggacgctgcactagcatggaaaatacttcagtcaaaattaatcttactaacactaacatcctcattgttagatacatttagtagtgattaattgtatatcggtatctctttacgttttcctttgccaggtctgtgttctgtgtggttatggaggtggagctatgacaagggcattgaaagcccagaatattctcaaaagcttgctgaggggtattgcaactgcaaaaagatcagataaatatgtttattcatcaggaaatgtgaacagtgagtgtacaagcaagttacatggggaatatgtcaggcatgattcatttaatggacacagatcaagaagcttcaatgctatatcttcttttggtataaaagaagcttcaataggtagtgcacgtggggacattatcagcaagtcgtggacctctaatcgcaattccagtctacttggtccacgaacaaggcagtgggttcatgtggtctgtgggttgtggacacctggtacaaaatgcccaaatacaatcacaatgagtgcttttgatatatcaggggcttcacctgccaaaagaaataccgtgagttccctacatgcatattcttttgaacttcattgaaaatatgtttcctgtaaattgaaagtgcatccaatgccaagtgctggcattggccatgggtttcctttcatcctgcacccgattatttagtcctaatgaacttaatcttcattattgctaatgtttttgttgtcaggaatgctcaatgtgtaacagaactgggggctcatttatggggtgtcgtgatgttaattgctcagttctctttcatccttggtgtgctcatcagagggtatgatatccactcataataagctatttgacctatatattatcacattgatttactgtatgctcataagaaatattctgcaatcttggttaaaacttattgttatctcaacactgtaaatctgaatgttgctcatgatatcacaatagggtttgttgcaaagtgagccagaaggcgagcataatgaaaatgttggtttttatgggagatgcctggatcatgctatgcttgatcctaatcatgttaatcctaagaaggaatgcttgaggagcaatgactggacatgtgcacgtactgaggtaatatatttgttttacctttgtactgcttgaaaaattagaatcctaacaagtgacaacttcctttgtcattcttctgaaacaggtttttagaggccgaaagggagactcatttggtgctaatcgtagcaggaaaccagaagagaagtttggtgagtgcagtgtttcccaagaacagatcaatgcttggatacgcataaatggatcgaaatcttgcatgagaggacaggtaacttctaatccttcactgcaatgcagttggttatcttcaatatagtacattgtaatgtactctgctttagcggggtatcaaagtttgcatgtacatactggatgagctgtttacatgtcttcattctcatttttagaaggaatatgtccactacaagcagttaaagggatggaagcatttggtagtgtacaaatctagcattcatgggcttggtctctacacatcggagtttattccacgtggctctatggtaattcatcagttattctttccttagtcgataatctgacacaagaatttagcaaatgaagaaattgttaacttctgcatgaaaatatttcaggttgtacagtatgttggtgaaattgttgggcaatgcgttgctgacaaaagagagattgaataccagtccgggaaacggcagcaatataagagtgcttgttacttcttcaagattggaaaggaacatatcatcgatgccacccgcaagggtgggatcgcaagattcatcaaccactcttgccaagtaacaaataatatgctcatctgtgtcttttttcgtccatctaaaactgaatgtttctaatgcatgttttgttttcttccaatctttgctggatcagccaaactgtgtcgcaaaaataatctcagtaaggaacgagaagaaggtaccccttttctttatttcgatgttgtcgtttcaaaatattcgccccagccctctttctttcctggcaaatttatctgtttctattctaatgtgtttttatcattgtccaggtagtgttcttcgcggaacgccacataaatccgggggaggaaattacctacgattatcacttcaaccgagaagatgaagggcaaagaatcccctgcttctgtagatcgagaggctgcaggagatatctgaactaagatagtgtacttcggtcgtatgtttgtagtgctgtttaaacattgtaatgtgcgcactgtatatatgaataaactgtagggacttaatctggcactgataatttagacatccaaacttaaatttagaatggatttagaattaatttagacttcctctcccgtgctcggcagcaaaattggaagctacttgccgctgctggagaaggccactgaccttgatagaacccgtaactcgttgatttcccgggacattgttgtcgtaggtactgggaattgtgctcatggaacaagctcataattcatagaaaattcatacacaacctaggtccaatataacaattgaaccttaaagtacaacatcagtaacttggaggtaaaactatcacagaaatttccaacacaaaagaccaattacattcactcgcagtatcaatcgtagcttggagtcaagaaaggattcttctcgtcatagaaagggtttgtgaaatgttgactgctgctaagactgtcatggacgttacccttcactgcagcctgatgctgagagaatgctctcgggttgaaattttcgtcatggctgtctccgaatgcaacccagccatcaccgccgccggtgatgtccctctgcttctccatctcttcgacgtgctccttgaactctttcttcgccacgttgatcacgttgtctccgtgttcatcgcaccatgccctgcaaaaacagatactatcatctcagaatttctgaaccatgtctgttaaatctgaatgatgacggaattgtgaagttttcagtactttgggaagaaggtcttgaggtcagatttgtccactggaagccttgttgagatggcctcaatttgttgatccctacaatgatgccaggacatacattttacacacttcaaacaacagtaattgatcaaaaaattcattggcaaaacagacagattaaaacttacgaaaagttcaagtttcggttggtggatgacaactcagcctgaatccttgaaagctctttctttgtgttctccaccaaaaccttcagtaagttcagatacaaaaagctcagttcagtccagtaattctgaaactaccaagtaccaatcaatggacacctgcacaatctgtttactgaaactaaacacgatggagagatcaaccactttgcaataccttatcattcgctaaatcggaagcagaatcatcgtcgccggtggccgtattcagcttcttcttggctctctttgcatccttggcaacagccgggctcgcctcaagccggcactcactgtacgaagaccgcggcgcagcgtgctccggccgctcaccgccggccgtcgcctcatcgttgcttgccttcttccacttcttgaggccatcgaacccccacgaactcttcttcttgctctttgacgcatccttctcctgatctgtgccttccatggacgccgccgggggctccttgttctcgctgccattgccgccgttgtggaacatcgccgtcaggtgcctcctcttccccttgtcggtcttggcggtgggcatggcttccgacggcgagctctcggccatgaggacggatggggcgttcttgctgttgttctggtcgacgggggctaacggtggcctcgatgcgtccagctccttcttgcctctgctcttccatggcgggacgaaggccttgtgcttcggcttgtcggaggccgccgcggcgggcggcgggtcccggaggtcgatctccgaccactcctccatggaagacgacgaggctggtgccgccgccgaagccgcgccgccatcgccgacgtccgcgtcggggcagtcgaccacgacaccgaacgccgcgaggcgctgcacgagtgggctcttggtggagttgtactccgccgccgagatgcacttggcgtacaagagctcctgcaaaaggagaagggagaagcgttcgatcaattgctcgctcggattggagggagggaggtagaagaagaagaagaagaaggcgatgcgggtgggtagtacctggaggaagaggagcttgtcgcggaggatggcgggctggtcggggtgggcgggcgggggcggggcggcggcgagggtggcgagcatgtcggcgcggaaggcgtcgacgtcggagggcgggacgatgccctcgcggtggagcgcggagaggtggaggatgcggtggaacgattcctgctgccacttgagcgcgtcggcgtggcgcctcgccgcggcctggtcggcggtgaggcggcggccggacctgaagccgccgaaggggaggatggacttgcacagcgacgcgatggtgtcgtgcaggcccgagtagtacgtcggcgtgtacgtgtaccccatcgtcgtcggcgactcgtcggcggcgagctgctgctgctgctgctccggtggctgctcaggcgaggcgaggaggggagcgtgagagagagagagagggagatggtggtgagagagtgaaggggaacgggttttgttgggctacggcccaacggttggggagaagggaggaggaactagccgttgagttgaatctgcagctgcaagtgggcccgttcgccacgaggtcaagaagcttcttcgcctaacatgttgatctcagccgtttaacgactgatccaatggttggtcggggagacatcacgtttaccggagtatccgatactatcatgtaaattaaagagcaagtgatccctctgttccatatttttccctatttaaattttattaagcttgatcgagttttaaaaaaaatttagcaatatctaaaatatcaaattaattttattaaacctaacattaaatgtgtttgtttttttattaaaaacactattatatttttctataaacttgataaaatgaaagaaatttagttagaaaaaagtcaaacgacttataatataaaatagatgaagtaaaaaaaataagggagacgaagatacaacaattcatcaattcaaaacacgaagatcgattgttgaacagatatatgcgtaggcaagaaactgcaatccaatcgtccagcattcacgattgtatgtattccacaaagaaatgccaacgtaatcagataactgtgagtgagttcagtgattttcttgaacggaataataccagtttttaacttttgataagagcgttgagccacaaagctgaaaaccatgctgaaaaccatttgctggatactgctttcatcccatgaatatagcaatatatatagtactatcagataagacattataaaactatgaatatataaattaaattagtttcattaaatataacatcgaaaatattttgattatatgtttgctttgtgttgaaaatattactatatttctctataaaatcaaaacgacttataatatgaaacgtccctccgttttttaattataagtcgctttgatttcttaagtcaaacttactagaagtttgatcaaatttatagaaaaatttagcaatatttatagcaccaaattagtttaactaaatctagcattaaatatatattaatagttttttgtgttgaaaatattagagaaaatgcatgtgcgttctaatgtgttgaagcaattttaatctcacacattatttgattgatgaaaataggagtcctcctatgatttttgcatcatgcaaaacctatacgcatgcatgcatgtattgataacagctagatagacagatatactgacatactgtagtaatgtctggctaaacaatttcattctcagaagatagataggattcacaaaccgcatgaactagacgtacgggctccgacttagggtccaaataggatttagtttggctacatctttatttttttttctctttcataatcggaaacctgactctagtatcataccttctattcatcttcacacatagatagtttttctatctaaaacgaataaacttgtgtgcagatcgccggccatggctaccgtcttcccctaccgttggactaaaaccaagcatctcaccgagcgtccacccacccacggccaccctcccgacgctcacccatggatcgtcctcgacgtccgcgcctacatcgccgaccgccagaacgccaccaccgccaccacctctctcaccagcggccgcaagctccagatcaccatctgcgccgcgccgccgccgctcgtctcctacgtctgcgcctggtcccccaacgccgaccccgccctcgtcttcgccaaggaacccgtcgtcgcctgcgtcaacgccgacctcgtcttcctccgagtccacagcgatcaagtctaccacctggtctaccacgccggcggcggtggtgacagccgccgccgccgcccttcgctcacgcttgtccggcaccccgaccgccccttccatcgctgtcattaccttagtgagctcggcagcattgccatcctctcccgccgccgtgccggtgccggtgacgaccacgacgacgactccaccggcttctatgtctgcagtcttgatcaggagctatggtatgggttacctggacaacgtggccacttcaagctctgcctctacgactccatcgatggcgaatggagccaggagacccttcgtctcgaccagctgcgcaatccgcaggacaaagacaccgttttccattacacggagaaggtgattactctgcacgatgaacaggtagtggccttcgttgatctgtggcgaggcatggtcatctgcaatgtcaacgatggcacctgcaacaacgtcgagctcctgccgaagctgaacggtctccctgccatggataagctgcggatagctcgtcctatgctcagcttgatggattcgcatgtcgtttacatcatgggcaaggtcaatctctccggcgagaaggcggtggtgctcactgttgacatggccaacaagaggctgcaaggggtatctctgcgtgacgctgaaaggatcgtctacgatgataacggttgcagctacaaacagtataccatctcccaatatttcactacatctgcaggtgattgattaatccctggcctgtttttttttcctacttattgcttttcttttggagaaatcttgtgtcgaactgacgagacctcacctgctttcaagaactcggctcgttcgtcatcaacctccctctcctccaagaatttcttcaccaattccatctccttagcctcaacttcctgcgaatctttcacagcaaacaaaccgcatgaaccagagcgcaaaatcacaaaaatgtccgtacgcgaagtttgtgtgtgtgtggtggggggtgctccgttgccggcgctggatcaggacgagttcgtcgtcgaagcgagggcgcgtcgatcggccaccggcaatccgattctatccaaaccatcttccgccgatccgatttacttctcccctccgactccaacttgcattgctgacatcgattcggatctcgatcttctccgactccgaatactccacgctgctctactttaagcccggccggacgatcgccggcgggaggagaggccgcagccatggctaccgccttcccctacagctttacaagaaccaaacacctcactctctgcccgcccagcagccacggtggggatgcggccgatcacgggccccttccatggatcctcctcgacgtccgcgcctacatcgccgaccgccggaactccaccaccgccaccatcgtcttcagcaacggccgcaaaatccagatcacattctgcatcgcgccgccgccgctcgtctcctacatctgcgcctggtcccctgccaccgaccccgccgtgttcttcgccaaggagcccgccgtcgggttcgtcaacgacaacctcgtcttcctccgcgtccatagcgatcaaatctacgatctcatctaccatgccagctctcgcccatctctcaagctcatccacaacccctacagcccctacaacccatacgactaccttcgtcgtatcgacaacgttgtcatcctccctgaccgccgccatgccgccggcgctgatgatgatgacaacaacagcggtcacttctatgttagctcgctcgatcgggatcaccgcttcgatattggccacttcaagctctgcctctacgacgaagacgattccatggactgcaaatggagcaacaacatccttcttcttgaccaactccgcaatgcgccagacaaagatatcgtgctccatttaacagagaaggtacttatcctggatgatgaacaaccactagtggccttcgttgatccctggcggggcatggtcatctgcaacgtgctcgacaacagcagcacacctgggggaagcagctacatgccgatgccatccgagatcttcaacatccacaacacctacacttcatccatttcccgtgacattgctatcgtcaatggccgtctcaccgttgtcaggctgtgcctttacctcgattcagatgatgattcagacgatgatgatgacgacgattgctgcgcttgggatctgaccacatggagcaagccagtcacctgtttggatgatgagtggcgtgaggacttgaagatcaagtccagtgacgtctcgattgacgacagcactcggaacgcctgcctcctgcccaagctggatgatggttgcccaacaacggagacgctccagttagctcatccaacactcagcttggtggacgctcacattgtttacatcatgggtaaggttgacgtctccgatgagaaggcgctggtgctcaccgttgacatggcaaacaagaggctacaagaggtatctatgtatgacgccgaaagaattgtaaacgattttgattatgcctacacgcactctaccatctcccagtatttcactacagcagctgcaggtgattgattaattcctagccttgttttttttttctacttttgccttttcttttggggaaaccttgtgatgaatatgatagtaaacctaattcaaagtagtgataggggaaactattttgatccctcgaggggatatcaatatctttgtcgtttgcatgttactcaaatggttattaaaaaatgtgaaaaaatttgagaagatgtattaacgtgtgatatatcacgccacaaacattcaagttaaaattcaatttttacatctcgcaaggaaaaaaaataaattaaactatacaactagttaatgtatattcacagacaaatttatttttttcgttgcgagatgtagaagctgaatttgaacttgtatgtttgtggagtgatatatcacatgttaatacatcttctcaattttttttaatttttttaaaacaatttgattaatatgcaaataatgaggggatatcctctcaaggatcaaaatccactcccgttgaccgttgtgatagctgatatattgtgtgtggctgctgctttagtgctagctagacaagttgaggccgtaattagtgtgaacctcgccaaactctttattacccatctaatcatggaagccgtcggtgagcttccaaacaagttatagagtacagttccagaaaagttgtaaatttcatgagaattaatgcaagtcatgtgggacacaaacccactcaaatacaactgcggcatattggattgaaaaaagtacgaattacctctctaactatcaaggtcgaccgaaatacacctacaaaatcgaagaccagatattctacacccccaactattgaaaccggataaataccccgtgtctcaatccggagcggtcccacatgtcagcctccacctcatcctccctctcttaagaagctagttggccccgcatgtaagctgctccctcttccttcgtctcctggccgcagagatgcctgtgccgcctccaggctccagggacccgcaccgccgccgccaggcacctgcgccgccgcactcatcttgaagcccgcctccttcagtcggtcgtcgtcgccgttgctcccatccaaccgctggagagagagcgagagaggaggggaggggaggggagaggagagagagagagagagagagagagagagagagagagagagaggagaaaagagatgacaaccggcggcggcgacaccctccagggcaggcgggtaaagcgacagactccttcacttcggccaaggacccccgccgcccgagttccgtcggagtggccccgtctccaccaccgccgacgccgaggtccagacttcgctcccccctgctacgccgtcgccagaggatggatgctgcttcaccgcctcgatttcctccgccgatcccatcgtcaggaggccaccactgaccgcgccagcaccggtctccatcgccgctaggccgccgcttcaccacgaccgccaccgctctgcctggctgccgatggcctctcctctcccttgtgccacatctccgtttttctctctgcctcccatccgcgcccgccgccgctcgccgccgaccgttcccctccccgactcgcccgctgccggccggagccgcgcccgctgccgctctcccagccgctcccgtcaacgctaacagcatcaacatagaggatgggagggcgccttccacctccgccaccggctgcccgggcgagctccgcctccgcctcagccgcccgccgctcggggagctagctctgcctccaccggcggccgcccgctctgcctccgcctccgaactcgaaaaccgaggagctccgcctcagccgcccgccgcccgaggagctccgtctccgccgccggtcgccccctccgccttcgtttcagccaccgtactagtgagatggtgaggggagggaggagagagagaggggtggggatctgacagtgggtcccactaattttttttaagagagggaggatgaggtggaggttgagcaggatgttattttgaccggtttcaatagtaggggggcgtagaatgtccggtttttaagttcgggggtgtaattcggtcaacctcgatagtttagggggtaattcgtactttttcctattggattctagattgtctttatagataaatatttttccctgtcagtgcacactatatcaataacatgcacataaaaaaagtgagcatttaaaagaaatggtcggaaatgaaaatagaaacaagatttccgccccaacaaggtagaaagagaaaagaccattttaggtgctattgcatgcgtgaactaaattggttgatactcttttttgtttgctcgaacacattggtgatactctgataggaggacttccattttggtcaccctcgtcgcgtgaagggttaggcatattaatatattatatatgtactcctctgtttttaaatatttgacaccgttaactttttagcacatatttaaccgttcgtctttttaaaaacttccgtgtaatatgtaaaactatatgtatacatataagtatatttaacaatgaatcaaatgataggaaaagaattagtaattacttaaattttttaataaaacgaacggtcaaacatatttaaaaaaattaacggcgataaatatttagaaacggagggagtaatacgtaggctatttgcgctgacacatggggacttttgttttgctgggtgcaggtgtaaagggaagcctgaagagacctttgaagtttcatattcaatatcctcacaagcggttgggtgaaacaatcaataggagcgatcctatggacttgcatgagccattgcaactggatgctggatctgacatgggaactacagacggaactgaaggcagcgataatcctatggacttggaatagccatgccttttgagtgaaactaaatgggcataaattaattagagctgttgagaatcatgtccgggcataaattattatagattaatttgagctgttgaaaatcatgcccgggcataaattaagggtgtgtttagttcacgaaatgaaaatttttgtgtgtcacatcggatgtttgaccggatgtcggaaggggttttcggaaaaaaactaatttcataactcgcctggaaaccgcgagacgaatttattaagcctaattaatccgtcattagcacatgtgggttattgtagcacttatggctaatcatggactaattaggctcaaaagattcgtctcgtgatttccgtgcaaactgtgcaattagtttttttatctatatttaatgctccatatatgtgtcaaaaaattcgatgtgacgtttttaggcaaaattttttagtgtagctatatttatggcgccatatttttcatcgaaaaatagtcggcatgtatttacattttaagtccctaaattacatatgtaattttagtgtatttacaatgtaagtctcaaaattacatatgtaagtactaaaattacatatgtaaattcgaaaattacatactaattacatatgcaagtggggtgtaaatgaggtgtaactacggtgtaagtggctaaaaaaaaatcgactgtaacatatggcgccatatttctagcaactctgaaattttttggaactaaacaaggcctaattagagctgttgaaattttgaaaatcatgcatgccccgttatgtattttggttgttgtgcatgactgcatgtctacattttagatttgccttgaatggatatgtttatgctcttgttggactgtatttgatcgttcagatcgagagttgtctttggagcgtggtgttaacatattgatttcatctataattctgtttcagaaatattttttcgtactctacaattcagaaatagcaggggaagcccactgctttccattttcttgaaaccagaaaatagagtttgagggtggtcgttcgccacgacttgacctccttcgccaacgaaatgtaatcgccaattatgcataacccataggctgatctgatcaggaaagaagattattgctagtggcctttgccagaaatcaggctatcgtcaagcacaagccactaccggcgataatacaaccatagcaattcaagataagcagatccgattttaagcacctccgatcgatgaaatcgatttacttctccccctccgattccaacttgcatcgctgacatcgatttggatctcgatcttctccgactccgactcgggatcctccacgctgctctactttaagcccggccggacgatcgtcggcgggaggagaggccgcagccatggctaccgccttcccctacagctttacaagaaccaaacacctcactctcagcccgcccagcagccacggcggggatgcggccgatcaccggcctcttccatggatcctcctcgacgtccgcgcctacatcgccgaccgccggaactccaccaccgccaccatcgtcctcagcaacggccgcaaaatccagatcacattctgcatcgcgccgccgccgctcgtctcctacatctgcgcctggtcccctaccaccgaccccgccgtgttcttcgccaaggagcccgccgtcgggttcgtcgacgccgacgtcgtcttcctccgcgtccatagtgatcaaatctacgacctcatctaccatgccagctctcgcccatcgctcaagctcatccacaacccatacaacccctacaacccataccattaccttcgtcgtatcgacaacgttgtcgtcctccccgaccgccgccgccatgctgccggcgctgatgacgacgatcatgatggcagcggccgcttctacgttagctcgctcgatcgggatcgccgcttcgatcttggccacttcaagctctgcctctacgacgaagacgattccatggactgcaaatggagcaacaccatccttcttcttga

SEQ ID NO: 75675 - DNA, 62058 bp, Oryza sativa
ccttcttcttgaccaacttcgcaacgcgccagacaaagataccgttctccatttaacggagaaggtgttcatcctggatgatgaacaaccactagtggcctttgttgatctctggcggggcatcgtcatctgcaacgtgctcgacaacagcacaccagtgggaggcagctacatgccgctgccaccggagctcatcgatgcccgcaggacctacaattcatctgtttgccgtaacattgctatcgtcaatggtcgtctcaccgttgtcagactgagtctttacctcctcgattcagatgatgacgattcggacgatgacgattactgcacttgggatctgaccacatggagcaagccagtcagttcttgtttggacgatgaatggcgtgaggacttcatgatcgagtccagtgacgtctcgattgacaacagcactcggaacgcctgcctcctgcccaagctggatgatggttgcccgacaacggatacgctccagttagctcatccaacactcagcttgatggacgcccacattgtttacatcatgggcaaggttgacgtctccgatgagaaggcactggtgctcaccgttgacatggcaaacaagaggctacaagaggtatctgtgtatgacgccgaaagaattgtcaacgattttgattacgcctacacgcactctaccatttcccaatatttcactacagcagctgcaggtgattgattctcttttttttttttcgggaatacgccagtgacgcatttttcacattatgagaaataaaagttatttacaatcaaagaaagatcagcacgggacaaagttattgattcattcctggcctgtttttttttctttctgcatcttgtttttcttttggggaaaccttgtgatgaataccatagtaaacctgattcaaagttggctctcataggactttttttttatcatatcatactttcataggacttggcgtgaagggttaggcacatgtatctgtaggctatttgcactaacacatgggcacttaatttgttttgccgttttactggtttgcaggtttaaagcgaaacctgaagcgacctttgaagttccatatacaatatcctcacaagcggcagggtggacctggttcgaaaattagagatgaaactgaagatgggaataatcctatggagttggattaattagtatacgaattgcgatacaaccaaccgcatacgaattgtctgtattcaacaacaaatggtagtgcaccagagcaccaatataatcagatgagcgtgcttagtgattttctcaaatggaattgcagtttttctactagaactgagccactgaataagctaaaacccatcttattactagagtcatacatggcttgaacaataggattgagctgttgaggtggataatttacatggcatgtatgagagcaacttttaacaccacttcccagaggcctgcagccttagttttcagttcccacaggttgaaactatctccaaagtcttgctgataccagcaaggaactcgaacattcagacttcaaacattcaggaaatcaaattacaatgacaaatggataagactgattgctaattctgggtaatgaattataaaagaactagattggctgtcgatattcctactcaatttgaaatatcacactccaaaatgtgaacaaggtggtcaggcacatatagttaccgaatttctcattccagtgatgtaaacttatagatgaaggtcacttaaaacatgtccatactcctgaatttcgtattggattattggccttgctataagttaacaatgctaacctacctgcttgggtaaaagggttaacgtctcacactaacagatacattatttaagaaactgcatgttccatactggagtatgattgataggaagaaacctcagaaccaacatctgattgtgtaactcagtatacatttagtgcatcaataacaatgttctaaaacaaggtctacaaggccgcacaaaggaatggatcttaaccttgtactgcttaagccacacaataggccagctatgccatgtaaggcaggcgacaacacataacccttgacatcttttagaatcttgataaaaaatgatcaaaggaattgaatttcctagtactacctgttctgcagtctacaggtcgtatggctcaactcaacagaaaagggaatcaaggcaaaatgtccagggtctccaaaaatcaaattttgtggtgactgcaaaattgacagccataacttattgatctattatctctttatccatttagactagtcaggggtaaactcatcatagacatcaagaaaatttaagtttcaaaatctctacatattaaaatactacacattttgtctcacttgtaatcagcgattatttcttacctcctcaccatttctgtactagagttaagactgtaaactatgctgcgtctttgattaggctggcaatccgtttctatccaaatcatctttcgccgattccaacttgtcttgattccaaatcatcatggttaaggtgtcaaaaaaaatcatcatggttaaacctctccggctcctctactctgctctgctctacttaagctagcccggccgggcggacgatcgccggctggaggagaggccgcagccatgtctaccgtcgaccactacatgtggagtagaaccgtcgcctggagtatatttgttttcagttcccaagtcatgcggataccagcaaggaactcctgcaaatgcagaagggagttcagacttaaaggtttcaggaaaccaaattacaacgacaaatggacaacactgattgttaattcagggttaatgaattgataaaaaggatgaacaagactaattgttgatgctccaaaaatgtgaatgaggtggtcaggcaaatgtcaggaaagtataggttcagtcaattagctgcattacgtctcaagctcaaactcagtcagttaagactgtataaaactcacctgttttcaagaactcggctcgttcgtcatcaacctccctcccctccaagaatttcttcgccgattccatctcttcaacctccaacttcctgcgaatcattcacagcgtacagaattcacaaaccgcatgaaccagagcgcgaaatcaatcgacctcaactcgacgatgacgctgaggtggatgcgcgggccatgccatgctcgagtgacccgacgcggcggaagatcgtgcggatcgtcggtcgccggcaatccgttcctatccaaatcatgtttcgtcctccgattccaacttgcctgtgattgctgagatcgatttgcatgtcgtctccgactccgactcctctactctgctctacttaagctaagcccagctgggcggacgacgatcgccggcgggaggagaagcctcagccatggctaccgtcgaccgctatatgtggaataaaaccgaacacctcactctgcgcccgccctgccatggcggggaccctctggatgcacaccagcctctaccatggatcctcctcgacgtccgcgcctacatcgccgaccgccggaacgccaccaccgccgcggccgatctcggcaatggccatcgaatcgagatcaccatcttcaccgccccaccgccgcaggtctcctacatctgcgcctggtgcccgaccggcgaccccgcccggatcttcgccaatgagcccctcgtaggctgcgtcaacgccgacctcgtcttcctccgcctctacagcgaggtagtctacgacctcgtctaccgcgccggtggccgcccttcgctcacgctcatccgggaccccgtcgacgtcgacgccgccagcttacagagggattacctgcgttcgctccacaacattgccctcctccgtcgtgctctctggatctggacctccatcgagtcacaccatctacggcagcttacaaactctgcctctacgagtccaccatccatggcgatggcaagtggagcctggagagcctccttctaccccagctgcgtcaaatgatcgtctataatacgagcagggtaattactctggatgatgatggacagggagtagtggccttcattgatctcaagcggggaatccacatctgcaacgtgctcgcccatggctgtcctggaagttacctgccactgccgccagagctcaccagctctcgaatgagcttctttgccgggacattgccatcgttaatggtcttctcaccattgtcggactgcgtactttctttgattcagacactgattgctggtcctgggatctgtccacatggagcaaaccggtggctcatctggacaacagcaaggactggcaaaagggcttcatggtagattctagtgacatcacggtcgacgccacttgttgcaacgtcgagctcctgcctaagctggagggtcgcccggccatggcaaagctgcaggtagctcttcctacgctcagcttgacggatgctaatgttgtgtacgtcatgggcaaggttgacgcctctgacgagaaggcggtggtgttgatggttgacatggccaacaaaaggcttcaaatggtgtctgtgtatgatgctgagaggatcatcaacgactttgattactcctacacgcagtctaccatctcccaatatttcactacagctgcaggtgattacttaattcttgcgctgttctttctacttattgctttttttttcggtaactttgtgttgcatacgacagtaaacctgattcaaagttgtgattgctgatgtattttaaacctgtgtggctgctgctatagtgctagttggacttgttagtttaggctggaattattttgaacctcgctagactctttacctctctaattatggaagcctttggtgagattctagacaagttatagagtacagttccagacaagatgtagagagcacatgacatgcaagctatgtggaacacaaacccagtcaaatgcaactgcattttggattctagattgccttcatatgaaaattttcttgtcagtgcacgctatatcaagaacatacacataaacaaagtgagcctttaaaagaaattgtcagaaatgaaaacagaaacaatttttctgcccccaacaaagtggagagagagaagaccattttaggtgctcttgcattttttaaacattcttgaactaaattggttgatgctctcgtaggttttctttttgtcatactctcatagggcttgggatgaagggttaggtacatttgtgtgtaggctatatgcactaattcatgggccctttgttttgctgttttactgggtgcaggtgtaaagggaaacctgaagagacctttgaaatttcatatgcaatatcctcacaagcggctgggtgaaacaatcagcaggagcgataatcctattgacttgcatgagccattgcaactggatactggatctggtatgggaactaaagacgaaactgaagacagcgttattcctatggacttggaatagccatgcatgcactaaacgggcataaattaattagagctgttatgaatcatgcccgggcataaattattataaattaagttgagctgttgaaaataatgcccgggcataaattaattagagctagctgttgaaaagcatgcccgttatgtattttggttattgtgcatgactgcatgtctacattttagatttgccttgaatggatatgttcatgctcttgttggactctgtttgatcgttcagagagttgtctttggagcctggtgttaacatattgatttaatttataattctgtttcagaaatatttttttcctactctacaattcagaaatagcaggggaagcccgctgctccattttcatgaaaccagataatagagtttgttgcggagagtggtcgttcgccacgacttgacctcctccgccaacgaaatgtattcgccaatacgcatactccctcctattctatattaattgacgttttggacatagttgagatcaaatttttataactttgaccattaataactttaaaaatatttagtttaaaacaactaaaacaacatatatagatttgttttttaaagcactataataaaagtaaacatacatttatttattgtatatattataatagaaaaataaggtcagagatatattttgtaaaccatgtcattgtccaaaacgtcaattaaaatagaatcggagggagtagttcatatgctacagatcgatctgagacgtccaccgcctgatctgatcaggaaagcagattgctcgagtggccttaccagacatcaggctatcgtcaggcacaagcaaatcaccaccggcgataatacaaccaatagcaattcaaaacaagcacagtaggagatctacttatattgtttaaaataaaaatgaataggcgagcaattgccatacaaccaaccgcataagaattgtctgtattccacagcaaatggtagtgctccatagcaccaatataatcagacgagcgtgcctagtgatcttctcaaatgtgactagaattgaaccacagaatatgctgaaaacccagctcattgctagagtcatacagcacgaacaatgggattgaaccactgaggtggataatttacatggtgtgtaggacagcagctcttatcatcacttcccagacgctatttgttttcagttcccatagtttgaactttgaaataagtccagagtcatgcggataccagcaaggaactcctgcaaatgcaaaatggagttcagacttcaaaggtttcaggaaaccaaattacaatgacaaatggacaacactgattgttaattcaggggtaattaattgataaaaaggatgaacaagactaattgttgatgctcctacttgatttgaaataggacactccaaaatgtaaatgaggtgatcaggcacatatagttaccaaatctcattccagtaatgtaaactgcttactgatgaaggtcacttaaatatgtccatgctcttggacgtcatattggattgttggccttgctataaattaacgatgctaacctaccggcttgggtgaaagagttaatatcgtttcacactctgacagatacattatttaagagactgcatattcatccaccaaaactagaaagaaactgcatgttgcatactagagtatgattgaatattgataggaagaaatctcagaaccaacatatgattgtaacttagtatctttagtacatcaataccaatgttaacataaggtctacaaggtcgcacacaaggaaagggatcctagttcctaaccttgtactgcttgagccacaatatgccagctatgcccacattatgccagctatgccagtgatgtaaactgcttattgacgaaggtcacttaaatatgtccatgctcgccttactagaaactattgggaacttatatatgaaggtcacttatagattattagccttgccagaaattaccaatggtaacctactggcctgtgtagaagggttactctgacagatacactacctaagaaactgcatgttcatccaccaaaaaccagaaagaaactgcctgttccatactctgtatgattgataggaagaaacttcagaaccaacatctggctgtaactcagtaccctcagtgcatcaataacaatgttctaaaacaagatttacagggccgcacaaggaacgggatcctaaccttgtactgcttaagccacacaataggccagctatgccatgtaaggctgtaagcactgcaatgcaggtgacaacacaatagcccttgccaccttttagaatcttgataattgaatgtcctgcctactctagtaccacttgttctacagtctacaggtcgtatgactcaactaacagaaaaggaagccaagacaaaatgttcagggtctccaaattttctggtgactgcaaaattgacagccataactttattgatctataatctctttctccatttagactagttggattaaactcatcatagacatcaataaaattaaagtttcaaaatccctacctatgaaattactgtatttttccttactagtgatcagcaactatttcttacctcctcaccatttctttactacaacaagcattgcggaggaaaacaggttcagtcattaactgtagtagggttttagctcgagctcggtcactcaaagagttaagaactagtatctgtgattttgtctgtgtgcttcttctcgaaagcgtggagccaagccaagccaagccaaccaagggattggattccctgcccatcccttccaagttattaactgtaaaactatgctgtgtctttaatctcatagttctaaatgtatctacgacgaattaacaatctcacctgatttatctgcttctcctgtgcctacttctcgacgaatgattcgacagtcttcaaccaccggagaagctccatcttttccttgttcgccatgtagtcgtgcaagaactcggcaagctcgtcatccacctccctctcctgcaagaatttcctcaccgactccctctccctagcctccagcttgctgcgaatcattcacagaagaggaacatcatcacagaccacataaaccagagagcaaaatcacaaaagcttccgtacacgaagtcgcggcctccgctgctggtgctggagccatcggcgtcccggagagtgaggacgtggcggacgacgagttcgtcgtgccaggcggagcagatgaagccgaggacgcggtccgcccgggagacctcgacgatgaggctgaggtggaggcgcgggccgcgctcgagcgactcgacgcggcggaagaggggcgcgtctgggggcggggcggcggcgccgtcgaacatggtggcgtcgaccttgacctcctcgtcctgggcgccgcgggtggcgcggaggcgcacccactgctcccccgggcggtcctccaccccgaacgatttgaaggccttcggcggctgcaacgcattcgtttctcggcgaatcagagaagacacacacacacagagagagagagagagagagagagctaagatgggggataggcacgttaggatgagaggataccgggtagggagggcggcgttcggagatgtagttgatctcggagcgcaggaggcggaggaggcggtcgtccatcggggagcgcagcggcgcgacgacggtggagaaggatggtttcgccggggaggaggccgcggcggcgagggagagagcccggcggactagggcgcgcgccatgtgttcgagcttttgcctctgcgaagcgtctgcctagaggcgagggttggttgaaggaaggatacgacgacgcggcggcggcggcgacctgacctgggctgcctaacattgcggcccgattctcctttgtggaatagaataagttcactagaggtcccttgatttgtcccagggtctgacagtcatctctgaaccgaaattctccactagctcatcctcaacttaccacatcatgttgagggaattttaagttcctgaggtatctaaatttttcataactcctctgaaaattgcgaaacgtatttattaaacctaattaattcgccattagcacatataggttactatagcacttatggctaatcacatgtgggttattatagtacttatgactaattatagactaattaagttcaaaagattcgtctcgcgatttatgtaaactgtgcaattagtttttttaatctatatttaatgctccatgcatatgtccaaagattcgaagtgacgtttttttggcaaatttatttgaaaactaaacaaggccttaggcttaacactatgaacaacggcgtgctattaggaaaacttccggattcggacctattttcgaaaatggaatctgtcggtcggaattttttcgaaaacggaaacgaattcggaaatattttcttggaaactgaatcggaaatgataagggcagtttccgtcggaactcggaatcggtccgaaactttccgaaaattttctcagaagtactagaaattttgtgactaaaataccctggattctttttttaagcactaaatagtgaataccatggtgtttggctgttatttttataaaaaatatgtgttatgcaaatctaaaattacataagaatattttttgtcctacattggaatttatcaacaacattactctttcaattggatttatcactttgatgggttttttatttcgataaattttcgttaccgtattcgcgccggttcattttcgctccgttttcggtttcgataatattcgattccgttttcgtatccggggtttccgatttcgactctgaaaaaaaatatgaaaacgaaaacgataaagatggtttccgtccgtttccgtaccgttttcactcctacgtgctatgccgcatatgggaggcagtctggtcaccttgcgcccaacagcccgccagctgttcgacgcaatgccccaaccccaacctcttcacctgcaacgtccatctctcgctactcatccctctccgtgtccttgctggacgatgatcgaatatttggcgcagaagcagaacgcactggatgttttcaggagaatgagagcacagcagcattggtcaatacaagaacatactcagttcacatatttttcatgttccaggagaagaacaataagagtacatcaatttgtggatgctttcttggtagaggagtggccaaccatgtaggagccgaacccccatacggtgatgagcagagacaggatcttgaagccgctcatggggtcatggaaccagatcaccgccgcgatgctcgtcaccggcaccctcacggcgttgagcacgccggcgaggacggtcgacgccaggaacagcacgccggtgccccccagcaccccgagctggaacgtcaccgccgaccacaccatcaccatcgcgtacgacgcctcgccgtgcctgaacgccgccgcctcccgccgcatcgccgggaagccgccgccgctcacggcgagcccgacggtggtgaacgcgaaggcgcagagcgacaccatcgcctgctgctccagcacgacgtggaacgacctccggccgaggacccggacgaacaccagctccgacagcgcgaagatgaggccgtggagcgccgacccgagcacgtcccagacgagccccagcgcgtactgcctgcccgtgatcccggggtacctgtccgacccggagtccagcgcgatgatcaccacgccggcggttatgacgacgacggcgttcagcgacgacagccgcagcctgttcttcgcgatggcgcagccgaacagcgccgagaacgctagcgacgacgcggcgacgagcgacgccgtggacgccgggaggtaggcgtaggcccaggcgtacatgaggttgtcggcggcgctcaggaggccgagcagcgcgtaccaggcgcacagcttcggcgacagcggcgtcggcgccgccttgccggcgaggtagcacggcagcaggaggagcgccggcagcggccagccggcgacggcggaccacgacaggatccacttgctctgcccgccgttgttgtagtacagccgcgacaggaggctcgacgccgggaacgctgtgagcatcgcgccggcgctgaggacgagcagcagccagaaggacatgggcttgctccggtacgtctccatggaggaggcaaccatcgctgctgccttctgacgcagagagcgatctgctgcctctgatgaggtctcctccattgctgcaacttctactgctgttcatgacagggacaaatattcagaagatttcatcattatctgaataaaattcagaagatttcggattctgtctacagctccagcttggtgaagaggagtattttctgaacaataacgttgtgttaacatttgaaaacatggttagattggtagtaactccagaaataaaacagagtgaatggttgagtgcctagagatttctgcaatactagtatgatccaacaaaataaatttcattattgctaaataacaatgatgttgtttggatcccacaaatccaaaattattttaaaaaaacaaaatataatattacaattgtaccatacttattaatgttttcccaccatatttattaattcttcatgacaattgtaccatgcataataacattattgtataaccaaacaaaccttcttttgtgtttgtttccaggtctgcaaaacttttgaatttttttttggaaataatacgattttaatgaaaaatcgtaaaaaatatatgtcgattaggtgaaatcgagcaccctatcgaacaaccgtagttcgataggacacctatcagttcgacaggtaataaaataatttaaaaaaagagaaaaaaacattgtagcatcactgtagcatcatccctgtcgaacactgcctgttcgatatgtcctcctatcgttctttgcttgcttgatatgtctctgcgtactttttaaatttttttttcttgaccaactaccttgttaaattgccacagttcgacaaatacccgtcgatatgcagatgttcgataggttctcctgtcgaatcgtggttgttcaacagggtactaaacttgcgatttcgcctaaccgacctatatttttgcaattttccattaaaatcgtattatgtaaaaaaaaatccaaaactttcggcatgcaggagacaaataagaaaaaaaaatacgcgaaaatctgctacaggaaaaacacgcacacaattgtcatggccccgcaacaacctcaacaattctcatggcacatcagagtctccaaaatcaagaaacaaaaatagaagagttgaattaggactgcgacatcaactttgcaaagggagtcagcttcaagtgaaaaaaaagaagccttttttttgaagggttgttaatttttacagtagctaccaagctcaagaagcagtaatactctactcccaaataactcagaaaatccttcccaattgaaggtacacacaaaacgtagtgccatggccttcttttgtcctaaaactacgcagatgagcacgaattattcacaccgacgatgagaattggtagaatcaagggaggaagctcactaggttttgctcggcaattaggaaaaaaaacagagaagaaaagaagaaggacagacctgacgctgggacctggacgacatgatgatggcgtccctcaccgtcgccgtcgccgtcgcggtgctggttcctctccatctgccgccgccgccgtcggtcgcggagtcgcggacagctagggaggaagctacactctccgggtctcccagagaagacgacgatatgattattgatgacttgctggaacagccaagccaacagacagcctcctggtgatacgtctacgaaaaccaacctgaactctggtctggttcgtgcacgtcgctcgctcgctcggacgaattttgtttatctataaataatctggtggtcgtagtggcacaaatttttcatcaaagtacggaagtatatttaattatggaaggagaattagtactttattacccccgtttccactgaagtgttgaccgatacggcgcgtttcagcgtgaagaaagggagcgcttttttttgggcgtgtgtggtgtccgggttgggaagctgcccactccacaaagaacacgcgaaacaactgaaaaaaatgttacatctctgaatctcacaaaaagcgatttaaaaccaagtagtactagttaactaattaaggtcataccacctacaactttaattatcatcatcttatataaggaatatcacgttctttgtgtgacgcctggtaaacaaaataatataatataattacaagctgcaactcacaaaggcttcattgcttctggaggtgcgttgttttcgtttcattgagctggttaatgatcaggagttggcaggtgacgaagctttggaaaaactggagtaaacagtcatattatttgggaaatcaaacattaattaaaaacagtcaggcaacaagcccactatataaaatcatatcagaaacaggatggacaaaacagcaacaacaaaattaggatttcccaacaaatatggagagaatgaagtatttgacagatgtactgtatctagagagcacaggacacagacagacaaccataatagtgtaaaatcgctttgcctcttctcaaaatgaatagtatccgacttcagagtggatatgatacatggtttctagcattctcttcaatacacagctcagctaatgatgctgcgaatgtgcaaataaacacctcaactagcatccctctcttatctctaaactgactgaaaaagaatcacttgggtaatgtaataaattgtgcctgtctatttgtcaaaaatgtacactatacaatgtaaataggaaatttaagacagtttggagatcttgtgttgcctggcatcatcctgccatataaatactagattcttgtgaagcagcaaattatcacgacctgtggatctcacccatatatgtgaaaataggaattggtgtatttgtatctgactctgggggataaatatatgttgatatatgtcatctagcaagaggttcaagctggacctccatcacaccagaaggacttgattctgaattcctgtctgtactgtcaggatgcaaaagatcaactgaatcgtcttcctcggtgttacctaacacccagtgccctctagagcttgtgtcgccgctcctccgtttgacctctttatactccaagtaaagtgttataactatagcagaaagcacccacagcatcaaggcccaagtgagctcctctacattctcgctatcatacctatggcctaaatgcttcattccagtgaaaagtgccacaattccgactatgattgccgacctgcctgtgataacatgaaggtattcccagaggacacgattccaggatgaagcctccccattagctggtctcttgggccggaagtaggcatttagtggctgaagacctgccaacagcagagccgtgacaccaaatttaacatgcactgagctgacataaaaacctctgagttcagctgcagcgaaaaggacaccaaggaacattatagcaattcctgagtattgcagatagacatgtatttggtaccacccgtcacctttcaagttcttcaaataccgggcagccagtattccaccaggaagcaagatgccccaggcaacaaacatcataaacccatgaacagccagaacaggacgcaagtcctgttctgcctcagcagaacctctcaacaaaagcacacgtatggggcgactgcttgtgatagaatgcatgttactatctgtaagactgttacctgaccagcttgcacccatagcccaaacgaccttaaggggcgtggttggatcaataatgttcttacactctacccttccactacaggaaggcctaagaggacgagtaaactcaaatgtaataatgccattttctgacctacacctgacgtaggttaagttctcagatgttgggtggatgcccgctgcactctttccatcaatccagtaactcttgactcgcccaactccatcattgccaacccagccaacataagcataactgttcagcatgccactcccgaacccaacagcaaggtacccacttttcttctcacctcgagctgctatagatatagaatcatgggacagagtccagaacagagtaacctgctgatcatccaaaaggacgctgctattatacatgtcactaaggcctccatcaacaacttgaactttccaacccatcttcggttcatacaatgactggtagtagactagatcaggtgtattccgatcaggcagccaaagcagctctgtaggagttgctggtacaccatgagcatcccggctgccagcatatatgacctctgttttattccgcagtgtagcattccccccaattggatccgacgtgatgtaaagtgcaacatcatgcccagcctgcactgagaacttcactggcacacctctctcaaccttcagcagaggagcctccttcttgttgatgtaaatcaccttgtcagggtttggtgggtttgggtagcggacggctggagcagatgtcaccaccaggggtgtctttgcatccgcgatgatcctctcctgatcctccttgttgtcagcatccaatggtccgttgcagctgtccaccgtttccgacaaattcacccttgcaaacccataggttgtgtccctcggccccccatggttctgcgggaggtagtgtggcctcagagtatccggcggccgcagcttcccaatggcccagacaaccgccatctcctccgtggcactcaccagcacatcatacttggtatccccagtgtcaagcttcctctgatacctcacgaaagacactccatcccgccggtgaccgtacaccagcaatgaatcattcttcccctcatcataaaccttgtcagggcacacaccagataccggcgattcatcggtccccagcgtgcactcgctgtagtcggttatgtagtagtcctcggcgaatggcataccttcctcggtgaatccggcgacggcaacatcggaatggatcatggcgggagaattggccttgggatcagcccacccgaacgccatgtagtactcggagcccacggcggcctcgaggccgatctcgactgtgccggcggaggcattgagcgtccaacggagacggtacttgttctcggcgagagggaggcagttgtcgaacatggtgggaacaggctccggcgacggcgagggcgaggcgacgccggaatcatcggtggcgttggaggcggaggcggaggcggagacggggaggaagacgtggccgaggtcggaggaagtgtcggggtcgaagagcgcgaggaggggcgggagcggggcggagaaggggagcaggagggtggcgttgcggaaggtggagttgagcgggtggggcgagaaggcgcggcccgcggcgaggtcggcgagggagtccccccgcgccgcccagaagcgcgcggagggggaggccgcgaggaggtcgaagcgggtgaggcgcagcgcgcaggagtcgtcgtcggcgaggcggaccgtgccgcggagctggtgctgcagcatggtgaagtccgcggcgaagggcgcggtgtggttggcgtgcgggcacacggcggccgacgacgacgccaccagggccccgatcgcgaccgcgagtacggcgaggcggagggcggcggcggccatggccgcggccgcgggggagggatcgagatctggagaggaggcggcaacgcgtggagtggagggatctggaagcggagggggttgggttggttggatgagttgagttgagttgggctcgctcgcttgctcgcggctgcggctgcggcggagtggggcgaggcgaggcgagcgggcggggtggaggtggggtggccgagatccactttgggtggtggactgatggaggccgtgcgccgcgtgggaatgtgcgatgcttcgtagggaaggtcggaaggaggcagtcgcaaaccacttgaactgttaagagaagaagaccattttatgttctctcgagaaactttgaccattttatgtcctatcaacaaaagtttggtctatctcaaaaaaaaaacaaagttttggtcaatttatttgtttgtttgtttattgttgaaactgaatatcgatatcactttttacagaatgtagaaaaacaaaaaaaaaacgaaagtgataaattcagtgagcacaaaaatcgacagtagattaccttgagctagtatgtgtaaaaaccaggaagattttaatttctatatcatcttcagtcggttattgattttgactctgaggctgccactcaatttctcttatccaagttttagaagatgactattgtaaagcaaatggggtagtattaattggaagcattagctaccgtggtacacatagtatggtaactccgaaagtattggttttgttcaacatagcaatagacgtagatcattcttttgcgagagatgttctgtggctttgcacatgtcatcgtgctatgttttgtgacactagaatgtgcgatgttagaccctggtttaaactagtgctcctatatgatattgcctgtgggatgattatttgaagggcaatgcatgtgcgatgatttgatggttaatttgtaaaccttatttgtagaatagaaacggattaatccactgaataaattctagtgctcctcttgagaaaatttgaactcatgtgtatgaaataaaaatatccctaaaacaatgtaatgtgtctcaatcatggtatcatgaacccatcattcaaattttcactcgagatcgcgatatatgaatggagggggaaaaacctggtaggctcatttggcagctcgggttaccggcccattccccggatgaaaggcccacgggctaaattacacgcgcgtttggaagcccacaacagtcgcgtccacgcctgcgtcacgccgcagccgccgcgagatgccgccgccggccgggccgccggagtaactccggtaaactcaatcgattgctttggagcaaaacttgggactgactacgtgaaagattgtctgctcaattgaaaaccggtaaactctcacccggatctccatgaattggattttattttttcaggaagtaggaacttctgtttttagattggcaaattatgtttgttcacatttattagtttttatattaatattatattttcaagatgataatgaacagattccatgtagacaagttatattgctcctttttttttttgactacagacatcctatgcttggttagagtaaatcctctgatagccctgttttgggctgggacttaatatgtgaaaattttgccaaagctacatgttacatgtatatttctgtaggccattaaaaccaactggtttgagtcagagtttcatatactggaagcaatactggatttacttgataaccaatcactggaaacaatactaaaatgcatgaatatagaaggaaaatcctaaatttgcttaatattttttttctaaaactaatatctggtaactatccaggaattgaattgaatctgtgctgtggaaaactatagtcactgcaatcacatcaatactattataaatagtgtaattgctaggttatcatggcaagtttatttggttgttttacatcaatgaaaaagcagtgcaagtttttaggtcttctctttgtgacaatatatcagtaacatcagaaattgagacattaatcaggtgaacttgttttattttttttttgcagtcaccactaaaatgtaatatcagtgccgcatagaagtgatcatgcatataataagaaattgaagaagagagctatggaacaagtagatcttgtcaactagaatcgctaggtggtggttctttttaattgtttccccttgatagctaacctgtcaatgttgaagtaacattttgtatgatcgttcgtatatgtaggcctatagccagctccaatacctttttttttgcactatatgtggtgcatttcagcttcatgccctgaccattaacatgatctggttgtatgcccctcctgattgaagctagtgctataccaatcaactcccaaggattaattcctattgccactcgttggttccagtccttgcttgttatggtgcatagagcaaggtaatcagtctcataccatctgcttggtatagaactgatcatcatgcggagttcgttcttcgattcaccacttgcgctgagtaacatggactctgaaaatcatgtcaccaaattgggttattttcaggcatgaaatctgtcgtcaatagatattagaaggctgcatgtatgtattgtttgcagtaatcctgttagaacagaaattcttgatcatgtactttagtccgcatgttacatgtgcagtatagaaaactattttttttcttctttcagctagtacaataatggaactgtctgagttgaacattcaaacaattgaagttgatggctaaaatgttgtatcagaaatgtgagatgttgagaggacttacaggcttgcattgcatatttaccaatgataaatgataactcaaatatttattcatattcttatactgcctttctttccaactgaacatttagaacccaaacatgtacatgatgtacattttgcgtgaaggttaacaagcagccatatatatagctccaactgcgaggatataacaaaatcttttcacccaaagaagttaacactgcatttattttttacatgtatatttatttataacatgtaaaaactaggtcctagagacacttgtaacttgttgcacatgtatgttcatttacatgtgaatgagtttattcagcgccgtgttttctaccgaattttgtctgaatttggcatttgtacaccgtgacaagctttatagtgggacaaaggtcgctagctggcaagggcaggattcgatggattttttgttctccaatcgatgaaagattttaaaggcattctttgcttgtccaggagataaagatagaattatgccgtgttcactacattgctgatttcaacccaacaaaacttgataatttggtgttatcaaaatttaatagtttaacaaactacacaagccttaccgttatcaacctatcataattttgtaacttcgaaagttttcgctcacagaaattctgagaatgattgacgtcggtcgcccggcgcgggggagccggatcgggcgctcccccctcgcacccctccccccacgtgtgggcccgcccacttctttctcatttttccacaaaagatgtttcattcagtgtatttataatgtttcactatttatagatctaatgttgcagtgaattaaaatactttttttaaaaaaagaaacccacatattttggaaattctccattaaaggaatttggtttattttttgttccaccaaaaatgtttcacccagtgtattaacaatgtttcactatgtatagatctaatgttgcagtgaacaaaacattccattgcaacaaaaaaaacctacatattttggaaaccccctattaagggaatttagtttatttttttttccaccgaaaaatgttgcacctagtgtactcataatgtttcacttatgtatagatctaatgttacagtgaactgaaacattctttcgctatttactgaaacattatttttatatagggtgaaataacacccgatttaaatgagtgaaacattttcgatctacttagtgaaacaattctgatatatttgttggaacatcatgcaacatttaaaaataattcaataataagctaaaaaaattcatcggaatatattcatgtgtggtcttattttgaagatttaattgcaacgaatttaatggtgcaatcggatcatgatttggataagtaatttaagagaaatcagtttaaagtagtttttgcacgtaaatcgggcgctgatgtcagcgcccgatttttctcaaattcgatcgggcaaccgatcggtaggagtgccccaaaaattccaccgaaatttaaggctacgttcgttccccagggtttccaactccccaccctcattttcgtgcgtacgcttttcaaactactaaacggtgtgtttttttgcaaaaagtttctatacaaaagttgtttaaaaaatcatattaatctattctttaaaaaatagctaatatttaattaatcacacgttaatgcgaacatcgttttacgtgccggatagcgaacagagccttagctctaaaccaacttatccaatgctaccaaaatttagtatcatatcaaaatttgatattgccgaatttcggtgtggttgatttttcaataaaatagaaaagtccttaatttagacccagaagcttcacacaatctaccgtttgaatatttgcatttaccaaagttttcaaaaaaagaaaatttgaatttaccagcatcggctgcctcgccgggtcaaacgacgccgcccgcatgtgcagagccacgtggtcaaacgacgaagccgacactgtaaacataattacacgaaacttgaaggtccaaaacgcaaaaaaaataaacttctatccgataaaaaccccgggaaagatccacccgacgccccaagctttcttcctcctccgcgcgcgggtcgtcgccgtcgccgccgcccccgccgcatcgccgccgccgcgctcagatccagacccctgagacatggtctctcgccgagcgatgcgagcgccggagatgctccggtggctcgccgcggcggcggcgctcgtggctctgctcgccgccgcgccggccgccgggttctacctgcccggcgtcgcccccaccgacttcgggaaggttcgaatcgctgctctgatcccatccccctcttcgtcgagctaggaattgctgcgcgcgtgctcgggtttggatctgggtcgttggtcaacggggtgggggttcggttccatggctgggatgggatgggatctcgtagatctggctttgggtgttaggtactcctgattcgattattggtggtgggatatatatctgagcttgggattcacacggttgcaccaacaattcgcttgttccaaatacttccatttggtccatttggagtgtgtaggttgcatgcatcatcaaactcttgtagtaatggtggatttaagccaaaaatagctagtttggttgattttgtataaactttgacatcagattttggttgttctgagtagtaacattaaactacctctcgttaaacgtgtgtgtttccaacaagtattgtattggaataggtgattctgagaaaatccattggtttgaaccaaagttaagctcaataaacggatgtgcactggccatccgagccaagcagaagttccgtctcggaaaaaactcaactcacagtaattgcataccacaagatcatcttctgaagggttactcattaaaaatccattgccattacactaaaagaaggccatcgcttaaatgatctgaactgtaattctttgcttgccttcttttcctctggtgtatctaggtccagtggttattccagcttatctgattttgcctatggaattagatgatcacaaagttaacatagaacaatgcatgggcactggtttctgaaattgggttggtgagtcacccaataatgcattggttcactgcttcatcgatcataattataactattgttctgcttagttcttttccaaagaagattcatttgttagatcagactggtttggctcatcttcctgtttctttgcacttgtagtttcatgtgtacacatgccatgccgcatcttgatatgttaagtccaaataaatgttacctttaacaaggaatagtttagggcatcataacattttatttgtggccaggatttcccttataattgcctttcctgtttatctacagggtgattcacttcccgtgaaggtgaataagctgacatcagtaaaaactcaactaccctatgcatattactcccttcctttctgcaagccagaaactatcgttgacagtgctgaaaatctcggtgaggttcttcgtggtgatcgcattgagaactctccatatgtggttagtaccgggtaactcatattttgaagtttatgtccttgaagtaatatgccttaatctctgtttgccatcattctttttgtttgagctacagtttcaaatgagagagcccaagatgtgccagattgtctgcaaattaactgttggtgagaaagaagcaaaggagctcaaggaaaagatagaggatgaatatcgtgtgaacatgtaagggatatataggtaatgttgcacttcaagtcacagtatcttccaaagtgacatgatttgttttgcaggattcttgacaatctcccgctagttgtttctgtgttaaggcaagataagaacattgcttaccaaggtggctatcatgttggtgtcaagggccagtacaccggagtaagttgtgcactcaattgatgcttgcttgaccttctatttattcatatatgctctggattaacaaactgtgatatataaatgtattcacagagcaaggaagagaagtacttcattcacaaccatttgtcatttttagtgaagtaccacaaggacgatgattcagaactttctagaatagtgggatttgaggtcaagccatacaggttttctttctactttgtgctttgatgttttacttgcatatgctctatataaatgagcctaatgcatgtgttatttatatactgttatggcagcattaagcatcagcttgatgataaatgggatggcgtgaacactcgcctgagcacatgtgaccctcatgctaacaagcttgtaacaagttctgactctcctcaggaggtcgaagctggcaaagaaatcatattcacctatgatgttcactttgaggtactagttttgcatgttttgtttggattctgtttcccccttcatgtgatagttgcctattctcttaatgttaaatttattgcaatgatttccattgaatctttttccctcattgcaggagagtgacatcaagtgggcttcccgttgggacacctatctgttgatgactgatgatcagattcactggttttctattgtcaactctctcatgatcgtgcttttcctgtctggtatggtcgcaatgataatgcttcgcactctatatagagatatctctagatacaaccaacttgaaactcaagaagaagcgcaagaggaaactggctggaagcttgttcatggagatgtgttccgccccccaaccaactctgatttactctgcgtttatgttggtactggtgtccaattcttcggcatgctgctggttacgatgatttttgcagttctgggtttcctttctccatcaaatcggggaggattgatgaccgcgatgcttcttgtctgggtcttgatggggttgcttgctggttatgcttcttcacgcctctacaagatgttcaagggttcagagtggaagagaataactatgcgcacagccttcttatttccagggattgcttttgttatcttcttcatattgaatgctcttatttggggggagaagtcatctggtgccgtccctttcaccactatgttcgccttggtcctcctttggtttggtatctcagtgcctcttgtgttcgttgggagctatcttggattcaaaaaacctgccctggaacctccagttaaaaccaacaagattccaaggcagatccccgagcaagcttggtacatgaatccaatcttcactattctaattggtggcattctaccatttggtgctgttttcattgagctattcttcatcctcacctctatctggcttcaccaattctactatatctttggcttcctcttcctcgtctttgttatcctcatcatcacctgtgccgagattacggtcgtgctctgctatttccaactgtgcagtgaggactacatgtggtggtggagatcttacctcacttcgggatcctcagcactttatctcttcttatatgctgctttctacttcttcacgaagctgcagattactaagctggtgtctggcatcttgtactttgggtacatgttgcttgcttcattagcgttctttgtgcttactggtactatcggtttctgcgcttgtttctggttcacgaggttgatttactcatctgtgaagattgattagttgcaacactacagagcacagcatatgtttttaagccttctgagtcatgggaattgtatgttcgaagtggggatcaatcccctgggtttttttaaagaaattttcagtgaagttacattttaggttttagtttatgaacaatttatgtttgttatggctaaacgatacatcttactgtagtaatttggagtacaagactacaaggatagaacacattgtgatggagttgttttttggtgaaatttttttaatggactggtataagaattcaattgattatgaactgcttgtactctaatcaatggtattattgactctggcaccagtatgaaatcaatatgatgtaccagtaacaatttaatcactgttatattattagaatgaaatgtcccttttgctttcaagtactatccaacctgggtgttggtggtgtgctctgggtgtgtgacatttctcccatttttaattttgcttgtggttggaactttggaggcatcggtatgaaattgctccgcattctgtggcatgatttctcagaccgtcgggagacatggaatcaatatcaacttgccatgatcaatgtctttttcagtcttgtcgtctgagttgccctgccatgtgggcgtccgcatgttttcacgttccacggcgtgtagacggcggcgacaagctggggccagggcggcgtgtttgccgccggcgtcgagggcggtggcgcgtgatgattcaaatttcgcccaatttgcactaatccatggtaccttgttcaggccaaaggctgaacaaaaaagggtccagatttctgacacgaacggcacataaatcaaatcaaatcgcccgtgcttctctctcccctcctcttacccttccattggctccctgggttgagctcggcggcggcgcaatggcgtgccacctgctgctcgtcgccgtcgtcgccggcttcgccgtgagcctcgccggtgcgacggaccatatcgtcggcgctaaccacggctggaacccaaacatcgactactccctctggtccggcaaccagaccttctacgtcggcgacctcatctgtaagcctcctctctccatctcctcctttctttcgctccagcagcaatgatttccgacgacgagatgcttgtgcttgtgccggcgttgcagcgttcaggtaccagaaggggacgcacaacgtgttcgaggtgaaccagacggggtacgacaactgcaccatggccggggtcgccggcaactggacctccggcaaggacttcatcccgctcaacgactcacgccgctactacttcatctgcggcaacggcttctgccaggccggcatgaaggtcgccatcaccgtccacccgctgaagcacaatgccaccggcgacggcgccaagaaccacggcggcgacggagccgcacaggaggccgccgctgccgccatgccgggcgccgccgtgtggatggcagtgctcgccgtggccgccgcagctgtcgccatattgccatgattaattaatctctgcacttgtgcttggaagaactcaagaacattggcacattgtgtgttttgctcgcatttttatcagggacttgattaatgtagcaccaaaatcagatttatattcaagtattaattcagcaagaatattggttcatgatagagcatcaggattcaggaaaaaatttccaggcggagaaagcagcgacaggatggagcattggaaaattcatgcatttcacacaacccagttcgattaagcaacatggcatgtattacaggttgtggtgcaagaaaaagatgctagttgaaagaaagaacaaaccctatagtgactgtagaatagaatcccttttcttatatacaccacttactatcctttttgtctatcaccggttggaactccatggttcggtctcggcctgctacttgtttggatcgcttgggccatcatcaagctcgctgttcacaaaggtaagggctcaaattctgaaaggggaactcaggcttttacaatgcgagatttcgtgatctggaatatggtttaggtgcgacggttaaaggaagctcactttggtcgcatctcttctgaagagacagattgatttgtgcttgaagtagcagctgacttgcttggcttcttgaacttgactatgatcactgtcatattatcacagccatcaccaccggatacaggtgccaagcaatggtcaagcaacttctcgcagacagcagataggctatcctcctgtagttgttttcccagtaaattaggaaaccataacataagcatattgcaaaacacaacactatgaactatatatttttagtgcataatgtaaattctgtgaatatcagttgcttacagtgttcatttctttgtgaacaaagtccaccacttcttgacttgacatgcaatccctgtcataagataaatttacgtctcagataaactatccagtgaaactacaaagaatacagaataatccatagaagagttgacaaaagatctagcaccatttcaaaataactgcaggtataaaaaatcagcttcacatctagtatacaaagttatctggatgtttatgtatctgggatccattataaaagaagttacatatcagcatctgcacgccacacagtgcactagtacacatcatctaaaaagaattgtgaattactatctccaagggctgtccaaatggtttaccaatagaagatgatgtcatttctttggacttaccctaattacaactattgtttctttttactaaaaaaatcaaatctgctaataaactaaaactgttgttggaaaattgagttgtcaaaaatcagcagcagctacaccagatggtaaaaatagctaaaattgtttatctcaataagatattcaagagagaatgattggtgcaaaggacataccatatgccatcacatgctaaaacgatgaactcatcatcctcagaaagtttaacctgagcaagccgaataaattccatgttacaaaaaatgttgtccaaagcaaatacagtgacagaaattgtcaacaaaacccactgtgtttaattcaggttcagcagtgacaatctgtctctcggctgggagaaattcattctgcttcaattccatatcccctggtggaaaagcacaaaaggataaataaaaattatgcgtgtagctaaggaattgtttttcgatgagaagagagggtgctacctattgcccttgccaagttcaaacttccattgacccgcccagcaacaatgaaaccaccagcattcagtatcctctccttttctgcatcaagatctggcttgtgatcttttgacaggtcataagcctatgcagaagactgagtcaggacacatattctaacattttcttcacaaataaaaccagagatatagaggtctgactgacgtactcgacccttccttgagagcacacaccgggaatcaccagcatttgcaacaatgagttcatcatttcttatgatagccacacaagcagtgcttccagatgttggcccaggaaaatgagaatgaggaccctggttaagtaacttagttagagcagtttagttgaactctacattcactagaatttcacaagaacagtttctttttaggaaacaaggtcatgtataaaaatatagaactctggagctgatgtttcgtaagttacatatatgctcagtgctaacgaatggtgcatattccctttgttttccttatttgtacaaacatattttgtaataatgtatttcaccaaatgaattttagatcacatgttatcatgcttaaaaataactggacatcaccttctaatataaactagtgttgacctaagtttcagatgcaacgatcataggcactcctgactcaagagcacttctcatattttcaagataactactagagagacatcccttaaggatttaaatgggtattttaagaaagacatccctctctgcagaaaccctaatcacataacaagcaggaccaagcccccttcaccaatccacatacttaagagcagcaccactcaagacaagcctctttaaatatgaattcagaattactagcatcgaatcagtttttagtattttatcccgtcaaatgcttgttctaccaaggaataactctgaagcatcatgacatcaaagatggcccctcaattccatcatccagcaaaaatggttggtaatgaaggaacttttagaatagcagttttacctcctcagtccaagtgtcctcaggtttatctgactctccaggtttcggggaccatattatgccttctaacatgccagtaaacttttgtcccttgtcccccaattcagccagttccctccaccccctttgccctttcatcatctcatccattctgaaagggtaaaaagcggtgcagactcattaaaaccaccaagcatacgatagtttcactgaaaagcacttcatgttcaaaagaggtacatgctacatacctgaaaaatgactttaagacagaagtagccaaatcaccagatgaataagcctcatttttcagtacttgcaagtgtagatgtttcgcacaaaacttagatactgccttccctggaattacaaaggacagtttgtcaagtcacaacataaagagttttgtccatgatgtggataaaaggacaacatagaagcgcattaagttttggtttcaaaaaaaatatatgaaaaagatgaatcaatttaaacctactcaatgcacttctaccttttacaacgatcaaaaagggaatgtgaaaatgttggactgtttgattgttatttccctgttaggttactggactaccaaactcaacacagctaagtttacctaatctgcatgaatggatgagatgatgaataaatgaatggatgagattatcatcaactcaacacagctcaggttacctaatatgtgtagtttgttaggtgaaagttggcgatgcttaattgaacttgctaaggttatgccatcgaaactacagaggcaccaatcatttgcaactagtaatggataaagttgtaagatgatattaattcaatcaccaaatggtaggcattaaatcgcactcgtctttgtttagatctgaagatgcaacataatagcgagttggacatgaacagaaaatcaatgaaaaaacttacctccatggccatcatagacaccaaaaaaggatgtgcattcgtccaggcgtggcagggcagtgtgctgcaatgtaaggatgcactcaataagcgtttaaagaacaggtacagccactaattcaatctaatttcacctgaaacggtccctaatgtcatgccaaatcaatgagaactcaatgtcgaacggcactcctagtgctaatcatcgtgatcaatttatctgccctagtatcggcactggactccaaatgcaagtgacaaggcgcaacaaaaggctaccgtgagtcttatcattggggcaacagaacaccaccattggcgaacgcaattggaatcaatccacgtagccagttccccggaacaacaacttttggcggctaaccaatcaagcaaatctacgagagacaatcctgacctaaaaaacagttgcgaattccgggtcctagggtggtggcgaatcaaccagaaagcagaagccaacaataatgtaatgtggaaggggaaacagagggagggaggaaggaaggaaggaactcaactcaccgcgtcctccatggtcgtccgccatccctgcatggatgcgaggccgtagcggaggcggtcgttcccgccctcgccggagtacttctccgtcttgggcgtgctcaggtacacccccatgtcgccgcccaaccgaatccccccaaacacccccctgcatccaaccagcaccgttattacaaacgcaaaccccaatcacaatcgcaaaaacagtggcgctcccccgatccccgcgggcgatcttcgccacggaaccaaacatcgcggaatcgaagcaggggatgaggagtgggaggaggagggtactcacgacgacgacgacgacgagggaggaggcggcggcgaggcgaggagaggcgaggtgaggaggaagcgaaggggaggggaggaggaggtgggcgagtatttgtagggggcggaagcgacgggaagaggagaggagagccggagaggaggagtcggaggcggaggcggaagggaaggagggagatgaggaggggtgggggattcggggaagattgcgtatctcctttttctattcaccgccaccctcccttctctctctcgctcgccgccctgttgcaatgccctctcctcctccggtagatcaccgatccaccgttttggtggttatcaacagatacatatactcctgcctcagaatttatctctagccttttctttcttttgaaatagagaatttatctctagtaaagaaataatttcttgttttgatttgtgcttctttgttaaaatatatctgcagttattacatcacgatcgtattatcatcgaataactcttgtgagaataatctaatgtttttaacatgagcatatagttgtaagaattaatctagtgattgaatagtttgctttatttacttttccttttcttatatcgaagtttacttttacggtatacctataaatgattattgttaattgcaattagatttgagccattactgagtatatatgatgaaataatagtattctcaaccacatccatagtagaggctttactacattcgaattagattgcagccgataattatagttaatattttggttttttattacaattcaaaggcacatataaaatgaattaaatataaaaaaataaagatggattttgaaaagtatctaagaaatttctatatataatgtttcttaaaaaatctatttagttgcttaggaaacgtgcacataataattcagaagctaagaatataggttaaatcgtggcacatttatcatggcaactactagtttcttttggcaacttcttaggtgtactagtttctcgtacaatactcacacgtttattttgttccataaaaacgaaacattatgtactttatgcagcttaattaatagcttaaaacatgaatgacattgatccaaaactaccttccatcatcaaattgcaatgctacaaatgtgagtatctaccttccattgtcaccttgtgcaaaaagctttatctattcacgtggcacggaaaattacttctcatattggatgaacggaaaagtattcattattaacctgtggatacacttctgaacgaaactctgttcatactcgcaaggatcaaacggagtttgacaggatatatagtgattatctcaccgtttgatttgtcaccatcaaactttcaagccccaggtggctaaacaccacacatcaagatagattttttcttttctactttctaactgatgtctcaaaagtattggcttcagtgtatgaacaaaaatttacagctgggatgtcaagctctctgaacatctgtcaccctttgtttgattgatttcttggaggataaaattagataagctaattgtagttgttaagcaaaagcgattagatggtcacacatgtcggcatgtcaaggctacacagcctttttaatggcggcaaaaaatgcaattatgcaaacatcacaatgctttgctatcccactgtacttaacctccataatatataattaaggagaccttaagacagccacacgtcagctaatctccaacagtattctactagtatacattattcttaaagggttaattaaagtcggtacgctactaatcatgccaggaggatactctgtacgtagtatgctcctgtagcttatcataatctcttcagattcagagttcgtttttctctttcagaacaagaagattacggatcaaactcacatagctaagaacttcattaattatgttcctgaatcttcaccagaatcacagtacaatccttcatatatgcacacatccagccagccaattagagtaaagagatctcgccatttttcaggaatatttttctcctgatcatctgtcgcttttccagccattttttcagagttgagactttcagtttcagggtagttttaggttgtttcgtgtgtgcttctgcaggcagagctgggatcctggcatgtgttgccgtgttggccactaactcctgggagcctatggattaattgagccgataacattataataataatcttaaattcttaatcttaatcacgcagctcacgttgggtttgatggtacaagacgaggatcattcccaatgcaaacctgtctgtcagatttgttgtccctggatctcgtaatcttgtaatatatccgcgatcaaagcttttttagtgttcacgaaaaaaaaaatgatctgtacgtgggcactttattggacttagaatttgacattgttatcgcagattgatttgcatttgaggttgctaaatacggtaaactgtgcgattagcatgctaattaagtagtcatatgatctagctggcatgggattagtacgggtagatgttaatgcgatgcttttggttagtttacagccaattggggctcctggtttgctaggctggtcccccaggggtgtacgatggaatcggggacaatgcattttaataaaattaattaaaagagggatatgatttgtgtttttctaaacaaagaggaaaagaacaaggagagaatccgtacacgataccggtgtcgcgtcgatgatactgcaggctcccgtgtccggttttgagggtgctgagctaatcaatcaatccattaaccattgtcagatatcgttttagttttgggttatgtcgagcatgtctattttaactattatttcttataaattcgtatattctaatatcacaaagtttttatttagcataagaattcgtaatttatataagtcttaaaataaacgatttttcaaaagttaatggtaaaaatagacatagacatgtttaatccatattctttcacaattgaaacacatattttatttgtttttgttaacaagttttttaaactactaaacgatatattttacgtgaaaaactttctatataaaagttttttcaaatatcatataaatttatttttaatcttgaaataatcaaaaatcaatgaatcatactctatccgttatatattataaatattataagttgtttgacctttttaagtaacatattatagaaatacatttaatattaaatttgataaaactaatttaatatcgctaaatttttctacaaacttgataaaagctaataaaatttaattaggaaaaaatcaaacgacttataatatgaaatgaaggaagtccgtgctaatgatttctcatttttatgtctctatacttaatctttcatcggactcgttcaacgtgacataagttagattaaagatagaatgataaatcaatttgaaacatttggaataagtaattaaccatcatacaaatcatgattaagccttactcataaactaaccaatgataagtaattaaggctaggcgacgtgtcggcccataccccgtccgtcctgtaataatctcctcggcgcgacgccacgccaccgaccaacgcgacaaggcgagacgacgcgcacgcgacacacagccagcggaagcagcagcaggacgacgaggaggaggaggagatagcttagatcccgctcgcctctgatccccccggatccgatccgagatcctccacccatggcgtccggccggtgctgcacgttcctcgagatcctgctcgccatcatcctcccgcccctcggcgtcttcctccgcttcggatgctgcagcgtacgccgccacgaatcccctttcttgccctccctatctctctccttgcctccccgacgatctcccgctcgctctgctactgttcgtggataggtggatcggggggattcgttgtctcgtgtgcatctggtcgttagaatttcaatttcggggggcgaattttttgcgatctggtaggtcgattttgctcgcatccagtaataataattcgaggatactgggagtggttgcgaatccccgagctccaaacgctgcgctgccagcgctgaatcttgggtggacaactctcgatgtagctctgcttcgtgcaatggctatcctatgcaattgggcttcctttggtttctctctctaaccatttttcatctggagttcatatgaaagtgctactgtcggtttgtgatttatgatttatgttaatccttgcagtgtaagtaccctagaatttctggtaattatgcaatccctatctactgataactgatccaagagagtaggctgaaattttgtcacaagtccatataatctgcctggtgttattttattttaaactggttcttcgatgtattatagcgcatatattgtcaacttagtcatccccaggccaatttttatgctcaagtggaagtgctgcacaaagagcatggggattatgtttgaattttgactagtgataatggcatagttttcttgactctgctacatctgcctgtgttgatatcaaaagttaaaccataggcatagtccgaatgaatcagcgatgaacaagcttttttttttttgtgctgataacactactgacagttctgcattctatcttttccgcccctcgtggtaacatactaatagtgttgatatttattatgtcttaaacagatggagttctgcatctgcttgcttctcaccatccttggctatgtccctggcatcatctacgcagtctatgtgcttgttgctcttgactcagaccagtaccagagggaatatcatacccttgcttaggcagtccacttcaattctgtcgaaacctatgctctatccagaacagccaagttctgctgttgaattggtatctggtaacttcgtctgggttttttgatatggcgttgtgaatcttgtgattataaagtagaaacagtggttcgtatcaaggaggacgaggaggcacctagtcatttggtcgttaaatctccctattcatctgttttgtgctaaatgtataattttatctggatctcttgactccttatttcagtctgttaaatgctcaaactgtggtctggtctccattctgtaattttgattcaagaaaataagttgttgagggtaaatattattggtgtttgtatgtcaataccgttgcaattcttgcctatttcgtcatggaaacaatgggggtgattattttgttacaacgacgtcagtaccaccttatatgccagtctatttatactttgccagtgaacttcaatgtttggtgggtttcataccttatgcataaggtattcaagtgcttcaccaatctttgaagaccactctggatttttgcatgatggaaatgttctctgagaattccatgtagaaatagatgactttatcatacttgatctgtagagtactaacatttatccaggccttgtaggaaaacagaaaacagtcttagaaccctcgccctttttcaaaatatgatatgcttgtcacatgctgtaatgtgcaggaaagtttgttttgttcagtactctagtcctctgacaataaattaatcagtgtccctcgtttgatggatcatatcttgctgctgattgtagtaatcacttttcatttgatggatcatatcttgctgctggttgtagtaatcacttgatcctgtcacttgtgtcctctgttatctgcgctttctgaacgacatcttcatactgatgtcgaatcatagatggatattataaaatacatgaagagaatgcttgtttctggtgctgaatgttcgtgcccatgtgatattcagtgattctgttagattgtgaacgcctgatgaatagattgtgtgtagctgctcatgaagtttctttaatgtttcatttctgattgcaacgattctgtctgccctgctgtgagagagatgcccctgaccttccctgtccacttgactatgctgatcaggttgtgtatgtgcattatattcaagggtacataaactgtcgcatccgattctctgtttcgttttcttaataatgcagtcatccttaattgggttggacgttcttaattgggttagacgtcatcgttgaccaatacatttgctgtattatataaagatacaactcgttgaagagatatgaggtggatcaaagtatgtgattttagttctgaattgatataaaatgtcacgttcttggggatgtctgaaactctgaattgttgttgtatgtcgatccatcggtgcggcatccagaggctggcatgcaggtcggtatatcaacgattgatctgcatatctttttcataaaattgcatgtctcagactcagcatgctactctaccatatggaggcatggagccttcgtttctggaactgaaacggcagaaaaactcattagtcgtcagaggtgagaagaattcacgggctgcaggttctgggagctatgaacagcgtacttatgaattttgacagcaatcacataggctgtgttaagatccaaagtttggatccaaacttcagtccttttccatcacatcaacctgtcatacacacacaacttttcagtcacatcatctccaatttcaaccaaaattcaaactttgcgctggactaaacacagccatagtctacgtcatgatcagctttgtttcaatccattctggttcaggtgccccctcctcttcatttctgacttctgctccaggtgcccagttatcgacaaaggggacaaatgatctactgaatcgcagcaaaaatctgtttttcaactagttttgttcatttaaatttcaagagctattactcagaaccatggtggataactcatattcatgccaaataatgccttacacacagtaccaataatttataatcctggtgcaagtctaaattgtgatatcactctgactactactcctacagtcattttaccaaccttctcttttgtcacaatccctgcatttttattgagtattggaagctgaaactagtagtaccagtgtactaaaaaacattcggacttatcagagctttacagcttttattcaaagtttatgccactcatgaatttgttccatgggcctgtgaagacgcaatgaatgtaaagtcagcaattaggcgtctgaaattacatgtctgctttgtctgacagtcacaattatacgctcattattttccaaaacactgtgcacacatcttccaactctcattcagtcattctgtttccatgaaggcgtccagtctcttgataatgtctccatgaaaggcttcctatgctgctatcatgagtgcctcgacaccatcagacatcagtgctgcctatctgatcatgtttcattactgactgtacactgaacatgcagtgtttcactggtaccagctggtattgtcaaattcttttttcttccctgaagaaacagtatcgtcaaattcttttgcatctccttaactgaagtccctctatccaaaaaaaaaaaaagcttcttggaatgaatccggacaagtgaagatggttttttttgacggagagagtacgttctcccgaacatgagcagcaacatgactgcatcctatagtttcagtgagagaaatgtctggttaagtgccgtgttactatttcatggctcctcaaagctggcagtgaatgggaaacgtgtggttaaacatggagcagacagcagcagagtggtcggcaggtcggcaagtgtccctctactgctgctgctgctgctgcttgctcatcatcaagattcaagaggagcttgacctggacgtctcctctgctccatgtttgtggattgatcagtgggcaccactcaaccatcataatcctaggtaggatttggaggatgagtacactcttttgtgctcaccactgacttggatggcatattctccatgcaactttaaagtcctttccgttagggcaatgcatatggttttgaaaatgtggtcatcagttgattcatcatccttcatctagagaatttgccaatttgtatgcttgggctgtatagtaactatgacatgatctaagattttgcagatatcacacatagataaaggccgtgtttagttcacctccaacttccaactttccatcacatcacatcatatccaaaattttcctacactcttaactttttttttccaaactaccaactttccctaaacttttaactttttttcaggaactaaacacagccaaaaagagagagaagagtttaaatagtggagcaatcaagtgggcattgtttatgcccttgctaattgctagtagtacaaactaaaatagccaatatctgataatctgaacatgagaacggctgccccgttgtgtttcaaagaagagagttggagtacatgaaaaatcttagtactatactaagtacaaatgaactgtacctgtctctagtgtataagttttgatgggattagtacactgtacagtaatcacatcgtaccacaagccaaccctactgattttaaatccacaagggtaggagtgcatgatcagactcaaaaactctggtgagcagtgagctaaataaattgcactttttttttaacattaaataaattgcacttgtgcacagttctgcacttaatatgcaagcatcagataactgcaactagtcttgcatatacggtgatgatagtagcagtacgccagtaccatatgcttgactttctctataattattgacttccacttaactgccgtaggccgtagatgttgcaagatcccactaatggtcaaccagttgaacagaacaatgatagaggtagagtacagtagagtactactagtatactccctccgctatctatatctattataagagattttaacattttacttacactatttgactattcatcttatttacaaaattttaaaattattatttattttgtttatgacttactttattatctaaagtattttaagcacaacttttcattttttatatttacataatttttttaataagacgagtggtcaaacatagtatgtaaaatatcaaaatactttatattagggaacggagagagtattatctctgttaaaaaaactcaatctatctttttagtactgcaaatctgaataattctttattcagattcatggtacttccttttgggttattattatttttttttaacggagaagaggcagtactcggtgcagttgagtgcagcgcaggctggagttgggagttggctgcctgcgatgcgagggcaaagaaaaggaaaaaagatgccgctgcaggcggctgccgccacccaccaaccgcggacaagtggaagccccaaaccccaaccgaaagcgacggcgcgcgcctttggtggatggccgttggcgccgaggcaagcgaggcgcctgtattttcttacatttcagcccttccctaaaaacttattttacgaatgaaccttttaaaaaaactcttataaatgaacccttagaaacttattttacttttgcacctaggtccaacgctatgctgaagtcaatggcgtcgagggagttgacaccttgtcactttgtgtgagcacgcggaccggcattttggcgattgttaagatctctagccttgatcctcggtatggtgaagtgagctatggttgcgtggacacggtcagtcagcagttgtagttgtttcatgacagtccatctggttgtggccgctgccgtgccgaatcagtgaccaggatttattagcaccaaagactccggcgctgtgacgttggacctcatctttcccaaagtctaaacttgaaataaagctttgctgatggtgtctatatatgtaaaataagtttatagaaagggggtaaaacagaagaaatccagggcgaggcgtggtcagtggtcaccaaccgcgggcgccgcgactgcctgccttgctgtctcgtgcctgccgtggaaaacgagggaacgggaacccaacccaggcgcgggccccgccggccaccgcgcgcagtcgcagcaacagccagtactctctctgcgcggcggcagcgcatttcccactcggccactccagccccccgcagcatccgcccgatccgccgcgcggctgcttggctgttggctcccaccacaccttggcgtggccgtggcgcgggtgttggatccgtccggtcagcgctggcgtcaccctccactccctctccttccgcccttgcctcctcctccgcctaatgcgatccgacgcgcgccaccaccacctcctcctccgatcccgcatgcgcccggtccaccgcgcctcgcctcgctgacccacgggggccacctgctgctggtggtggtggacggacggagttgtccgcgacggtctcccactttccgcctcttccccaccaccatcgttctccttctcttctccctctcccacctttctccccccgcgcgcccgatccttcccttcccccaactccctctcgcatttcccagctcggatcctcttctgacttctctctctctctccgtctgtctctctcctctttcgaggtcttcagtcttcagtgttcttgacgaccttgctgcttcttgcctctgtttcgcctcctacttgccgtcttcttcttcttcttgctgctgctgctgctgctgctgaatttttcttcggtcagttagtcggtcaggccggtgccggtctgggagcgattccgccggacgcacgcatcaacagtggagggaggggaggggaggagcttcccctttttgatctagcaagtcgtcgtctccaaaaatacacttttttttgttgggtctttggaacaaaagggtctcctccttttgatctttctgtctcatcactaaattagcaaagctttgtgcttcgcggcgatctcttttcagctaattcagtctctgttgatagcttcgttgcccaagagagatcccccatgtcagaggcgagcggatgacaccgcaattcgggtccggttcttccgcctgagctgcagaattttaagcttcctccgtggtgccgccatggatgcccttcctgacgccgccgacgcggcgcagttggcggcggcggcggcgccgccgcagaagcgcgacgagtggagcgagagcggcattgtgcggctgctggaggcgtacgaggccaagtggctgctgcggaaccgcgccaagctcaagtggagcgactgggtcgacattgcccacgaggtgtccgcccactgcgccatggagaacgccgccgccacggggaagcccgggagcagcacggccaagacgcccaaccagtgcaagaacaagatcgagtccatgaagaagcggtacagggcggagtccgccgcggcggcgcgcgccggccccgccgccgccggtgctggcccgtcgtggcggttcttcgcccgcatggacggcttgctcaaaggccccgccggctccggccagccgcaggcggagttgagcaacagcatagacctgcgagctcctcctcctgcaaaggttgaggtcgatgtcgatgcagatttcgtcagtcagttagctgatgcagggccgggtgcactttctgaattggtgagtgcatatgcaaacggctcgattcaagagaaattggacaaggttgagaacagtgggcatgttgaggggagagctgcagagagtgatgtcaatgtgagctctccgaggatcaaggaggcgaacgaggatgccgaggaggtggacaaggtatgggacatgtccaagaagaggaagaacacggagtttgatatcgcgaagagcatcgagttgctggcaagctcattcttgaagattgagcgcgcaagaatggacctgtacagggaaacagagaggatgagggttgaggctgagattaagaagggtgagatggagctcaagaggacagagattatggcaaagacgcacttgcagatcgctaagcttttcgcaaagagattgaaggagtgcagcagcaagactggtggtagctcatctgtaacagctgaagtggacaaccatgccaagaaaggagaaaatggttagtatcaacatgacaatttgcgaataaactggttgtagttaactaacttaataggggtatatgttgttctttacattccatagctatcaaacattccatgcaatttgaagttaagtactcctacttggcatttgctatatctggagttcactaatagattaggaagttccagcctgttgagttttgtctagtgtaattatgcgctacatagtctttgagttccaaatttttggagttcggtacaactatatcgatagaagctgatattttctgagtgcatgttctgaaatacagaacggcttgattgcatgtgtggtatagtgcaaacacatgatgtttcgttagtacaagattttgattgtaggagtgcatagactaaattgcgatctgcaaaaagtacaattacgtgcgacctcagcagagcgatcttccatgttgcaaacacatgttacctgaattacctaaatgatcagaccttacattaaaaagattgtatacaaccgctaagtaataaaattgtaatgaaaatataatcaactgtgctgatggcatgctataaaaatactcctactgggttaagccatgaatagacaaaattttgctatgttctcctactctccttcaaaagcgaatccaaaattcgtataaccctagaggtgtccaattcataaaaatgaaagagcaattgcatgcttgttgaaagtgattctgactgtataatgctaccataatctatacaaattgaacttacaaatattctggagaaaaaaaatactggatcagcctatggatgtgtttaagtgcatctgtgcatatatttatctgatttgattgaatacgctaatattccatatcttatcaaaatggaccatgtaagccttttcatgcataagaggaaattagattatgagaaaatcgacacaggttgctaaatctgttcagcttagcatatattcagaatcaatcatcaagtgatcatgtaccagtactatcagggctaagtattggtttgtgctagtgcaattatgtttactttgtattgataaaaggcaaggttagcacaccaaacaattcaaggattagcatttatgccctcaagttgaaaccgatctgaatttctgaacttttaaatgcttccatcttcaaatacatctcaaaaattatcttttttgatcttcttttaagttgcttggaagtgccaactgaaagcgcggttttcattgtaatcaaacatgttgaatgatgtttacactttctatttcatcttgtttcgctgtgagcagttcttctgacttttgggcttatgaatttcaggttcagggtgattgaaacaccaaccgatcgtccagaatccagaaagcaggcttgtagtttttggtgttcttgtgcaccaaatgtatgtctttgattgatccgacttcaccatgtacgaagagatagttagctgtaaaagtaaaatgcaataaatgatatgattgtccccattcagtgggggattatagaagcagttttagaatcagtaactagcctgaagaaagttgttgagttccttttgttaatattttttgactgacagccatcgtatgtatcattctactttttttagataatggattttcattaatccggcctctagatccacaaatgatatacacagccaaatccacgaattatatacacagccaaatgtatcattattctactatctcattgttgcgaagtgttttctgaagcaacatccaacgataagattcttgcgggatattttattgcgttgataatatggctttggccgtgttaattgcaggattaaaatggttggaacttacactgtcgtttacttttatgctgtaatgtggtattccaagatctcatccgactttgtttgatccagcatacttatcactttatcagatagtgaaaccagatcccatttaattgccctctaatgactccacatccctgaatttatctacacggtcgagattttttttatatatattcatgtattacgatgttgatataaataaaaggtaaaatttatttttagctagaaacaaaaacgttaaaaacgatactaccatttttattttattattttcgtgaatttatcgtgattcgaacccctactgatacctctctctccgtttccaccggtaaaaaatagggaaaaaacagaaaaggctgttcagatttgctagaaaactttcataagtttttttacccctaaaactttcatatttgtgactatagaatcgtgttgagaactcaagatttatgtatgaagaagaaaatttgctcgaaagaaatttttacacatctcatgtgcaagatcctagcactaacaaaccaaaccatatttgaatataagttttatataagttatatcgtagctacagtatagttaaagctaagttacaatataattacacttcaattccattatattacatgcgaaaggttttgactaaaaaaactacggggcgattttttagatacttccaaggctgtttgtcgtgggtccacatgtcagttacatggtacaaattcgtgtggactctctgtgtggctcaagctaacaagcaggaaggcagggagtaattggtccaactccctcttcttcttcctcgcctctcccgaaaggaaaagaaaagaaaagaaaacgaaaaaggggaagaaaaatttctgtgtccgttccatcctagtccttggcaagtcttctcaagcaggaggaggacttgccatggtgttgatttggggcgggaagaagcatcgggctcgccgtctgctcctctgatcggcctcctcagttgacacagcaagatttggtccggggggaaggggagcagccgccatgtttgggtcccgagtccaggatgaggtggagatgcagaggaggactaccaacaggtgcgtgctgccagcttgtgattctttaatcctgtagcttccttttcgtctcttgatgcagaagaggaattcttttcggttctttcaagcatatgtaaggaggaaagtttcaatttatacggcagatttagtttgccccttttaatgtagtagcttgatccgcagttgcgaacaggtggacacaggaggcgatatgttgtcaatatgcaattctggtctaattgttaccctttctgattggaaccacccaatatttgcacaaaagataatacacattcagagataacatttttgcagtttatttttccttactgggttgtttctatgtgtaggatctttcctgatgagagacaggaccagtttaagctaccgtttcaagctgcacgggctgacagatttggggtaaacaggatagatgcaaagactactgagaagattaaagtgataagtgaaggcaacataccatggcaccgccgcattctagaccctgggagtagcatggtgctaatgtggaacagggtgttcctagggtcctgtttgtttgctcttttcattgatcctttcttctactacctgccgctagttcatgtactagatgaaagtaccaaccgttcatgcattgccaaggaccggcgattgagcataactatcactgttcttaggacatttgcggacttgttttacatgctgaacatcatggtcaagttccatactgcatatgtagatccaaagtccagagtacttgggaagggagagcttgtcttggacttaaagaagattcaacggagatatctcagaacagatttctttattgacctacttgcaacgatccctcttcctcaggtaaatagcgcagaagtaatgcttttttggaattcttattgcatttgttgatggtagatacccccagttacccatgcgcaagactaaagttgttcgaaagagtgactatggtgcaaatgtttgtaattgtgcactttattttcaccctccactacatcttttgttgctaaaagttttgtatgccacaaccatccctcaaagtacttttaataatgcccttttgcaatttactagtatttccattctttctttctgtttagaataaattcattagttttcatgactaaaaactaaatcacttcccctgagtgagtttaaagacaatttattttattatttccatgtttacttggaatattttcatgatatagttaactgctacttcgatttataattatccatgttgtctttgccaacattgttctaaaccatttttactttgcactgctagaactacatgattggcatgttattttcccccaatttccagtgtgtggttgatccgctttcccacaactgaataccgataatgtaatcaattgaaacttttgaattctacagtcatagcctgaatctcctggtggtactttctcttgcaggttaccgtgtggattattatgccttcaataaaaaactcagattacaacatccggaacaccacatttgctctggttattatgattcagtatatattcagaatgtatctcattgtaccattaagcaatcaaattatcaaagcagctggagtagttgccaagtcagcctggctaggagcagcatacaatcttctgtactacatgcttgcaagtcatgtatgaccaccttccatcttcaacttagtgttcatcatttttgtgccatgttaatttgtttaaatactaagtgttgtgcaatgtaatctacaattgaaacccaacttaaattttgcagttttttccctgatacctcattcacagtaggaattggacaaacaaaatgagcctgtctgtaatcacagcatgtagatatgttaatttggcctctctaaaaaaggaaatacatgcatatgtgcaaactcaaattggaggacaataattttaatatcacagctcttagctgcacttttttttttgaactaatacttcaataatgttcctcctggttctgcagattactggagcaatatactatcttctctccattgaacggcaaattacatgttggaatcagcagtgcctaaatgagtcttgtagttttaacttcataagctgtgacaatactggttctagcagttatcttacttggggaaagaacacaagtatatttgacaattgtgatcccaatcgtaattcaagtgctaaccccccaccatttaattatggaatgttttcaaccgcactgagtaaaggtgctgtttctgctccatttcttgagaagtacttcttttgtctgtggtggggcttgctgcagcttaggtataattaatttttaatatacatccccatcttgaatattaaactttctgtacatctgttgttgatatcttgcctgtgaactattaatctgattatatactttacttggggttcttccatgatttatccattttattcatggttctgtgtgattcaaatacaattgctcatgtttagttttctgctgctgtatgtgctctccttttcagttctagtggaaatcctcttcagacaagtgcatacatcgcagagaacacatttgccatagcaattggtgctcttagtctcgtactctttgctcagctgattggcaatatgcaggtattgtcatatcttttgttctgaactaggggagaaaatgctccaaggacaataattttcttgttactgtttcagtttactgtaaatgtagtaatgcaagattgttacgttctataatatgtgcacataagtggatgtcctatttctgtgatcaatggatgcttcaagtcagaaatttccattttcattgttttaaaatctgatgacaggaacataaaactatcactttgctcataagccattttccacatttgcaaccaattgaggttgttggttcagagatgttgcttacttcctttttgtttgtcatcttgtagacatacttgcagtccatcagtaaaaggcttgaagagtggaggctccggcaaagagatatggaggagtggatgagacatcatcagctccctgatgaacttcaagatcgtgtccggcgattcgttcaggttaaatggcttgcaacacgaggagtagaagaggaatccatcttacaagctttgcctgctgatatacgccgggatgtacagcgccatctttgtttggaccttgttcgacgtgtaagttgtggttatttacttacatttcaactgaattagtagaatgttttagtttctgaaaggttttagatgttaaattttctagtggcattctgtcgtttggatggaaaaatcagtgacaaaagtaccaccagtgctacttcatagtctagcatgttttcttatcccttcctaaaatgcaggtcccatttttctcggagatggattaccaacttctagacgccatctgcgagcgtctggtgtctttcctgtgccctgagcgcacatacatttctcgtgagggtgatcctgtgaatgagatgctcttcgtcatacgcggtaagctagagagctccacaaccaacggaggccgcagcaacttcttcaactccatcatcctgcgccctggtgatttcgctggcgaggagctgctcacatgggctttacttccaaagaccaatgtccatttcccgctttcgacgaggacagtgcagagccttacagaggttgaggcctttgccctgagagccgaggacctcaagttcgtcgcgaaccagttcagaagactacacagcaagaagctccagcacacgttccggttctactcccaccattggaggacatgggctgcctgcttcatccaggctgcttggcggcagcaccagaggagaaagctggcagagagcctgagccggtgggaatcatactcatggtggccagaagaacatccaccagctgacaagcctaaacaggagggcacttcaagcagtaccaagactattgctgagagtgccattgctcaaatgcacaagttcgcctccgcttccagaaggttccgtgccgacgataccgccatccggaggctgcagaagcctgatgagcctgacttctctgcagatcatttcgattgaggctgatgtttcctgctttaaaaaaactgttgtaaaaccactactgtgcactgcattgtattcaatagccatatagtaatccatgtgtatctcaaagatgaaaccaaactggtcctttgtgtaattcaaatatacgcattttaggagctgtgaatcgtgtgcattttgtttgcagttgaaccaacctcgagaattttgaagaaatgaacagtttagtagttttatatattgtcgcgaccgagaaaatttgcattttcccgaacgctagtgtattaatccccgtcccaggaaaagccggggtacaccacacaaacatgatataaaagacacatctttattatatcgataatatttacattattacaaaggcacttcaggcctgacaatcaaaaataaacagcagcggactagcgggcctacggctccatcttcacaggcgctcaactggggtataagccaggactccacctaagacatcttctccaaagcctctcttactgaagaggggaaagattgagcaagagtgagtacaaccacagtactcagcaagtcacaccggcagatgcatgattaatgcaagggggtacaaggggataataataggggttaagttttgcagtaaacagcatttaaaagtcacttagttgcccaaagctattttgtaaacacgatcctagagctatacaatattattaatcaaggccgtgaaccctcacgaacctgccttaacccaaggcctacgatgattcagaccgaactggcaacccgaccctgggtcccagctcgtcccaagccaacccaggctaaccattccacattttagttgttgagcaaattttaagaattaaaacactaacttgggtacattgctcggcttgcccataaccgagggcgcggctattcgaataggttttactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaatcacctaatgttgcctaattaatcagcgaagcatctacctaaatttatactagtggaaccatgaatagagtacccactagttggggttttgtttattctagggtgaacaaggtaataataacaatagcaataataatgtcttaacaaaggtaaataggcatggctaaataaaacagtgataacgcgggaataaaacgataatgcattaatttaaatcaaaataattttataaactgggattcaatatgctcaaggatgatgtgacttgccttgctcagagagaacggccttccgaaccttcggcgacggccgcgaaccacgcttcgggaacctccggaacgacgaagactacgcgaagcacacaagcaaagctacaagcctaaaaagaagcaataacaatacataaaaagaaagcacacggttctttaggttatacaaacattaggagacttgaacgggtcgattcagagctcgtatgaccaagatatgatcatccgaagtttaatgctgttatatggagatttgcggattattgtaattaggttttgcaactataaaacaggtgtaagcgctagcctggaaaagacaggaaggctgcgccgttgacatgcggaccccacatgtcaacctaaaggaccgcggtagaccgggtacacagagacggtccacgggtcgacggaagcggaccccgtgtgtcaaccgaggcgagtggccgacaaacggactccactagacaccacacgggctgcacacgtggaaaccacgcggctaccgagcgggcacactaacacggtcaccacacgcacaagcgaacgactaccgacaccggtacacgggtatcggggtcgacaaccgcacaacgggtacgggggacaccgaaaggacgaggacggggcagcgagggagagggaaccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacgaagacgatgacggggctgcagcggcacacttgacggacgcggacgagacggacgagaacggcctgacggagggacgaacgccacgacgaccgggaacgacgagaggacgacgacgacgacgacgacgaccggggccggcgaggaggcgatgagggctgccggcagcggctgcacggaggcgaggatggcgcggaccacgccgctgcgatgccgacgacggaggcggcgccgcgagacgacgagccgggcgaccgatgggacgtcgacgacgagaacgatcggagacgacgctgatggaccgcggaggggtttggatggaggggaaacgatgccgaggacgaccttgccgctgcgatgccggaggtggtggaggtgtggccgaccggtgcacgggcgaggagggacgggcggccgaacaactccggcgaggcggatggagaggtttgcggcgatgtgcggcggcttccgggcgaaaccgaggggtggacgaggtggagggctacgtcaccgtgccgagggaggggacggcagcgccggctgacgcacgggcatggcgaaaggggcagccggaggagatgccgccgaggaggaaggagaagccggcgcgggcgacggtgttccggcgaaattcgggcgaggaggaggtgatgccggggatgagggcggcgtcgcggagccgagggaggtggtggcgacgtcgaccggcgctcaggcagggagatagaggcggctggaggcggccgacgcggaggaaagggaagggcgacggcgggaacgcagctccgggggtctccgcgggaaacggagggcaagccgggcaaggggaggcagctgctatgctggaggaggcgacggcacgaccggaagacgctccggcgaggagggagaggcggctggaggcggccggcggcacgggagagagaggaggacggcggggagagggctagggaccacgggagatcgcgggagggggctaaaacgatagaacggagcgagggggttgcattttatagcggagggaagcgagccgagcacgggagagggcggaacggcgacgggaatggcggccggcggcaaaggaaggcggccggacttggcgcgtccgttcccggcgattgggggcgccattcaagggggaattaagggggaaagagagaggagggaaaggggtttaattccccctaatcaatttgggaatcccatgcttgaatcgcgcggatttgagggaggaatggcgctagggttcacgggagagggagagaggacggccgggcgggaggaggacgatgacccgcctgacgcgcgggccccacgcggccggacgcgcggtcagcgcacgcgcggcgcgcgtgtgcacggccggctcggctcggcctggcttgggcgcggcttgggccgggcggccggcccaggaggagaggagggggaggcggcctgggagaaagagggaggaggagggagtgggccgggaggggaagaggggcccaagaggaggagggagagaaggagagggaggagagggagacttcggccgcgggccgaggggagagaaggaggactttgggccagacttggcccaaagggggggagagagattatttttaggtttttctttttaataaactctaataattgtttttgttgcttaataattatttccggtgctctgaaaattcaagtaaaatttaagggctccttttagaccaaggagaatttaacaaaaattccccgggccacattcgaatttttcttgtacgcattttagtgtttgccaatttcttttcgaattttaattaattctattattccttttagaaaataatttttattttgggatgaatttatcaggacgtgacatatatcgtacgatttcacatttcagttccatctcgttttgtttttctcgatctcgggttactctagctgggctgttcttgatggctgccgattgccacacttcacaggagacaattatcatgaaattccattattaggctttcttcgatcacaatcgctctgatcttccgagaatcgtttttggagattcaactttttaatccgttgttagaaagaagggttatgcatatagcttagctaacaatagatagaaatataagtctttgaggtggtatattaagtagtttttatgcctttaattaaattatttattcgtcctataacatatgcaataattagatgttactttatttaagcaaagatcggaataaattttattattatttttattaaaaaaaaaagtaagacaacgaattacagtaagtccaaaaaaaatcgtttgaatttcgaaagagatattgttggctgtgggctaaggtgggccggtaattttctagcctgtgggctgaagggccgcagttttccctcctttccatcgtcttccttccgtgggttagatcgatcgatctggctctctcgcggagatcgagcaagacggatgatggcatccatggcgaagggccgccgcttgtggaaaaccaagcatctcacactgcgcccgccctgccacggcggcggcgatggcgatggcgatggcggtcacccagactggattctcgtcgacgtccaggcctacatcgccgaccgccggaacgccaccaccgccaccgccatgctcagcaacggcggccaccaaatccaggtcaccatctgcgtcgcgccgccgccgctcgtctcctacatctgcgcctggtcccccaccacccaccccgccgagctcttcgacacggagcccaccgtcgaggccgtcgacgccgacctcctcctcctccgcatccacgtctcgctcaaccatgtccacgacctcgtctaccaggcatccatgttgccatcgctgacgctcatgcccagccaagatccttacctgcacgagcccaactgcatcgcgctcatcccccgctcctcccatggcttctacatctccacgctcgacacggatctccgcagtgggattgggcgatacaacctctgcctcttcgactccaccaactccaaatggagccatgaatcgctctctctggatcagctgcgcaatccgcctgacaaaaacgaggtgctccatatcacggagaaggtgatcaccttcatcaacgatccacatctggttgccttcgttgatctctggcggggcatcatcatctgtgacatacttgacaccaaaactcaaactgcaagctatgtgccgatgctcaaggagatcatcaacctccgcagaacccgagcatcgtcgatcaccagggacattgctgtcgtcaatggccgcctcaccgtcgtcaggctcaccactgtctttgatccagatatcaatggttgggactgggatctgtccacatggagcagggcagtggattgtttggagcaggaggattggcgcgaggactctctggtcgaggcctctgacatcttaatcgaccacaacatctgcaacgttgagctcttgcctaagatacaggggcaacctaccatggctaaactccacgttgctcttcccactctcagcttgactgatgctcaggttgtttatgtcatgggcaaggttaacgaatccgatgaaaaggctgtgctgctgtctattgacatggccaacagaaggcttgatgcagtatcagtgtatgacgctgcaagaatcctccactactttgatgtctgctacacgcagtctaccatcttccgatattccgccccttcttcaggtgattaattccctggctattctttctacttgtttttcttctggccaaacctttggatcaattgatagtaaacctgattcgtattgttgtgtttgctgatatatttgaacacatatatgtatgtggctgttgctatagtgctaggctgctagctagacttgctagtttagtcggctgttagttggaggctagtgttagctagactgctagttgagacaacattagtgtgaggctaggtatacttttagtcgtcattcattcattcattaagctgccagattagttatagagtatggttctagataaacaaatcatgaaatgcaagcccatatggcacatgtagccagttaaatgcaagggaatgttagctttcacattgccttcagatgaaaaagaaaatgttgctgtgggtgcatgctgtatcaaaaaacgctcataaaacaaatgagccattgaacgagatggttggaaatgaaaacatcgacaagatttctgccaagagagatatatagcagaccattgtaggtgcttttgcattcttgaaatagaatgaaaacttgttgaattatgtgtaaatggttaagcacatatatgtgtaaattattttgcactaacacatttccctttgttttgctgggtgcaggtttaaatggaaacctgaaacgaccagggaagttccctatgccatatcctcgcaagcaacaggctgtaaatgagccatttcttccggatgctgggagaggtttagaaactgaagatagggatactatggactgggagtagttatgtaatttggagctgaaacctgaatagacataaattgatcacagctgtttattttgcttctagttactacatggattgctacaaatgcagctactctagaagacatcagcctgcatagagaaatttactttggcagcaacaaagagtcgaacttggctatctcaatctttgagcatctgccgtcatctcacaacaattactgtcgtgaaactccatcattaggcttttcttcggccacaattgttctgatcttccaagagattcacgctttatgtgaacacagaaccatttcagattataacgcatttgaaattaattactgacaaaaatgacctgtaaattctggtaaaacactttgactggttcggggatctggagtatgattatagataagagtattattcacatttagacatagaagcgcccatggcctaatggataaggcgtctgacttctaatcaggcgattgtgggttcgagtcccactgggcgtgtttattattttttttctcttttaagactcagaaacagaaaactttttttataatttgtaattagcaaatacaagtacagatagacctacctcattcacctctaatttctgacaagaaactagttagctagtttttgtgagaaagcaggttggagaattgctacacgtcgccgcagcccacccaactcacagtattacggcccaaccaggcctcccgtaacgggccgggctacatgcagtttccattgcgaccagcatgctggcccacggtcaggttagcgtgggccaatttgactggcccagttagtaggcaaatggactgcatgaaatgggccgtagtcctcctattttagctaggtcgacttctttttccgagacatttaacttcttgcaacttttaaaatatggcaattaattatttgtcactcgctgtatgacatgtgggtccagtggtaaataatttagcaccactgcaccactcgtaagagtggcaaatagttaattgttcttctttttcccttttaacacgagcactgctacacgtactaattttttcttactaaatctttactaacaatcatctcaaccgtttgatttaggtagatggaagttattaaaaatctagatgcactcatagcatgacacatcactgttagtaagaatttagtaagaaaaagttagtacgtatagccttttccttttaacactatctccattttttaatatatgacgttgttgattcctttacacatgtttgatcatccttcttatttaaaatttttatataagcataagaaaatataattcatgcttaaagaacttttagtgttaaataaatagagagagtaggttcaccttgaaaaaggaaaatctcctgatcatctcgtctcatctctcatgtcatctgacacattgcagcatgcaagcaaagaagttcagcagcctgtctgatgctgcagctactacgaaaggggcgatttcgcatgcttaatcactgctagaggtgctcaagtgaactggggctgtgtttagattcaaagtttggatccaaatttcagttcttttccatcacatcaacctgttatacacacacacacaacttttcaatcacatcatttttcatttcaaccaaaatttaaactttacgctgaactaaacacagtctagagtaatcagtaactagctacaaatcgatctacactactgatccatcagcgatcagtcgtcgtcaacatctattgatgcaaagcagctggctatctatcaataatctggactgcagagattaattgaattcaaccatgcgtgcatgaccgatcgattctcctcgtcatccgtgggtacggattaattggactcttgctccgaatgggtgatacactcgggtggcagctagggcacacagctagctaactctgatcctctctcgtgtttgtgttagctcacatgactgcgtatactcatcatgttaagagatcttgatcactgacttgttcagcaggaagaagctaccttaccttagcttaattagcttttgcttagcttaggaaatagccactaacacacgccattaaatcgtcttgtcatctaactacacctaaatacgtgtatctagctagctcaatcaattaatttcagctgcagatagacgaaccattttcatatagttacaatagctagctagttgggtcgatcggttgcttgcatttcttgcatcttgtgtatatatgcatgggcaagagatcgccaacagaaaggaattttttttaaaggagttcgagaacaactgttcttcaataaacagataatgcgtttttaattgcagttgcagacaatgcaaacttcatttcccctgggcagctagctgatcttgttccataaattaactggacgatgtcctgacaagctgcgaccgacgtacgagcaaatttaattacttgtcgtgatcacaagttaatcaactatgcttatcattgacgacattatgcgcaggttcgtcgtcgcagaacaagttaagtcaaatcgattctactccagcagctgcatccatagatcgatcgatcagtctgatcacacactaaaaagcatctttgaaaaaacgtcatatcatcgcaacagtggtttaatcatgttccccagttaagttgcagtttacagctgatcataccggatgcgtgcagcaggaggactttgtgtcgaaagagtaattgtgtgtcaacaaagcatacatgcactatgacgctctgtggttgggtttgttgttgggtcagtaaacatctaatcaatcaattaattcatcttgctgcatgctgatttaatcttgagctcatacttacgtgttgatatatcgatgattctaatgaatcagcagtatagctagctagcagctggtagctaattaattaattgccgttagcagtaattaggagtagaaggtaaagactcttgcagcagataaagcaatttccaagttaaattaaactggaaagaacctcatttcaagtatgcaagatcccaaggaaaaaggatatatacattgttactgaacagtacttacagctgcactcaaacagcatgcagcttggtcaccttactaacttttttggactgatcaccttactatgatgatattattctatcaccttactatattactgattattattattattattttgtttgtgattgattggtcatttgagatagatcgttgttaattggtgggaatgggcagatagctagattcatgcatgtactagtttctactagctgctaatactaattttaaacaagaaaaaaatgggggaaaaccctgatgctttaagagttgtaactaagtaaaggattaaaaaaccatgagacgcacgaaatgtcgagataaattcggcttgatcgtgatatatgttttagtgcatatagtaaagcttctggtcattctcttagaacaataaaaagaggcaaattctccttgctaggatgaaaaggaagaaacactcaaacacatgatgaacacagcttgatccaatacaagaacacaaagacatactatgcaaaggattaatccacacacaatttatatattctctggggtacctaattaagcataggctcatccaaacatgtatacagatcgatcaaggagatcaattacgtactgaattaatgagatgtatattattgaactatatatatctctctctcaaagatcagggctatatatatgaattagccgatcaaacaattgcactagaaatcaatcaatcgcggttccagagacgcaacaagtactcgatccaacgctagctacctacgacatatgcatggattcatcacgatttgattaattaattaattaattaattaattaattaattaagccgtcatatacgtaatcaggttaattagctcagagcttcagcgacaagtcgatctcctccccattccggccgtagcgcccgccgccgcagccgccgtcggccggtggcggcgctggcggcgccacgtcgtgatcctcctccgccgcctcagccgccgcggcgtggccgtacggcggcgccgtccagaagaagcccccggcgacgccgtcgaagccgtggactgcccgggacgacgacgacgacgacggcgacggcgacacggcggcggtcatgacgatgtcacggctgcgcttggcgagcgtgcgctcgagcttgtgcgcgttctggtggcctcccagcgcctgcgagctgaagaacttgcggtggcagtagttgcaggagaaggcctcccgtgggtcgacggcggcgg

SEQ ID NO: 75676 - DNA, 730 bp, Oryza sativa
ttggcaccaatgcacgatcgatcgatttatacaaatccaccaccaccaccttcgcggcggttatccacttcatcaccggccactctgcctagagcattatcatcgatcgtcgtctacctagctagcttcacttgtgctccactgcaaccagtacgccacattaacttaattcacacctagcttagctcactatatagcttagcttcgcttaagcttaagctgatctcggagaagacgtacatgatggtggtggtgataaggcggcggatgtcggcgacgccgatgctggtgctggtcgctatggcgggcggcgccaccgtgtgcgcggcgcagctccggcggaactactacgccggcgtgtgccccaacgtggagtccatcgtccgcggcgctgtggcgaggaaggtccaggagacgttcgccaccgtcggcgccaccgtgcggctcttcttccacgactgcttcgtcgacggctgcgacgcgtcggtggtggtcgcgtcggcggggaacaacacggcggagaaggaccaccccaacaacctctccctcgccggcgacggcttcgacaccgtcatcaaggccaaggccgccgtcgacgccgtgccgggatgccgcgaccgcgtctcctgcgccgacatcctcgccatggccaccagagacgccatcgcgctggtacgtgtactcccggtttgactttgttcaaagttaaacaactctgagtttgactaat

SEQ ID NO: 75677 - DNA, 2230 bp, Oryza sativa
aatttaagaatacgacttagtgtacactggtaacccatgtcaatgaaatgcccgtgtagattataataaacttctcctacatcaaataatcataaattggatctatgctaatatgtattctatcactggatcaaggaaaccgcctgattagcttggaatggttttattggtactgtattcttgtattggtgaaagatgatataattaagtgtaacaacctgatatgagctgggctccatggcctttgtctagtatatgactaacagctatcctgattgattgtgatgcaatatgctgtatgtctagagtgcaacagtatattaccctctcaagtgtttgttatggtactagtgtttactgcttgttcttcatcttcctaagaaacgacaggaagatcatgttctgtaaaagcggccaaacaaggtcctgggactacgaggccctcaccatccgatgggggtgagtgtgtcctacgtcgcaattgcttcgcgcccacccacccacccatgtgggcagcaggccctcccgcatttgttgctgcctgtgtatctgcatgcggtgaattcatccattcagttagattcagggttggatgctgcatctggagtgtgtgctgttggaattctagacgtcggtgatccagggaaggtattgttgggtgcgagcttgattgagtcgtgcgattttttttattcgcatatattatattgggaaaatggatatactccctgaaatcattgggacaattgattacttactaataatttctgttcactagtggctacttaaattacccattttttgacttgcgattacggtgtcatctacaagtttgcatcgtaaatacatttctctaaaccacgtacatggaggcaacaataacacataaactgctgtcgttctcattgaattcccattgtttcagattgcatgttagattagcgatgttgcgcagagggcatgttttttagttagtttcaatctgtcgaatgatttagtttagatagaattgggctcatcatttggtgttacaatttaatttactttgtaataggaatccaaggcatgcatcaattgctctataagtttagagtccacgggtcatactgatcctgtggtcttaaaacagctattttgggcagcaaccatgtgcagcattaaggcttgtgctgaaggattgttcttcaacagttcaacctaaggattagagtaaccatgttattttttttagtaaatattcttaatcaagtccattgaaatgactatatatgttataataaacttattttacttaattaaccatgacaatggacctttgtcaatatgtattttatcactgaatgaaggcaatcatgtgattagcttgaagtgtttttattgctactgtattcttgtatggattaaagatggtatgaattaagtgtaataacctgatagtactttggttctttggcctttgtatagcttgaaaaatagatatcaggattgattgtagtgcattatgcctagaggttatagctcaacagcacattaccctcaagtgcctggtctggcactggtgttttctgcttgttcttcattttctaaagacagaacaggaagatcatgtactctaaaagcaacccaaaataactttggttgtatatgattactttagcatgacgcatgtcttctccccacaaatataccagtgttcatcacttactgttttgaatagtgtacttatatctccagtcaattaggaattcatgctgtgagtgagctcacaaaaaatgtccaactgggcacttatattttcccagcctatcctgttaacagtatctgaatttatgatctctttgagcagtgagcaggatgattatgaagttgtcaggaaagttgggagaggaaaatacagcgaggtctttgagggtattaatgtcaacaacaatgaaaaatgcattatcaaaattctcaagcctgtgaagaaaaagaaggtagttcatgattcatgaatcctgttgtccatcctttttttccttttcccctgaacatgctcttttactggtaacatggtactgtttccatcttacacctagctttgtgtcaatggcattagtgtttattattttaaccatagttttcttttgtatgcagatcaaaagagagataaaaatacttcagaatctttgtggaggtccaaatatcgtgaaactgcttgatattgttagagatcagcactcaaaaacac

SEQ ID NO: 75678 - DNA, 12544 bp, Oryza sativa
ttagaactttggttaattatgcgacatatatgatgataaatcttgatggtgacgtggcgtgtctcctgttctaggatacaagatgttttaattctagtctactctaagtttgtctaattctatagaaaaaagtagtaatatttacaacactagtatagtttcattaaatctataattaaataaaatttcataatatatttgtcttgagttaaaaataatactactactcttttttataaaattagtcaaactcagagttgtttaactttgaacaaagtcaaaccgggagtacacgtaccagcgcgatggcgtctctggtggccatggcgaggatgtcggcgcaagagacgcggtcgcggcatcccggcacggcgtcgacggcggccttggccttgatgacggtgtcgaagccgtcgccggcgagggagaggttgttggggtggtccttctccgccgtgttgttccccgccgacgcgaccaccaccgacgcgtcgcagccgtcgacgaagcagtcgtggaagaagagccgcacggtggcgccgacggtggcgaacgtctcctggaccttcctcgccacagcgccgcggacgatggactccacgttggggcacacgccggcgtagtagttccgccggagctgcgccgcgcacacggtggcgccgcccgccatagcgaccagcaccagcatcgccgccgccgccatccgccgcctcatcaccaccaccatcatgtacgtcttctccgagatcagcttaagcttaagcgaagctaagctatatagtgagctaagctaggtgtgaattaagttaatgtggtgtactggttgcagtggagcacaagtgaagctagctaggtagacgacgatcgatgataatgctctaggcagagtggccggtgatgaagtggataacggcggcgatggtggtggtggtggatttgtataaatcgatcgatcgtgcattggtgccaagtggttggatgaactgtgtgtggccggcgaggaagaagggcatatgcaggtgacgtggtttaatcttggccgttggatgaggcaaccgacggtgcagatggaggccacgtcgtcgtcgttgtcgatatgatgcatggtccccgggcgtaaagggcagagtggtgtatatgtaggtgttgtgatcatcgatccgatccgggcatgacgtgaggttgatatgaaactgaacgagacgggtatgcacaactaactgcaccaacaaatctttcgttgcgtggatatacgtatatcgtttgtgaattaatgtgcccaatgatagcttgatcggcaaaaatgttaatccaaagaaaagggctagctagattatactcacatcgatgtttgatagttagacgatgttgttaatttttagatatatgtatacgcttggtcattcatcttatatagtacataataatttgtggaaatatgaaaattttacaagtcatgtttatcgataaaaggtaattattttgaataaaaagaatgattaaatatatgttcaaaagttgattatgatatctaaaagtacttggcatatactccccgtccctaaatatttaacgtcgttgattttttttaaacatgtttaactgttcgtcttattaaaaaaattaagtaattattttttttcctatcatttgattcattgttaaataaacttttatgtatatatataactttacatattttataaaagtttttaataagacgaatggtcaaatataagcttaaaaaatcaatagtgtcaaattaaatatttagagacgagggagtatgatgcacgtcacaagtgagccatgcaggctgaatcatgatgcagtgcatgaggatatttatgttagttactctttccgtcccatgcttttttatcaaaatcaaactcgatagcccttgactaatgaccatacgtactagctatatctataccatgtattatacatgttatatcagtaattttagattttgatatattttcatttgatgctaatttcatatttattaaaaacatagtcaaagtgtgttattaaagaacgtgttaaaaaggagtaattagcaataattagaccaatgtgaaagtgtgctattaagggcagacctaacccatagtgtccataaacagtgtctatggtaccatgtcaataagacatcacaatagaaactacaatctacaacccatggtttcttaaagtgggccattaataaatacatcatctctcttctctatcaatcatatttattcttcatctattataaagacactattctctcccaatgcaaaacttgatagtgtctagtatataggttctcgtgttgaagctgtcttgcatgagacccagtttcttcctctcttcactctctctcttaattaatatagtgtcacataagttaaaagtcctacatggcaatatagttaatgtcatagacaccattctagatagagggttggaactgccttaaagaacgtgtaaaaaaagagtaattagcaataattagaccaaggtggaggtggtctcaagggaagcatgcactagcttttatggctagcttgtttgcactccatggataggacattaggactccactgctaaaagtatatactactagtattatcttttgatgcctctagctaatggtgctcacccaaaaaacggccacatgacacaactagtggcttgcctagagatagctggacggaaacgagatgtggccgagatgatatgcctatctttgtcgatactatttggaggtggcttctggaaacacctaaaagcaattaattgtacacttatgatttcctatttttgcatatgattttgttttcgtttttttctaagaaagcaataacatgaagaacaatattgtaacaaactctttcataattatgactctcttgtgtgttccatatatataaactgtaataatagtgttcgatcattcattcactaattatttgatataatgcttaattatgtaaatttgcaacctatatataagacataattttattggataattaataaactatatagttatcatattttcttgtaaatggcctagtaactattttttctctattatgtaggcacatgcacacacactacaacacgactacagaatagcttcacgcatgagtacacgtgcaaaatgaagcagcccctaacagtacacgtgcaaggagatggaggccacagcccacacacaggagatatattgttctcatgtatgaatccaccgtcgcttctctcgtcccttcgcctcctctcgttccccttcctctctacagtaacctctccaaaatctctcccttccggcccctcttccccttcgattccgatggttcgccgccggcgagggttggaggaggggtccggccaccttcccctagtagtatttagtcaggtttgtcctgttcgtagctagtctcgtgtcctagagtttgccggtgttgcctcccatggtggcggccggtgtggtggtccttgatggcggtggtggttggagctggtggctttgtgcctctatgatggggaatcgaagctctggtgggggattcaccctcccgctttggtcccaaagggtggtgaagattccagatctgagttaccttggtggtgatggaggcggttccagcggcggttgctggaggtgccctgcgtgcgtgtgggcacacgctggtggtggcaactacgtcgcgctcggcgttgtggcggtcgtcgtctccctccgttgtacttgtgctggaggtggcgacggcgtgtacgccgcccttggcgttgctgcggtcatcgtctcccttcgtcgtgcttgcgctggcagtggcgacagcgtgtgcacggcgctcggtgccgctgcggtcgtcgtctcccttcgtcgtgctcctgtcgtctgctgcgccccagcttgcgctgcccctgttgcagcctctgcctctgttggcagcagccatggttggttagatgacgacaatctcctccaagtcaatgtctttgggatttttgtgattgggtgtttgcttcggctagattcttgtggttccaagttgcaggtcacctccttcttagccatcgtcgtcctcacagcaagacataagtcaattggcaacctctcaaatgccccattgttgatggttggctggtctatggtttggccctctcttttgtttcctagcagcagaaaccgcgtatagtttgtcattcgggttgagctcggaacccctgtgcaattttcattatcagggttgttgttagagttcctcagattcaatgacgaatcccgtggggatgcttcgctgaatccggtgatgctcgcaccaaaatctatggctcaacaattatcctcgatcttgtgccgttcccgtgaaggcaaccaaaggggatcaacggtttgtcaagcggtgtgcaattcaactgaggcccaaggtagcagtcgtcgcggttttaagacgtcgtggctctacaatcgtcacggcatcaacgcagctccctatcggcttgctcctttttctgctattttgttacatctggaaggcttccatagtttggttaatcctctttctttagggttgtctctaatgctttcagctactatcctttgttgtgtactggggtttatcccctaatatctgttcttacttaataaagttgtttgtgtttaaaaaaaaaatccaccgtcacgcctcgatctccctgttgattgttgtaagagaaaaactaattattaattaactagagtaaaatttagagaaatgcaaatttaataactaaattatcaatatttactacaacattaattggtcacctagttcattgctgcaaggattaaggatgaaattattatgtaggtaaagttgaatctagaaaaaaaaaaggtatgtaaagctccaacaagttgataatttggtcgctaaattaatttgtacgtacatgtctaaaattcactcaatggagtattaatctctatctcttctcgatctatatctatttgtacatgtgctaatctgctgccaatgaaccgcaaccttaattaattaagctttaatctcgttgtctctagcgcgatctcacgctgctaatttgtcctgctccctctccccgttctgcatttatttacttgcatgatgcatgtcattcagatataattattattcgatccaagttcattttttatgattcaagtttcgtataggtttcttttcgacgtcattttttaatgatagatgctcatgatatattaattgctcttgctataagtggttaattacatactaatggagtataattaagttcaacaaaatcaattgaagtaatttgattcttttttaaagagattagaatataaaaactgaacctaaatgattaatatttatcttagttttattttttttcctttgcaccgcaacgtacttgtaatttttctagttactataataattagtaataaatctattctacaccctgaataattcctaataactaatagctctcgtccaaccaatcgagcccatgactggcacgtctaattaataggatctttttttttggaaaaatacctaaagtcggtttggcttttctggggtttcggtttttaccgaaacaaatggagcgttctattcgtgaaaagctgaaacccgtgtgtaatgtgttaattgtgtgttactagttctcaaaaaaaaagaaaaagaaaaagaaaaaaaagaatgtgttgtgtggggaactgggggatcaactattccaatttaccaggtggttatttacgtcggttggatgggccaactgatgggctcgagcgggcgagatatatagggccgggctccaaggccctaattaattaaatagcaaaataattaagctagaatatcatatcgaccaaattatattaaaccctagatagagaaataattagagagagaaggaagcaccaccgcgtgcgccatggccgcagctgctctccgccgatcggcggcggcgaccggccgccgcctcctctgccacgcatcagatcatcatcatcatcaggtaatccagcgcccgtacgtgtacttctaccttaattaattaggtcacaccactgcctgcctcttaatttctctcgaccgatcgatcaaccaatctcttcgtctttcatagtagtatgtccctatagctgatcagtactcgctaattttggcctaattaatgaaacttatcgtatcttttttttctttctactaatacgtaatgcctgtttaaagtttattatatttttcttttatgcacgcagcaggtcgatccattgctcttgaagaatgtcgaaaatttggcaaaaaggcaattacttcgtgacttgactaagaggtacgtagtacactattatggagtaatatacatatacgcacgcatgcgtgcttgaattaattgtctctacatatctgtctaagcaacaaagcttcatcttaattattatcatagtagatttaatactatagccaattcatacaatagttacctataaatatataccacactattaataaatgattcctcaatcatacgcacattatatgttgaagtccgtacgttctgcagctgtctataaatatgtagctcgctacttttttctttcctattttatcttctcgatatatgcttatatatagttagcttatagtctgctattgtacttgcttttgctcttagttcaccgtctttcctttttttaattaagcctcatattaattaattacatctgcatgcagattggctaaggagaagcgtgcgtcttctgtagcgccaacctttagagggattgcatcgtcatggccgtttgcttcttgtgcaattatgttaattatggatggatatcagaagcgctttaagaaggattgtaagaatgcagcagcagctaagaatccttaattaggaacagttctaaattaaattagtttgcttcaatcccctggccaaagttcataccaacaacaacttaattaattgatgtgtctttctggatataactgtatatgaatgatatatacgcgtccatctcgtctgtctaaagcctataactaagaatgtaatactgtttaatttctcgcttttctctcctccctaaataaatatgcagagctccttccatcttaatttcctgattacatctcccttgacgcgcctgactgtgtcaccgcaggtgcaacagtctccacccccaatgtgtctcgggcgctcggcaacctgcatcttgctccgcagcatcagggacacatcaccctgcctttgttctgtcgcatctgatttctgttgtgcattacgttatgttgtacgtagtctatgcagcctagattctcatggctagaacctagttctcggtggcagaatttgtatcgagatatttgaacgtatcaactgtggtcgaaattgtttttgtctatctgcttcatgtgttattcatgtaaatcattgctgcagtacctataaatctgttaaattaacttattctggaattatatgaatgtctaatgaatgatatagtggaagaactgctatacccgtgacaatggaatcgagattcaggagtttctttgttgacaaataagaggcctcatataactactagccggccaacactattgtttctattctcctctacaatgaaatagaacaagtcctaaatttggcatcatgacctcaagtaccagaatttggcacccatttataccaagtcccaaatttatgaaaaaaatttggcataacctcccctacattcatggacattcataacaagcgggttataagaacttcgatcacaaaacattcatacacataatatcacatttaaccccccccccctcccccaaagaacttgaaaacatacataggcacatagcttcacatacaacacaggttacatatatccataacctacagcctcccaagtacacatcacatgttacatatatacccataggccaaaaacctcgtaacgtactccttggcttgagcccacaaaatgcaaagtgattgagtgcaccttcaaacatattttggtccaaatcaccaaaacctgaaataaaatcaacacttgtaaggttcgaattacaaagtagtccaatatagcagcctggctagaagcaaccattgttaagttgaacacggaatctaagattgctttcctgaagagctctatcaggatagtgatatgtaaaatgcagattttaattgttgtttttgttttaagtggaaggtagcattgggccgaaatagttttttttagacatagtgctagatatacaaaaggatataacacccatagagcatgagacaaaacagcatatgtgtgttcccataaaactcatgttataacatggcatttcatagatatcagattttgacgaatataactttgccaatggatagtttgcatcacaacatctttgatttcttgcaaaataaacttactaactttcagtcctctgttggaggcatgtcacgcgggccttcgaccgaagctgccgaaaccactataccgacgaagcaccggtcaacgaccaaggcgttcacctagggcgaagccaggacggttcgccatcatgcctaagggactcgccgtgaagtcttcgcttaggatgaagctatagggcgaagcaggagggattcgccaggtggttggacatcttcgccaataggcccaaagggccacacggcccaaaaatgccattcgacataattgggtcaacttggaggcccacttagggggccccgagccaaatgggcactatttaccctcataaatgtcccatcttaagagtatccggccacgtaaattcccctgtacatatattaactctagggtgcatgagcttgtactaagactataaatagccccctaggggtatgtaatagggggatcccaagaaaaattccattattcaataaattactttactattccactcttctactgtgtgaaccacgtccttcgacgtgagcagttgtctttcgacaacactctctaatttgaaatcttttgagttgtaaatatatatgatatatagaactacaatccatatatcgcttcaagtatgtgaaatctaatttgaaatcctgtgtgttttagcttgaagtgtgactatacagaaacgtccttgtgatccaattgtgctgtggatttaggataagttcattgtgtcgacatttgagattacgactacggtattttgcatagtatggggattgttggtgctagggtatatgtgagattgaagtaagagagatggagacaaatatttttgtacaggttcggaccccttatctgacaggtaatagccctactcctgttggctgaaaccggtgttgctcttattaatcataatcacttcaatacaatatttgggataacctatctaaccgttgtcgagttggcggcctagaataccataccatcacttagtcgacaatagggtagtcttcctccttgaatccatactcgacgggaccagagatagcgctagattcctcttgtcggcctccgcaggcaccggattaagtctatctaggcatatatctgatgtcgatatccggtggcatgtcttggcgcgtgttagcttgtattggtttgtgtctatcttgattgttcatgtgtccccccctcctagggggtcttgtatttatacacatagatgtccccttgtccaagtagaactagggagaccaatatggatacaatccgagtagtctttgtagtttctatatagaactccttttgtccttccttatctggaactgcttctatataagaggtctgattccgtataaaacttggtatatggtgggccctgccgagcttagtcaactactattaggcatgtggtatccataaccatgacacactgaccttgacaataaggaaaaaaacgcaggtgttagaaagtaagaggacttgccattttcgatgagttgaacttttcaatcgtggcagaccaccactgccgatggcatggctgtggcgaggatgccatcggcaggtcgatctcctgccataggaaatgtttgggggccgtggcttggtggacgacctcgtggatctccatgcgcaccaagtttccctttggctagaggaagagaaccctggtggctgtgggtggaggaacgttgggaaggtggggaacgctggagctagcacccttgggggtggcgacaccagatctagcgccccttaggtttggggcagctggatacaatccctagctccaacactgcctcatggccagctagcccttccttctcactgccggtggtgacattcttgctcatacaatgtgcgatggagctatgagaagagaagatgaaggggcacgggtgcatggggcgtcgagcgctgggagcctcagccgatcgagcacaagcatttccgacaaggataaggataaatatgaaattacgattttaccctttgaagggtttgtaccgggtgaggtgagcgtcgttaccgctagttacttgatatgtgacggccgtccgatcatcctatttcattagcccatatttggtaccgccctcctctgctagagtgtaaaaattctcataatatagtgttcacattatgattaattatctgttgcattgtttgtgaatggttccggtgtatgtcctgatttctttcgaatcgacaaatgtatgcatgaatgaatatttatatatccatcagtcatactgttccctaaaacaaattagcaccattgagtcagaggtcacagctcaaaattaactaatatactgtaggaattataacatccttgattagaatgggtacgatcggaagtgattcaaattcatatttgttggttgtagcttctttgttgctagcctccttacgggttatgtgtgtaagtattatcggtgcgtgatgaggctctttttgcttttctggcaattgccttctagtttttactctagtttttatgtgtgtaggtattgtaggtattgtctggtgttggtcattcaaaaagataaccatatttctcttttctcccccttgacatagttagaatgacacaaaaaaaatgcaaacacggaggtactaatagcttgtgcaaaatcagtacagaaaattgctcgcgagagatctataaatttccatatactactaaacaaaggagtaaattaattaaaactgtcctatacaacaaattcaaatttgtctagctagaagtcttggtcgttgtcagggctcatcagttcgatcatcttggtttggacgaagaaccggggctctgttcatctgggcggttgccaataccaaccaaacgaaagaacgctttccggtacggtccatatgcaccccacatggcaccaataaagatgctcgatgaaatggctaaaaacatgtcgcgagaccaccgaaaaccatcaagccctatctccacacgtgcgtcatagatgctacgaattcgaacaattaggagcaaatggaaataaataatattagtatatatgacatttaataatacaaaagataagacatacattacaggacataaagcaacaatatgtaaagtttcaagtactcatggatgcatatacacacacacatgatacctcttaagatgttcctccagccttccgacatctattctttttagatcattgagacacttatcaacctacaaagaaaaatatccaaattcatataaaatataaatgagtgattttatggtacttgataggtatttttttaattaaaaaatagtatttcctcagcttaggtgtagtacgcacaaggatatataccgaattttacggtaggagactatagtactagtatctcttagtacctagtactggagtatcgtatggtaaattaaatctctatagagagtgttctcctactttagccaaacaaccaagagaataaagttggtcatgccatattagtcgtcacactggtggagaagtgctttttagtcccggttcgtaacccccctgtagtcccggttttcaaaccgggactaccaatccgggactaaagatcgctatctttagtcctgggtgaaaaaaccgggactaaagatcgatctttagtcccggttgataacaccaactgagactaaagatccctatcaaccgggactaaagagagggtagcggcagtctatcagctgatccttttttttcttttttattttctcccgaatcgagtggtatgcatatcgtcaaatcaaaccccaaatccacatcacaactccacagcacgattcacagattcaccacaaattcattcacaatatccattcacatattcattcacaacatcacaaatatatccacaatattgattcacaggttcattgacaatatcgagtcacaccctcattcacaacatcacagattcattcacaatccgattcatagattcattcacaaatcaaaacatccaaaccacaaattaaaaaaaatcaaaaaaaaaatcgactcaccggccggcctcccatcccgccgccggccggccacccatcccgccgcttcccctccgaccggatctgggggaggggagggcgag

SEQ ID NO: 75679 - DNA, 875 bp, Oryza sativa
gcgaagacggactctccggacacgacggaatctaagcagaaaagaacaaaatcaccaaaacagcacataaacaagcatgaacagtacatgtggatatttttaacatgtagatctcaattttagaaaaaattagagacttgaaccaactaaatcggagctaagatgaattagttatgaatttttaaagattaaatcggattaaaacacttatatcggttaaaattgaattatgacgcaataatgaattatttttgaaaaggaaaagaaggtttattgcgtcagcgggctagggtttgcggtggaccgggcgcacggcggcggttcacgcgaacggacggccgagatcgaaccgatctaagatggacggccgagatcgatcgggtccacggcggctcacagcggacgacctcgatgacgtcggcaatgacgtcaccgacggcggcggcggctcggcggagcagacggctcgggcggcgcacgctcgctggcgaacgacggcgcgaggacgcaaacggaaggcaccagcacgtagaggacgacgcggcgaactcaccggtgaccacaacggcggcggaaggtcaacggacggcgacggcgacgaggaggaagcggcgaagctcttcgggtcgacgacggcgatgatgctccggcgatcttcggcggcggcgaaggggcggacgaggacggcgacgcaacggcgaccacgatgacgtccttcccgagcgacggcgacgtctggaacggcggcggagcacggctggagcggcggcgacgacggcggcgctagggcacacggcgctagagctcttccggcgacgagaggcgaaggcgagggtggcgacgggtagaggagaccacggggagccttttaaagg

SEQ ID NO: 75680 - DNA, 954 bp, Oryza sativa
gctccgcctagccgccgccgccgtcggtgacgtcattgccgacgccatcggggtcgtccgccgtgagccgccgtggacccgatcgatctcggccgtccgtttggattggatcgaatctcagccgtccgttcgcgtgaaccgccgccgtgcgcccggtccaccgcaaaccctagcccgctgacgcaataaaccttcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttgttgaatttgttcttttctgcttagattccgtcgtttccggagagtccgttttcgccggagaagaatttgaagagttccaaggccagcaaggcaagtcacacagatcccaaacaaccctttgagcatgttgatcctatttaaagctattgtttctattcaactattgcatttattttcaaatgccattgggtggaattaacctattgtttgttatagcccttttgttcttgattaccttattccttgataccttgggttattataacttgactagttgggctttatttattggttcaactagatattagatataattgctcagccctgcttagaaacattagcacactattgggataacttatgactcactgttatttaatgatggcttaatgatagttcacgatggtcaatcgtgattggttaattaattaacgtgccaactaaaacctgataatggtgggttgtgagcacatggttttgatggtcgtgctcatgacaattaaggaccggttcacgagtttcggttgtgaaacattaaccgtgccaacca

SEQ ID NO: 75681 - DNA, 2722 bp, Oryza sativa
tgacgccccgaaagcttcggttgtgattccgaaataggacgtgtttaaatccaaccagaatagttcgtaccaaaatttgaatttgcgtcttagtaatttgaaagttttcaattagctgttgtgaagaagcggaattaactgacggagtgaaatcatcaggagaagcaaatggctgcattcccccgctacatattgcgacctgtgtgcaatgattgtactattaattcgctttggctcagccacgctgtcagctcgcaatcagataatgtaaccaattgctaaataacaaattccagagaaagaatgtgaatggcgtacgctaccatggcggaatcaaccaacgtcgcctcaacaacattaaataaaaacaatcagaatatacaaaacaaaaattgatcgatcatgggaagtggtacaggttggacggctggagcccggcggtgacgttgaagtacctgaacgccgccgcccaccggcggttgtccttgagcatgtgcacgaggacggtgtccggccggaagttgtccatgtcccagttgaggtcgtacatccgcggcctgaggctgtaccggttcttgccccggcggccgatgttgagccatttcccgacgaggaggtcctcggggccgtgcgtgtcgttgtaccgcaggatgtcctcgttggtcgacacccacgtcgcgacgtcccaggacacgacgtagcccatcccgtgcatgaactgcatcgggtcgtcgccgacggcgaagccgtagccgaggtagacgtcgtcgcggggcttgtgccggagctcgtcgaccagcgcggccacgcggaggtacgtgtcgtcgtcggtcttcatcacgtagtcgtagggcgacgacgcgaacatccgcggcacggaggagaggtactcgtgcgtcttgccgtcgttcatgttctccgtgcagttgagcaccaggatgtcgccgtgccgcgcggcctccagcaccaccagctgcgcgtccaccgggtcggccacgcggcagaacacgaagcggacgtccacctgcgcgacgccggggggcaccgccggctgcagcgcgtacgccaggcgcacgatgttgcgacgctcgtaccgcttcggcgtcgtcagcacccccaccagcagacggagctccggccgcacgacggccttcgtctcagcagcagcagcagcagcggaagctgcatctccacccggcgtgacgaggtagccgtcggcggtggatgggccggcgtggcagaggacgccgaggccgtcggagcggacgtgggaggagccgaggctggggacgacgagcaccacggcgaggaggccgagcggcaccagcaggagatacggggtgcagagcgaggcggtggccgggaacccgtgcgacgacgacgacgacgacgatgcggtcttcatcgtaaaaatctcgcggggaaatgcaagtgcccctcgcacgatcgcggcccgcgcgttactcgagctatagccgtactcgacttataaccaggcacgaacgcgcgctggtttagcgatgtgggactaaaatttcagcattttccccctctctctctatctcgtgtcaaaagcgtcggtggaaacgaacggttcttcgcggaagaagtcgtcgtggcaatggcaatgtggcatcacccacgggagtacgcgacacgggctcgatcgatcgatcgtcgtcgaggctgccgtcatcaacggcgacaaggaaccttactcgataagtttactggataattttgggttgtctcgtgccacatgacaggggatgtttcaacggccaacgccatatggtaggtggcagacggccggggatataccccagccctccagagctctagttttatcgccaatgtatggaaggacagctcaggggtacatcgaaaattcgaaagggatttgattaaaataacaagtacacagtgagcaatcattcaatcattcatgctgagattcgaggcatccagcttccagcatgcattgttggcgacttggcgtgatcgttttgagttcgggggcggctggaacagaagaaggtcgctgggaacaggcaagcttgtcggctactactacttgcgcgatagatatgcccggtgtgtgttcaattgttcatgacatgcctgatgccttggctggaggacgatcgaaaccgagatctcaccaacttatacaaatgatggtagattaataggcagggaaattgacaattcttgcggatgcttttgcctgtatgatcgccttaatttgagatcgtgatttttcagtgaaaaaatcgatttcgtgcaacttcgaaacgttgagggttaattggctaatgcagctggtcttctgttgagtaattcaacataagaattctactagcagatcgatatagtgttgacctgttctctctattttgtaaatataaagtttagaccttttctgggtatatggcatgtgttatggcaaagtcggtcagactgatcatacagtgaaaccaacttggtctggtctttctttctcagaatacaacctgaatgtacgcgtacccatgcatgtctacttcaattgattaattaagttttgtactttctagtaatatacggcattgtttacttttggatatgatatttgaccattgattttattaaaaaaaacctaagtaatatttatttagttgtgatttgttttattattaaaggttccttaagcatgactatatatattgttttatgtatttat

SEQ ID NO: 75682 - DNA, 6462 bp, Oryza sativa
gaaatacaatttagaaatagttgaaattcggaattaaaaataaggaatattagaacaggagactagagtccatatagaaatacaaattaggaaataactgaaattcggaattaaaaataagaaatattagaagtagagtatagagtccatatagaaatacaaattaggaaataactgaaattcggaattaaaaataagaaatattagaagtagagtatagagtccatatagaaatacaattaggaaataactgacattcaaaattaaaaataaagaatattagaagtagagtatagagtccatatagaaatacaattaggaaataactgaaattcagaattaaaaataaggaatattagaagtagagtacagattccatatagaaatacaattaggaaataacagaaattcggaattaaaaataaggaatattagaattagagtatatagtccatatagagatacaattaagaaaaaaacagaaattcggaattaaaaaaaggaatattagaagtagagtataaagtccatataggaatttaaaactaactaaaattcggaaaaaaaaagagtctccatgttcactctcatgacctagaaattctcatattaatcggagaaaaagaaaaagcaaagtccatatagaaatacaatttagaaatagctgaaattcggaattaagaaataaggaatattagaagaggagactagagtccatatagaaatacaattaggaaataactgaaattcgaaattaaaaataaggaatattagaagaagagtatatagtccatatagaaatacaattaggaaataacaaaaattcggaattaaaaataagaaatattagaagtagagtatagagtccatatagaaatacaattaagaaaaaaaatagaaatttggaaataaaaaaaaagaaatattagaagtagagtatagagtccatattggaatttaaaactaactaaaattcggaacaaaaaggagcctccatacaattaagaaaaaaaatagaaatttggaaataaaaaaataagaaatattagaagtagagtatagagtccatattggaatttaaaactaactaaaattcggaacaaaaaggagcctccatacaattaagaaaaaaaatagaaatttggaaataaaaaaataagaaatattagaagtagagtatagagtccatattggaatttaaaactaactaaaattcggaacaaaaaagagcctccacgttcgctctcatggcctagaaattctcacattaatataagaaaaagaaaaagcagagtccatatagaaatacaatttagaaatagctgaaattcagaattaaaaaataaggaatattagaagaggagactagagtagttattacacattagtagtttcgtaaagttattgcaaaatttaaaattatgttgtcattgtaatatattttaataataaaatgagaaaacatatatgctattatacgtgagaaaatataatgatgctaaccgcgtaatctgcgcgggccaccatgctagtttttttttttgaatgccaaaagaggtagtatatgacatggtacatacggagtaccttctattagtatcttctcaagcaccgtgatagaacaaatgtccatctatctcgaggcaacaaattgctcaccttaggagccaaactaccgaatgtataataagatcgtaggttgtgatatacaggtttaatgcttgagaatgcaacggacattgctccagtcaaggttaagtacatcttgcactattgttatgcacttttcttttgagtgagaccaccaaaaacaacataggaaatccccaaaattgatatggcaaagctatctgaaatatacagccttgacaaattacgttttgcaagaggagtacaagcaaattacagagctaataacaagcagagcaagcacattccactttggaggctacaagtctactacagcttcaccctgcggaccacttgcatcaaccctaatcgtatgaagaagatggatacaaactttgagttatcatatccatcagccggcgacccccccatcttgaatgctttcatttcctccacacgcggacacaccgtgctgtttctcatcaatccgccaattacaaccacacctatcgttgtcacgaggcgatcaatgacgaatcgatcgaacaggatcaacccgatgatcaccaagaaatcgagcagccgaaatcgaatttgagcgagtcaaaccgaggcacagctcgcgcatccgtgttcgtgcaccgcacaaccaatgcacgaatcgaattaaacccgttaaagaatgtgtcgaacgattagttaattagaattaatcaaacggggaagaaattaacaaacaacaattatggatcatcgaagaggtgatcgatcgatcgatcgatcatggtgagaggtggtgcaggttgatcccggcggtgacgttgaagtagctgaacgccgccgcccaccggcggttgtccttgagcatgtgcacggcgacggtgtccggccggaagttgtccatgtcccagctgaggtcgtacatccgcggcttgaggtcgtagcgattccggccgcgtccggcgaggttgagccacttcccgaccatgaggtcctcgggcccctccgtgtcgttgcgcgcgaggatctcctccgccgtggacacccacgtcgcgacgtcccacgacacgacgtaccccatgccgtgcatgaacggcatcggctggccgcccatggcgtagccgtagccgaggtagacgtcgtcgcggggcttgccgcggagctcgtcggcgagcgccgccacgcggaggtacgtgtcgtcgtcggtcttcatgacgtagtcgtagggggacgacgcgaacaggcgcggcacggaggagaggtacgcgtgcgtcttgccgtggttcatgttctcctcgcagccgccgagcaccacgacgtcgccgtggcgcgcggcctccagcgccaccagctgcgcgtccaccgggtcggccacgcggcagaacacgaagcggacgtccacccgcgcccgcgccgccgccggctgcagcgcgtacgccagccgcacgatgtcgcggcgctcgtaccgcttcggcatcgtcaggacgccgacgagcaggctcagctcgggcttctcctcctccttcggcgccgccggcgccgcgacggtgtagtcctcggcgccagcgctgcggcgggcgcagaggacgccgaggccgccatcggagccgacgcgggcgccgttgagagaagggagcaggaagacgacggcggcgaggaggagcagcgcgagcggggcgaggaggaggtaggagttggacgacgccggcgccttcatcgccatggccgcatgcaaatgcaacgggagacaacgtggttggtaggtgcaatgcagaacgagctgtagtagctgttatacgcgcactaatcaagctcacgtaatcaagaatttccattaagaaattccactgcctaacttggtttttttgtaaacaaatcgtcgaacagaacagctgacaagacaagagttctttctagcttgacgcgatgcgctggccagttagaactcgccacgtgcagtaataacaacacccatcgcttaccttttaacttatctacaaataaaacttaatattgaatttaattttagagttttcaattatgatttattttttacattgatcttttaatcgccaaggacgatatatatatgagtgtgtgtaatagttttatagctttcgaacgattaaacagaaaacatcttctctttttcttttgacagagacggttgctctgtctcgttattgacacaaaggttaagttaatcacgaaacgagtccatatcccatagaggttcagaaatggcacgttgagctgtcgccgttcaataatagcagccgagtcaaaggagagcgtgaagtgccgttcacgacgacggcttccccgctgcgaaatgcctagccttaccggtgaatgatcggatcaaactctgaacaggaataataataataacaataatgcagagaagtttctgaatatgaggcagaaaagaaagccatatggtccctagtagtagggtcgaagcctgtagtatacagataccagtattaatcaaattttagtccctgagttgccgtgccgtgctgtgctatgctcgcacatgctgatggcattgttgtttgtgttcatggctctgaaagtaacgggctaccaagaactgattccaatcaaatcgcacatcgctgtttcatgtgacgaatcctggtcatgggctggtgtcatctccagtcgtgtttcgtccagaatttgtaccgcgttttcttcctgttgctcgtcatctttgtgcttctcggctaagtaattactagcctgtacgagcagaattgttccacggcgaggagcccccgttttcaagccgtgctccccgcgtttctggagacaaagaaaacttgtcgatacccaacagtcctacctgattagctcgaaatcaatcgacaaaaaccggtgaaatccgaacaaattttgcagatatatacactgaacctttcccgtatttagccggcttactgcacggtttctcaattcgaaccgacttgataagattgataaccgcgaccgattacttaccgtcataggagtatctttgagaccctggtcaggtcaaaggtcatcggaaacgactcggaaaattaaacctccaaattcacaagtctccatcccactggtccctggacatggaagaggaggggaccggccgtgtgtacttgtacacggaaggaaccaagcaacagcactgtcgccggatggagtttggtcccggaggaaactgatcgatgaagctccaagactccaagcgccggcgacatcacacagctcgatcgatcggcagcagcagcagctacagaatatagatgcgtcgcgtagcaagctgagctatgccgatgggccctgtggcactaacggttgccaagagaggggattctaatcactcgagatgataatgtagtgatcgataggtcgcaataggcgccaaagccacccgtatagcctagtgatctttaaaaaaaaaaaatctgaattacccttcttactatcgtggtgaatagcagatattcaggtcccgtttgatagagctctaaactccaactcccaattctaactccaactccagtaagagctggctcctatacgagctgagacgggtatagaaagtatttggctagattactcagatccacgccaccacatccctcgtcgccattttgtcgaacaccttgtagacgtcaccctactgttgctgccgccaggcagcccgcgagccgccgctgctggtcagcccccgcatctcctccgccgccccgggccaccacctatcgccaccgccgccaacgcctgccgccgccaacgcaaacgccgctatcacagccacagcaagacgccggaggaggatggggaggaagatggagaggagagacaacgggaggagaagggtaggaaagggtagtttagtggtatttttacgtaaatacactaaaaaggtagtggttcttttgaggtggagtggagttgtggagcagcaaaaacccaactccatcccgtagtataattttgtggagcagctctgctaactctgctctaaaaaaataaagaatatgtatctatcgatgggggatacccgtagaccggataaatagggtattggggtacgttggtatgaggatctacatgatacgacatcaaaacaaacaaggagacaaagattatactggttcaagcccctcgttacgtaatagccctaatctagtttgtatgagattgatatgaaaaatcacagagtacaaagagaacaaaagaatccggcgttactggcgagatccttctctagatgattcgatgagatctcccggcaagtgggcttcgcgtcctcccgctccgtaaactatggtgggggtgttggtgttgtgatacaatgatctgaaccctcaggcggccttttataccgtgagttgccttagtctccaagtagaactcagagacaacaaaccctgcacgatatagaataaacctaatcctctctgaataggactctgataatcacttgcccataaggatattttccataatatcttgtaaattcccttatcgcatacggaaacatatcgtatacatgaaggtataccgtatccgtatattccataaggcgtgggatatgaggtatgccttatccgtaaccatgacagtaccgtttggcacagttctccagataagctggagttgggaggtagagctgtgccaaacggggccaataccatcaacttttcatactagacaattaaccccctaactcctgttttagatggttttgaactggggaggttaacgtggcattccaaggtgtcaaaaaaataaaaaaaaaagtaagtccaccaagggtggtaacaaaaatttaataaa

SEQ ID NO: 75683 - DNA, 6603 bp, Oryza sativa
cgtgttagttattaattatttttaatatcaaattcagttatttgtaaattatatatattcctatatatactctagactcgtcttttaatatttctttttttagtttcaaattttttttgtaaattgtatttctatatagactctatgctcttcttccaatattatttatttttatttctgaatttttattatttctaattgtatttctacgtggattctaaactcatcttttaatattatttaatttttaatttcgaatttcagttacttctaaactatattcctatattgactttaaactcttcatcccatatttttcttaatttcaaattttagttatttgtaaattatatttttatacggactctaaactctacttttaattttattatgtttattctaaattttagttagttttaaattcctatatgtactctatactctacttctaatattccttattttttaattccgaatttctatttttttcttaattgtatttctatatggactctatactctacttctaatattccttatttttagttccgaatttcagttatttcctaattgtatttctatatggactctgtactgtacttctaatattccttatttttaattccgaatttcagttatttcctaattgtatttctatatggactctatactctacttctaatattccttatttttaattctgaatttcagttatttcctaattgtatttctatatggactctgtactctacttctaatatttcttatttttaattccgaatttcagttatttcctaattatatttctatatgggctctagtcttctcttctaatattccttattttttaattccgaatttcagctatttctaaattgtatttctatatggactctgttttttctttttctccgattaatgtgagaatttctaggctatgagagtgaatgtggaggctcctttttctattcctttaataatataactagctaggtggcctgcgcaattacacggctagcacccaaacaaaatcatatatttttttagtatgatttttacttaaaatttattaaatagttatctcattgtcttaagactttgaaagacgaaaccttatcatccttatgtttctaattatatagtttttaaaagtcacaccaattgctaccccttatgtcatctccttctttatttgcttgctcgatctaccattatttctattcattctttttggaacctttaaaaattggattttatagtttttagagtttattgtcacattggatttcatttttataatatcaaaatgtcccgtcaaacgttgccattatactcctctacggcccgtccattgtctcttctctttattgtcattgagattttaaaaatcgaacataattattgtttgggttcatttttactttctaaaagtcccgccaaaccgtcaacggctttgccattgtactcctctacggctaacccgctaccttacttctttattgtcattgaaattttaaaatcgaacatgattatcattggttcttttttactttttggaagtttcaaacctttaaaaattggacttgtagttttattttttataacttttagaagtcccatcaaacgatgccactatgcccctctacagcccgtccgccgccaactctttattgttattatgattctaaaaatcgaacataactatcatttgaattcattttttattttctagaagtcccgtcaaccgtcagcggctctgcaactatactcttatataccccgcccactgcttctcctttttattgtcattgagattttaaaaattgaatatgattatcaatggggttatttttttttactttctagaagtcccagcaaccgtcttactcgtttgcttcacggcatgcctgacgtccctccttttaattgtcattaggattctatttggtgttttattaacaatttttatatctcgtatcaaccgccaccactctactcctttataggcatgtttcttaatttatctcgtcatgtgttttagatggtcttttctttcaataatctttatttttatcacaaattttagttatttataaattgtattcctaattgaaatcttacttttctttttcaaatttcagaatttttttaaaaaaaattagttaatatcgtattgtgttcttttaatgtttttattttttattttcaatttcagttgttttaaaattgtatttctacttgaattttcttttaattttttctaattttagatattattttatttttattctcaattttaattaatctcgtattgggttcttatatggattcttctttcaatattgcttatttttaattctgaatttcagctaattttaaattgtttccttcatgaactcttcttttattttcttttgctaattttggatttatttatttttatttcgaattttaattaatctcgtattgggttcttatatggactcttcttttattattccttatttttaattctgaatttctgctatttttatattgtattcctacttggactctcatttgcttttctaattttggattttatattatttttgtttttaattttgattaatctcgtattagattcttatatggaaacttatttcaatatttcttatttttaattccgaatttcagctattttaaattgtacttctacttgggctctccttttctttttttcttttctttttctctgaataatgtaggaatttctagcttccacagcgaacatggtgcctccttttaaagctgttttaataatataatagatagataatgaatggtcccacatgttaccttcttctcttttcttcccccattttcttcatccccagccgggtagatacggaggaggcagcgagccagcaagcgccctccttggcccgtggaggaaggcgacgatgatagcagtggcagccagccgacggagaggtgagctcatgcagggtgggtcatgtcttccctgtcacgccccgaactagtcccgaccggaactagcccgtgacgcttcaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaaaaactcctcatcagcaggatccgcttcatcttcttcagcaactgggggggaattatttatatagagcaagggtgagtacgggagtactcagcaagccatgggaaataagtgtttaatgcaggcttcaaggaaaggctgatgtttttgcaattaatttttatttgaactcttttctgaaacaactaagtgagtgcttctcaaacgacacggatgagacagtgcgtctcgtccggtcggagtatgtgcaatgtatcagtctttagaatttaaacaaggttagcacccggccaacagctttttcaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccgcatgacattactaacccggatcacccagcccgtggggatcagccacgtcgggagacctccaagctttcatgacaaggcatttccaaagccgacacaggtttaccatacgccgacgagaggggtcccagaccaacaacaggttagctcccagaccatactgtgccaggaagcccaggggtcctccccgacaccaccccggcgaatccacatgtctctcggcatcaaggctcccctgataagctagttactcagccaggggtgtcccattccacccatgtggttgtacttgtcttatgtttggatgaaattccaaggaatcggtccttaagtgcgagagcgggaaaccgtacacccggtacgtttcccggtccgcggttttggaaattcatttagttcgcaagcaccgacccaggtgtcgggttttccaagtcttttgtaaaactccagttttacccaagttattactcagattttaagtttgaaggcgaccgtcgatactggcacagggtgcacgaatatcgaggcgcaactggatggttacaaggggacatagtatagcaattaacaatggaaggatcaaatgcaacaagttaggtaggtctgccaatctgccttgcagacggaacaacagattaagtgcaatcctatcaatgcataatattttacaagcaatataattagatttcaaatataggctcaagatgttcaaaggtggcttgccttgctcgagatctggagcttgatcctcgaaatcctcgcaatgcgggtcttcgggctccgaaactacacgcgaaacgggacaactcaacaaacggcgaaaatgaaaccctaataatgacctctaagcgtgccattagatagatctcgagatttgaggaattttggaagttgaacggagtcaaacggatctaaggttaggaagatattgaatttctaagattattggattttttggtcaaaaagaaaaggatttaattaaatccttttttggaaaagaaaagaaaagaaaagagggagggattatagacttttcctcgggcggctaaggcgcggcccaagggaattggagcggaccggccgagttaaatgggtcggccggcccaaggcggcccaagtgcgcgcgcgcgggagggaagagagagagagcgccggtggaccgggctcaccatgcgcgatcccgggtgggacccgcttgtcagcggcttggctcaccgtgcggagggagtacgcggctcatgcgcgcgggcgggggagggacgcggtgcacgtgcgcggttcgcggtggatgcggatgcggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcagcggcagcgagcggcggagcgaaccacggcgatacggacaaaagcgagcacaccgggcggttgctcgtgatgaggggagacgagccaacggctcggatttgccggaggaagcttgacggcggcgaatcgcggcggcgacaaccggcggggagggaagagggaaacggcggcgaggccacgaggggtcgattcccggcggtgagagcatctacgcggtttcgggaactcgatgctagcgtcggattggacggagctacgccgagcaaggctggtgacgtgtgagtgctacggagctcgagcggcgacggcggcgagcacgcggcgagcgacgacaacggtcggggtggcgccggctaactacggggagtctactcgagctactaccgaaagctagggggaggagatggagcgaggaggaagaacagagggaggcatcaccgagatgaggaggggcgctgtgacgagaggccgacggcgcgggagtaatctctccggcctcgggccggggaagaggaaggagagggcgcggccgaagtccccttccgcgtccttactcgtgccgactccttcgacacgcgcaacaacgaacggcgacggcgaacagagcacgggggcggcagctatggcgaggaggcgaaaacgagggagattggaggggaaggagctggggtttaaagggggcggcaatgtcggtttgggaaccgacttagggcggtcaaggcgcgagctggcactcggcggtcgcggccagagcggcgacagggaggatgacgccggcggggggaaaaggggaaaaaggagggggagaaaggggcttgcccttttgccgattcgggaaaaaggaggaggggagcgggggcgacgcggcagagggaggaggggcgctgcctccatcccttggcggcttgcgcgcggagtggcggggccgggcggtgacgacagcgatgacggcgggcggtttggagcggcgcgacgacacgggcgacagacgcgtgaagaggctaacggcggcggcgaccgggcggtcggccactcggcacgcgcgtgcggcttgcaacgggcggcgtccgcgcgggcgtgcgcacgcgaacacggcgcgcgggaagtggcagtgagggagcggagagggaggacttcgctcggcgcgggcggctcacgcgcacgcacgcgggcggagcggaggaggaggagcactcggcgcggctcttcgcgcacgcgcgcgcggcgcgcgggcgaggtggagcggagctgagcgggggggggagcggagcgcgccggggaggggagagggccgggggagagggggagatg

SEQ ID NO: 75684 - DNA, 19214 bp, Oryza sativa
  unsure (1)..(19214): unsure at all n locations
cccccccccagggggagatgggccgggaggaaatcggcccatcgacccccgggggaggcaaaatagacttttgtggaggaatttgatttggaaggattggattcgggattggactcgacgatagatcggggattgagatcttgagatggcacgaacactagacaacaagcaaagaaacaaatttcgcaattagggtttttaagagataattttcccgctaggcgccacgacggaacgggcgctacattccctcctcttccatggaggccgatagctaccgagctagaggactccaacaacacaggtgtttgctagctgcggttgcctccagtcttctcccttcttccttcttccctcctcccctcttcacccctgccctcaatctccaatcaagccagcaaccaagccgattgccaaatccacatcccgttgttcgttgaggttccctcctattccttctcctccggccgacaagagaggagatggaaggagaagcgtgggcatcactggattcaccacctcgaccctcgcgtcgtccacttcctccctcacctctctttcttccatcccccatctgtctgggctccatcgagctcacagctaccaaactgcctactgcttccagccctcctcaccgccgtccgccgcgccacaactggccccttcctcgcgcagcccaccatctccagcgccttcctcgccaccgttcaccatgccctccttgccgccgcatactcccgccttcctcaccattactaggctcccactgcgttgcaaccccttcctcacctcgacccgccacctccaacgtcctccttgctagcgtgcgcagcaccctttctgctgttcccgccatccccgcagcgcctacatcgccgatagagagataaccgaaacaaatgaaaaacaaactcgtaactgaaaaacgatgtgtggtcatgtgaagtggtcttttaaccgaaacaaatgttagcttggtgattataagcataattaggaacaaaagaagggatggaaagctattgcaacagttcgcgaaattctcacgcacccgaacacccgcgagggcactacgcgtcgagtgcccgatctggggtgcaaaaaatcgggcgcccacgtcagctgaccgtcagcatgcatgcatgcaaaactattttaaactattttttctcttaagttatttatccaaatcatgatccgattgcaccattaaattcattgcaattaaatttttaaaataagaccacacatagatatattacgatgacaaaaatttagcttattattgaattgtttttaaatgttgcacactgttacaccaaatatatcggaattgtttcactaagtagatcgaaaatgtttcaatcgtttaaattggatgttgtttcaccttatataaaaacaaagtttcagcaaatagcgaaagaatgtttcaattcactgcaacatttaatctatacatagtgaaacatcacgagtacactaggtgatacatttttggtggaacaaaaaataaaacggattcacttaatagagggttttcataatatgtgtgtgatttgttgtaaaagaatgtttcaattcactgcaacatttgattcatacacattgaaacattgtgagtgcattaggtgaaacatttttggtggaacaaaaaataaaacgaattcccttaatagaggttatgtgggtggtttgttgcaatagagtatgtggtggagatacatggcaggtgggggcaggggcacgtggtggggcctaggaggcagcacgcgtcacgtggggagggagcgtctgatttttctccttcccctgagcgaccgacgcgaaggattttggacaagactttacccggaattatactctgttttaaaacagagtaagaaatgagggagacaaaatagacatatttccaactgattgctgatgactcgttgttcggttgggccattctgatcccagaaggatggcaaggcccagaaatacataaaccgtcggcgttgaggcacttgtcccaccgggcctggtttaatttcgatgtaactacacattcgtagtcggtgagactaaggctctgttcgttatgaggagataggggagattgattctcgttttccgcgtgcacgcttttcaaactactaaacggtgcgttttttgcaaaaaaatttctataggaaagttgctttaaaaatcatattaatccatttttgaaatttaaaatagttaatactcaattaatcatgagttaatggctcacctcgttttgcgtatctccccaatctcctcaatccccttctcctcaaacacaccttaatagaagtgagtgatagcggagtacattgttgtgtccagccaatatatatagtgtacatccatttctagcgattatgccgtttgtcactggattctagttgtgtggccttgccgctgtggatggctttatgccgacggtgacgttgaagtgccggaacacggcggcccaccggcggttgttcttgagcctgtgcacggcgatggtgttgggccggaactcgtccatgtcccagttgatgtcgtacatccgcggcttgaggttgtaccggttccgtcccctgccgccggcgttgagccacctgccgacgaggcggtcctcgtgcccgcgcgtgccgctgcgacgcacgatgtcctcgttggcggacacccagcgcgcgacgtcccaggacacgacgtagcccatgccgtgcatgaacggcatcgggtcgtcgccgacggcgtagccccggccgaggtagacgtcctccgcggcttgccgcggagctcgtcggcgagcgccgccacgcggaggtacgtgtcgtcgtcggccttcatgacgtagtcgtaggggcacggcgcgaacaggcgcggcacggaggagaggtacgcgtgcgtcttgccgtcgttcatgttctcggtactgcagccgtcgagcaccaggatgtcgccgtgccgcgccgcctccgccgccaccagcaccgcgtccgcggcgtccgtcacgtcgcacagcacgaaccgcacgtccacctgcgcccccggcgcgggctgcagcgcgtacgccaggcgcaggatgccgcgccgctcgtaccggctcggcgtggtcagcacccccacgaggagtcggaactccggctccctcgcggccgtcgtctcagcacctagaccgccgtcgttgttagtgttgtcgacgacgggacgggagcgcggagcactgaggcagccggagacggagaggacaacaaggctcgacagcgccatggctacgagtccgaggggtaggaggaggcggaggcacagcgagcaaaacgaggtggccggaaagcgcgacgacgtggcctgcttcatggctcccgaatcccaaccggcgaaacgagacgacgagacgaacgaaatggcctggttacggggtgttgcattgcgcagttatccagcttatgaagcagcggaagatgacgggtggacgtcacactcattcattacatgtcaattataacgaaaaaaaataacaagatagatcaacatctaatatatcaattcacaaacatgtgtttttacaagttgtaacaaagataacaaatttaattgcaaatatacctatactaattttgagttttatttattattcttgttacaattcgtaaaggttgaattttaacttgcatctatattgcatattgatgtatcttatcatatttttttatttttttcgtaattatttaaatggcatacaataaacgggagaacatccacccatgtgattaaaagagtttcctggcatgatgatggaggtggattttaaactctcgagagaatacctcctcattaatcgtatgttattcaaataattatgatgtttttttaaaaaaataaaagtttgtattaacacgtgatatatcagttaattaaaattcaacttttaccagcaagaaaaaacattaaactacagctagttaacgtatattcataacgtatattcatagttgaatttgttttttgcattgcaatatgtactagttaaattttaccttgcatgtttatgaagtaatttatcatatattaatttatctttttttattttaaaaataaatcataactatttgagtggcatgcaagttcttaaatgtttataatagttccgtgataatgtccatacaatttgatgataggagaaggctaagtcggacagagctcctctaacgtaaaatcagagagacgtgggtcgctgataggtgggtctcacctttatgggcccacacgtaagtgaccacgtccctctgactttctgactttatgataggagatgcttctagcttccggctcagtcacagtcacacagtaccacgaacgaaagtggtttgactatatactaattgcaaaagcaacaaacaacgatttgttatgatgtatacgtaccacatagtagtactacatctgaaaaaatctgcccaaaaagttatgaagatggagattaagtaaggacatctaaaacaagaaaatcatttgaaaatgataaattaaatttaaattactacaaacctgaaaaaatagatttatttaaatattttagagcaacaactatacataaagtttttttttacgaaatcacggtttaaccgtttgaaaaatatgctaataaaaattgagataaattttgtattttaatatgaaacggattatgaagcttaggacgagatatgcggcccgtgcaactgcaagcgaaaaggaaaaatcgtgaaaaaaataaaaattccaaaagtcgaaaaatacacccactaccggttcgccgtcgtccttaagccttcgcagccactgtcgacgtcgtcctcctcctgtcacggtgaggaggcaccgggagggccacagccgacggatcagggtgggggagggcaccggcctgcggatccaggcgggggagggccgccgccagcggatcggagcaggggagggcaaccaccggcggatccaggcgggagagggccgccgccgtcgcccatgccccccagtgccgccgccgtagtctgtgtcgtggggtggtgcctgctcccagcgcctgctcgtcggccgcaccgcccgttgcccagtgcctcccgctcggtgagagaaagagagagagaggagacgaagagaaagagagggagaggagaaaatgagagaaagatagaggtgaaggaagagagagggggaaatattagagaggagaaagaggagaggataagaggtgaaaattttgaagtggtgaggagggaaaaactgtaataaagagaagataattttgcatgcgaatctttaagagatccgcatgcagatctttaagaggcccgcatgtgaatagacttatttttacatgcgaccccttaagagacccgtctgtaaaaatagaattttacatgcgggtctcttagggagtcgtacgttaaaatggaggtcgatttttgcagacgccgttagttacggttcatctgcaatctaaaggggtcctcgtacagaaagattgttttcctaccagtgttatttaggagtttgagaataaatgcgtgtgcgcggaaaacaagaaaggtgagttgggaaaaaagagggaagaacacagcctacaacaataaatttcccatttgaaagaagaggtagcagagagatagaaacatgaacggagagatagtaatcacaaaataactcaaatcaagaaaaaaaatactcctatatgacaacatatttttttaagtagaactgttacgattcgacgtgagcgcgctgagcaagagaagggtgttgcagtggagtggaatgtccggttggccaagcttgtaacacaattaaacaagcctggcctctgcatgtgcatgtgctcgcttttaatttgcttgatatcgactcgctcgtactagttttacactattcatcctatttcgtcttatttaaaatttttttataattactatttttattattattagatgataaaaacatgaataatattttatgtatgactaatttttttaaaatttttcataaattttttaaataaaatgaaaagttaaacattggacacggattttcacggctacatttattttgggatagaggtagtatacgcttgggatcgatgaacaatcgaacatgttacgtacactggtcacctcaccgcccgttcctacggatcgagaaatgtttaatttgcagctttacgtatacaacaatcaaaagaatacaaatctcacgaaccgaagttgactcggctcaacaaaaaaaattcaattgcggtaaaaactcacgagatcgatatatcgatcaacctaaatcaccgggtagaacggcttgagcgcggcggtgaagttgaagtactggagcgtcctcgcccaccggcggttgtccttgagctggtgcacggcgatggtgtccggtatgaactcgtgcgagcacgggtgcctcccggggaagttgtacatggccggcttcacgtccacccggttcctgcccctgccgccgcgtcggagccacgagtagagcgtccggtcctccggcccgcccgtcctcccctcgatctccgccgccgccgccacgatccactccacgaggtcccacgacagcaggtaccccatgccggacatgtactcgttcgagccgcggacgtagtcgcacggcaccatgcacccgtagtagaggtcgcgccgcggcgctcgcgacagcgactcggcgagctccggcagccggaagaaggtgtcgtcgtcggccttcatgacgaagtcgtaggcggcttcgccgccgccgaagaggcgcggcacgctggagaagtaggcgtgggtcttgccgttgtccatgttctccgggcagtcgagctccaccacgtcgccgtacgccatcgcctccagggacaccaggacgcggtcctccggcgagccgacgcggcagaagacgaaccggacgtccacgcgcgccctcgacgccaccgccggctgctggagggcgtacaccatccggagcaggtgccgccgctcgtaccgcgccgggagggtcagcacgccgatcagcagccggaactccggggccgcctgcacgccaccgccgccgccgccgccttgatgatcgccgcatgcggcggcgccggccagcgaggcctgcagggcgaactcgttggggtagacgaccaagagaagggcggcgaggagtgcgacggggagcaggaggagcgccgcggcggggacgggcggcagcggcagcctctgcggcttcatggcagaatgcgtgcgtacacggtgtgtggctgtggcccaaacgaagttggttttggcagaggcagaaatggtggtttttctggggatttttgcagcaggttcacgcggtgcggagggaacacacgatcgagtacaggctgctgcatatttgcagcggagtagagagcacatacgctgtgaagaagtatagtgcaagcatatactcccttagtctcataatattaaaaccttagactggatggaacgtttcatagtacaacgaatatggacagatgcatgtccagatttgttgtactatgaaacatcacatccaattctagattgtaatattatgggacgaagagagtaacaagtcttcttcgcctttgcgtggaatatagttgtggacttgtggagctgtggtggactggtggtggcagaggaaccttggtagtagtatttggtttctcagaagtccattggccgggccatgcttcgattcctggatggcaggccatatcatttgcatgaaaaagggtccaggttttaacgattcacaagtaatcaaagacggcatgacacgtagctttctagactttttaccgaggaaacctgcacatgctcatcgcctcatccgtagcacattgccatttgccagtgcgcccagcgcagcccagcccagagctccaaaaataccaaaccaaccaggcaaggctgtgccgactgccgaaatccatcacggcgcaaaactcgcaaagctcgcgccgcgcatagtccaaaccgcgaaaatttcgctctcccaccacgaaatccccaaatttccccgcgcggtctccactctacactccccgaaaccaacctcgccgatccgcgcctccctcaatccaacggcccacgctgcactcctcaccactcacgcggatcgctccccatccgacggctccccactccccactcccccacccaaatcctatataacatcgccctcacctatctccccaatacagatcaaccaaaaatcgccaccaaaaatccccaattccatcgtcgtcgatgtcggggcgcggcaagggagggaagggtctcggcaagggcggggcgaagcggcaccggaaggtgctccgcgacaacatccaggggatcacgaagccggcgatccggaggctggcgaggaggggcggggtgaagcgcatctcggggctcatctacgaggagacccgcggggtgctcaagatcttcctcgagaacgtcatccgcgacgccgtcacctacaccgagcacgcccgccgcaagaccgtcaccgccatggacgtcgtctacgccctcaagcgccagggccgcaccctctacggcttcggcggctaggagccttttgcattgtgtttgtcttgttaggaatctgcttgtttcggatgtagccctgtatcctgtaatgaagaaaatgctagcagtaaaacttgtttgaattcacctatgaatctagtgcgaaattctgcaatcacaaattcttcagattaattttgctgggacatgtattgaattacgaacaaactgctaatttgaccggtagtttgagacataaaccaaggaaaatctgaagaactttgaacttgctgtagttcagttctcccattcgagagcgaaggctgactcgaacgacgcacggtcgaacaccgcagggccgaccccggtgtcgccgaccagcagccgcatgagctcgccgacggtgtcgaagtaccagtcgcacgggccgtggctggcgtccttcaccgccacctgcatcatggcacgctgcgcggccaccagcgctggccccagcggcgggaggtcggcgcagacgaacagcttcccctccggaaaccgcgcccccgacgcgaacggtgccgccgccgcaccgacggcgaagaacgcgccgctcagcgagcgcgacaggccgtgaacgcggagccggaggtcctcgtgggacgcgccgagcagggcgcggacggcggacaccgccgccgcgtgagggacccagcggagcgcggacgcggcggccacggcgggggccgggttgtagccgcggaagcgagactggaactcgacgttggagaagaacacccagtgggacgagaaggccgacctgaacagcccggcgtcgccgaccagcagccgcatgacgtcgcggacggcgtcgtagtagcagtcgcacgcggcgtggtccgcttcctccgccgcgacacgcaccatcgtgcgctgcgcgtcccgcagcgccggcccgagcggcggcacgtcggcgcagacgagcaccgccccctcgttccccgcgccagcgaagaagacggcgctgagcgagcgcgagagctggtgcgcgcggaggcggaggtcgtggtgggaggcgccgagcagggcgcggacggcggagaccgccgcggcgtaagggacccagcggagcccggaggacgccgggccgtggggctcgacgtcgtcgtcgtcgtcgtcgtcatcggtggtggaggtggagtacccatcatcctcctcgctggcggcggcgagttcgctcccccggtccaccccgtgagccaccacaaccatgctggtatcgaacgtaatggcgtggcgtcgtgcggttactcttgtgcgtagagggagctgtgactcctgggctgttgatcactccatggaccatgttccatcccgttgcgacttgcgacccaggggcggagctataacgtggtccgtgtggtccatggaccaccatagaattctggtccatggcccattacctctatgcgctacttaaaaatatagatggcactttgacgctttgttttttcgccaattcaaccaccgcgtcgggcatcgggcgtcggcgcgtcgcttcgtttccatcgcaattgtcgtttccaattttcgagcgcgcaagtcgacgagtcacgacgaccactgtccattgaggcactaacgagtgagttgtgacgtcgccacgtcggcggccggcgactgcgccaccgcgggcagcgaccgcaccagcgcgcagtgccacaggccagcagcaaccagcagggagaaagcaatcagcagcactccattcatcaggaggcacgcaacaccaaagcacagcaaacagcacgttagcaaacagcactatagtaggttctcaacttctcatctgcttctctctttctcctccctaacagtagggtttttttttctttaggtttaaatgttcaatctcatttcaattttaggatatccggtcgattggaattggaatggtaaattcaaattaaaccttacaatcctatataatctatggtagatttgctgaacaagttgagttagaccaccatatcttaaaaacctgggtacgccactgttgcgaccgttggtcccgagacgacgcgcgagcctcgaggcagagagagagtgcaggactctcatctgtcatttccatttcatgtgcagaagtcagcttttacaggtactttctcggtttctccttctggttgggttggcatcgtctgtctcggggtgatacggcaaacttcgccgttttttcatctcgagcatccaaacgtgaccgataactggatgagcaaatgttcgatggttgtgtttagttcacgctaaaagttaaaagtttgattgaaattaaaattgagcaaattgtttagtttcaacttttctgtcacaccaaatgtttggacacatgtatggagtattaaatgtggacgaaaaaaaaccaattgcacagttcgactgtaaattgctagacgaatcttttaagcctaattacactatgatttgacaatgtgatgctacagtaaacatttgctaatgacggattaattaggcttaataaattcgtctcgcagtttacaggcggaacctgtaatttgttttgttattagtctacgtttaatacatgaaatgtgtctccgtatacttaaaaaattttggcacacgaactaaacacagccttggacgttaccaggtttacgattcctagatgatctttcgttttgggctctgacggaatgacagttttcacgaaattcggtggaaagccaaaattccgaacaaaactccggcgattccgaacaaattttataaaccaaaatttaaatacaaatttcttaagtttaccgataagcttgcgaaaaccgataggctttggtgaaattctgagcgaaatcatcaaaatttcaatcgataactagaaaaagaggtaaacagattttttttccttttttaattctttattattttctttcctattgtaaatttcagtaaatacacggaatacatcaattttttcgaaaatttatatcccaataagttctatgaatatcatactatttataagattttatttgatttttttcttttttatcaattcaaatttaaatttggataaaactcatcgaaatctcagacggcttctactttgagccttgtcgaaacctcaaaaattcgcgggattcgaccggttttcgtcggaattgtaatccctggacgttactaatctacgcatcagttgaatggagaatctaataattaataagaagaagaaatgtgcaagtatgagcatgttagaaataacaacagaacaacactgaggtggtgatagaatctcctaaaagataaagattaacaatttcacgtaaaacgaggtggtaataacatgtgattaattgagttttaattattacaaaattaaaaaatggattaataacaactttcatatagaaagttttcgcacgaaatataccgtttagcaattcaaaaagcatgccacgagtacctaaaaatttatctaatttatttttacagaaaagaataggcctgaagtcatacaactaactgaacaaattatggaataaaaaagaaagctggctaggatcaatgtcaaggaaggccctaagcgtcggatgcccgatgctttgggaaaaaatcgggcgctgacgctagcatgacgtcagcgcccgatttacgtgtaaaaactactttaaactgatttttctcttaaattacttatctaaatcatgatccgattgcaccattaaattcgttgcaattaaatcttcaaaacaagaccatacatggatatattccgatgaaaaaaaattttagcttattattgaattttttttaaatgttgcacgatgttccactggatatatcggaattgtttcactaattagataaaaaatgtttcactcgtttaaattgggtgttgtttcaccttatataaaaataatgttttactacctccgtcccaaaatgtaactatttctagcatagcactttgtcccaaaataaagctatttttctacctaccttctcctctcaaccaatcacaaccattctttttcacctactttctctttttaaccaatcacacatcttcttcaatcattctcacctactttcttaatacccgtgccaaccttaaaaatgcttacattttgggacggagaaagtagcaaatagcgaaacaatgttttagttcactgcaacatttgatccatacatagtgaaacattataaatacactaggtgaaacatttttcgttggaacaaaaaataaaacgaattcccttaatagggggtttccaaaatctgtgagttttttttgttgcaatggagtatttcagttcactgcaacattagatttatacatagtgaaacattgtgggtacattaggtgaaacatttttggtggaataaaaaataaaccgaattcccttaatagggggtttccaaaatatgtgatttttttttcaatagagtatatggtgaagatatgtagcaagtagtagggacatatggtggggtcccagtagaagcacatggacacgttgtggaggggggaggaggggagcgcccgattttctccccctcccctgggcgaccgagcggcagcattttcgcaatgtcaacgcacgtagaattaaatcttaacctttttttacattcggacaaaaatcttaacctttttctaattgaagtaaatcttaatttaagccagtaggaattgaaaggatgtcatggttgtaattggtgctgattttctgaattcatttgatcccgaaataggtactgcaggatgatgttaggtgcttgtcagatacggtggttggaatccagccataggtcatgtatggatgctctgatgaagcaacggcaaagtttgccgtatcagcccaaaggccgacgatgcctggttagaaattcatgatgagtgtttggatgactttcataagtgtgataagatttctttttttaaaaatattggtaaatccaatattttttttataaatattggcaaatccaatatttctctttagtgactctaaatagtatagcatgattttatttagattatggcttggattttgatgaccttacctttgacaagtttgacgaagaaaacatgataaaccttggcaattatagattgtgaaccaaacaaccactcattgtttcatgctttattttgttttgccacttaggagtaggctttttatgaaaattcagtatcccatactttattttgtttcccatttaggagtaggccttttctactactccctctcccaaaacataaaagattttgattggatgggacatattctagtgctgtaaatctgaacctctgtattcatgatctgctatactctccatggaaaaaaaaatgatctgctatactcaaatataatcatgatcgagaaaaaaaaatcatgtacagttacataaacacatacgtacagccagtatacaaacgcaaatgaaaactaaggcacacagcacgcgttcaactctgatcaatatctgatcaacaagcgagttcatgcgtacacctcgcaacatttccactcgtgtatagtgacagccgaaactctttcgccatccaagatatatccaacgaaacccccctacctgtcctctcgacttcctccgatccgctacgggtagctagggtcgttcggattcaagtgaagaagtcgtacttgaccggcgtgccggtgggatcgatccatggctttgcgtgcaggaagttgtcgacggtgaacttggtcgcgtccgccttgctgatcaccttcttgtaccccggccacgcgacgcgccccgccgtgtcggcgccgggccccttgttggcgtactcggcgtagtagagcgtcttgagcgcgaactcgccgttccacggcatgtacccggccttgtcgatgatcgccgggatgtcggactccatgatgacggtgcgggagaactcgcgccacggccggccgaggtagttgcggatggggggaagcttggcgtcggtgagcgccggctcggcgttgaactcgcacttctggagcacgaaccccgtggcctcgcggccgtcggcgcggccctgcgccgtggcgatgttctgctggttgtccatggggcggcggagcgtgaggacgcagttctggaacacggcggcggcgtcgccgaagacgaagtcgatggtgcccgtgatgacgcagttgcggtagaactgcgccttggagtgcgcgtacagcgtgtcctggaacccgtccatccagcagttgaggaacaccgacttgtccgactgcaccagcagcgccaccgcctggtgcttcgccgcccccgccgtgttctggaaccccatcccgatcgccatgaacccgtccccttgcgccgctgcaaaaatcgccatcgatcacattgcgcgtcaatggcggaagctctgatattggtttataccgaaggttgctgtcttgaaggtggtgaggccgtcggcgaagttcttgctgccggtgacgatggacttcctggagccgtcgccgtacatggtgacactcgccatcttcttggtgatggtcacgtactcggcgtacacgccctccttcacgtagatcacgtaccttccactgtaggtcttgggcatggcggcgagagcttcgttgatggtcttgaacttgccgctgccgtccttggcgacgatgacgttcggcgtgaggttgttcttgaacccgccgcccttgagcaccctccggtcgccgtcgggcacccactccgggatgccgtcctcggcgagggccaggtgggggtccgctgctcctcctccgttgtcttcttccccggcgagcagccggcgttgggagcccttgagggcggagaggaacgaggaggccttctcgatgagcgccagggcgttgctggtgaactccctgccgttgttgaacgactccttgaccttgtccctgaactcgccgtcggggaagccgtcgatgcaggtctccatgttggcgatcaccgcgctcagccagacgcggagctggaagccctgtttgaggccgtccttgccgtcgatgcccttgagcgtgcagttgaggtcgtccttggcgtcgtcgaagagctccttgcagtcggcgacggcggccttcacgcgcgggtcgttgctcatgatcaggtcggcgcggncgaacgcctggtcgaccgcgccgccgatcacgtccacggcggtgcggatgatgtccttgggcgacgacacgctggcgttcgccgccttgccgatgctcgtggcgcacgagtccgcgaagtccgtctgcgcgcacatcatcttgatgctcttcgacacggcgcgcaggtccgctttgccgccgccgccgccgccgtcttcgtcgtctccacctccgccgcctttcgatttccccttcgacgagcccttggagccgccttcgtcctcctcggatttcttcccgctgtacgtgatggcggcggcgcccatgacgatgaggataatgatgatggacaccgtgccgagggcgatcatgatgcgcctgcgctgctgccgcgccttctcggcgcggcgccgctcggtgagcgggccgaagtcgccgaacgccgacgacatggccggaatctatccctagctcttctcttcttcccccactcctctttctcctcctccttattgactgcttcttctttctctctcacactctctgcctgacatcaccattggcagagaggacggaggaggaagaaggccggaggcattggagaacgagggttcattcatgtggccgcgctgacgcttcccgggaaaaaagaagggcccggagacgattgtggaagctatgtttagaagctttggcatgcaacaatggccgccattctcggacgctcccgccattttcttggaggggtcaatgtactctcttctctgcgagaaagctccatgaaaattttggaatacaaggattcttctgcgtcaactagacattcaaccagaaagtatagaagaattcttctacgtcgactagagattcaactagaaaagaaaatagagacggcggaggcggcgctgcgtgccgccagaatcagggaagagcggtaggactcaaactacatattttacaaacgaaaaatatactgcctccgttttttttttatagatgacgttattgactttttctcacatgtttgaccattcgtcttattcaaaatttttatgcaaatgtataagatataaatcacatttaaaatactataagtgataaaacaactcataacaaaataaattataattacgtaaattttttgaataagacaaatagtcaaatatgtgagaaaaagttaacggcgtcatctattaaaaaatgaacacagtatgtgtttttagcgatctaaaagcaaatactggaaaacaaacaacgacaaaaaactttaaaattaactctaaatctaaaattaaaattttaaaactttgctcgtataagtataagcgaaaagatgagtagtctcgatccgatctgacgatcgaagtgacccaaatgggctactttcataggcccatctgggtgacttgggccgttgaggaagcccatcgcgccgtccccgacacggaccaggcggcccagttgataagccgaccgaactgagccgccgggctgcggcgtccccatcgtcggcgtccctttcttcctcatcaacggcgagcttccaattatgcaaccagggtataactataaattctatcgtttctcgggagagaggaaagagcaatgatttgtcgagctgtccctgcctcctcctgtccatcactctactgttagaacgagatgaaacctctacctcgagtggtccagcagcagctgcccctgtggaattggttctccggtccgctttcacttccaacagggagcacagcatcagtgatgcctaccgcctcatcaatctgccggggggaagattaggcggagaacgcgtcaagcatccaaatccatgtcagtatcagtgtagcaagatcgagcggcagaggcctctggttggaatgtaacgggtcgaatctactccctccatcccaaaataagtgcagttttgcacattcatgttcaacgtttgaccgtttgtcttatttaaaaattttttatgattaatatttttattgctattagatgataaaacgtgaatattactttatgtgtgactaaatattttcaaaatttttacaaatttttcaaataagacggacgatcaaacgttgggcacgaatatccacagctgcacttattttgggacggaggtagtactactgatggattcttgcacgagtgagaatctttgatcttgatgaggagcttcttgatcaatgatcatcctctggaattttcagatttgcagttgaaagatgcgcggtttttctttttttttggaggagtttcttttgcgtggcctatagattcgtgcctgcttcaagtctgcatcgtccagttgtaagtacaatgggggtgttgcatcttttcgtgtttggccaaaagagaggaaaagggtaaaggagattcgtgcctactaataacttctgcagttcagcgattctctagaggtgacaagtcacaactcaaaagtgagcggcaacttggccaattctcgcagcagaatagcagtgtaggtgtagcacagtagcacatgctggttttactgaactgaacaatgagcaagaaaaacgtagaaaaaccaaatcattttaagatttaagtggatgatcagcttaaattactgcaacatctgggatccagaagagaataggagatgataaagttcctgtcaggaagtatatcatgcacattaagatttacgatcatgaataaaaacgttgagcacaaacactggatcctaccaccgtattggtgcgtcggaaagcaaagtaaaccacttaaagagaaaattctagatttatgggtgatgtgtgattaggactgcaggattatcttgatccaactggtgataacgcactcgtctgacttttttcccgggatttgctgaggaaaaaccacggttagattccacaattgccgcactaactccattgttcatctctagttttactgaccacactaactctgtcaccgtgtctgttccatgatcggttttagcaagctcatgctttccttgaaagaacaaacaagagcagagaagagaaaagcaaggcatcaactacagctttaattctcactcccacaaaataccaatcattcatcagcttagctagctagctagcacaatcaacattgctgtcaaattcccagcagcatcagttgcatcatcatctttgttaaaaaaaaattgtatcattatcatcttttttttaaaaaataatgaaattgatttacatcccggtctctctaccataagacacataaccaacgagttttgatacctaaaaatcaaaccatataaggtgaagggaaaaaccctcaactccctctaaacaagttcaattgaaaaaacattccaaaatcaaataaattctagcatgtcattcggtatatgctaagtcagccaaagtggaataaaagaaacttggctaccaattccaataaccgaaaattgaccatttttaccatcatttggccccaatttcagatattaagaagataattatatacaatactaattacttaattagtgaccagtgatcacttgtgtgtgtggacagagtggctttaaata

SEQ ID NO: 75685 - DNA, 4964 bp, Oryza sativa
ggcgacggccatggcgatcacggtatcatcagtatccaccagcagcgccttcgtgtcgtcgggctgcagatcgtcctcgcccagacgaggcaccaccaccgccagcagcacggccatgtcgtcctcaagcagatgcagatggtgtccccgccgccggcggcgcgtcaccggcggcggcggcgtccttgcggtgacttcttgagcgcgtgctccctgtgcaggctggagctcggccccgacaaggacgtgtacatgtacaggtacgtacgtacggcaacggcacgccgacgacatggccggcggcgggccggcggctagctggagctcgatcgatcgccgcctgaattttggggtggtttgcttggatgcaggggtgaacaggggttctgcagcgaggagtgcaggtggcagcagatcatgacggacgaggcgagggagcgggacgccatggccaagaaggagcggctaggcctgcatcatcggacgccgcggccgccgccggcggcgatccgcggcggctcgccgaggagactactcgccgtagcctagcacgagcgaagtacagtatgctatacttgatgagaccgtgacccatgcttggatgatatatgatcaaaagaaaattttctactgtactctctgtaaaatatggagaaatcgatgtaattaagaaaaacttgataaggaggaaggagagagagagagagagagagccaggttttgagtaatttgaggcaaatttgaggaaacgtatacgcataactgcatgcagtttcatatttcaaatgaacacgaaatgtttggtgggggaaagaagctttccaggtctcatgggtacaagtgtgcaacttaactgtaacctgctcctgcttatgtgcaaaaaacctggtaaattctggataaattagtttcctgtgcgtgtaaatttcatctcgattatttttagaggatgcgaatgattctcagtcgagtagaactcgtggaatgattctgaacacaagtaaaaaagctctgatgaatcctggggcatctgccatcttttgctttcgagatgccgaggtgccagaaatttgatgccaaagacgaagtggagggaacgaaaggatggtggccgtggcatcaagcaccttgatcgatggggagacagtgagacaccaatcgaatcaaagtggaatcttctcttgctagaaaacgaccaacaaaaattggaagcagctagaagcctataaacattggtcaaggaagagggagcagcctaagagaggcagacagcgattgctacattttagtgccacgaaaatctattaggacagttcgaaaagaagccatcacgttcgtggtgaagactaaaaacacttagatcctgtttagataggactaaaacttttaaatccctatcacatcggatgtttggacactaattataaatattaaacgtagactattaataaaacccatccataatcttggactaattcgcgagacgaatctattgagcctaattaattcatgattagcctatgtagtgctacagtaaacattctctaattatggattaattaggcttaaaaaatttgtctcgcaaattagctttcatttatgtaattaattttgtaagtagtctatatttaatactctaaattagtgtttaaatacagatactaaagttaagtctctggatccaaacaccaccttatattaatcagagaaaaaattaagtaaaaaataatttagaaataattgaaattcagaaaaaaagaaatattgaaagaacatcacataaaaaacccaataaaagattaattaaactcagaataaagaataaaataaattctgaaattagaaaaagaaaaaaatgagatttaaataataatataatttataaataactaaaattcggaattaaaaataagaaataatagaagagagtccatatgtataatccaatatgagttgaactaaaatttttaataaataaataaattttggaattacaaaaataaaaataagattcataataatataatttagaaataactgaatttcagaattaaaaataataaataacagaaaaagagtccacatagaatccaacacaagattaattaaaattcaacataaaaaatatatcattacaatttgacataaattaaagatatagctctacttaccctttaaatttcatttatataaaaaaattatacaaaattaccccctccttccttctccctctctcctctcttacccaagattcagttgaaaccacggtcgccggcgacggagctagcagcggcgtggttaggttaatccattgacaggggcgattgaaccgtgaaagagattgacagattagaaagagggagaaggaagaagggagtgaagaaaggaggaggccggggtatagtttagtacaaattttttgataaatgcattgaagaggtataagtatggcatatctttaatttctatcaaattgtaacggcatatgtctttaaataaacgaataataatgctattttttccaaatcaaagaagtcctaatgggtatgatatagttattttttttaatgtgaggactggtgagcccttatattttctttttttttataggtgaagccattaacttttggacacataatttgaccattcgtcttattttagaaactttgtgcaaatgaataagatataaatcatgtttaaagtttttttagtgataaaataactcacaacaaaataaactgtaattacatactctctcgtcccataaaaaaccaacctagtactatatgtgacacatactagtacaatgaatctggacatatgtatgtctagattcgttatactagaatatatcacatccggttctaaattcacttttctgaaacggatgggactcaaaagttatatcatagtcatcatctattaaaatacagatgtagcatgcatccagttgctttctcaaatttcaggcgccagcccgatcatatcgatgagaaagcagagaacaccatgcaccgccgaacattgacgccgcgcgccgaaccaccgcggcgcgctccgtctccgtctgccacacgtacaacgcggcacgacgtacgcgcgcccacacacaccccgcgatcgattgacacgggtccgacgccccagtgtgtctgtgttccccccctacccgggacgtgtcacctgcatacgctgcctagcgaccgcccaagaagctctcgcgtcgtcgcccatttagcagcgcacgcgcacgcacacgaacgcgccgtgcagcatcagcaggcagcagcagcagcttcctcctcctcctcctcatcttcaccgacgacaccgcacgctccgcttgctcgtctcgccggcgccatgtcgtacaaccattcgccgtccatcaccgcagagaccataaaccagaaggtacgtggctacgtgcgtcgttgcgttcctccgtcgatctgaacctcagctcgcgatcgatcgatcgatcgatggctagctcgatcgagttttattaactgatcaaatatgtgcgcattctcattcgtcttgaaggtcaggatcttcacctacgagccatgtggggagattgtccgccacgcacgggtaactataaatctcatcaacctacactgagggcaaagccaatgtttgaagcttacaattacttgagatgagacccataaatagttaatttttgttgtagtatgttatacaatacttatgatcataagataagggcaatgtatacgggttaagtagtccttatggtacggttaggccctgtcacaatagacttcagttatctctatttctatcgctacaaacatgggatgggaatcatgggacccactaacaaataaaaatgtattccctccgtttcaaaatgtttgacaccgttgactttttagcacatctttgaccgttcgtcttattaaaaaaattgtgaaatatgtaaaactatatgtgtacatgaaagtatatttaacaatgaatcaaatgatatgaaaagaatacataattacttacattttttgaataagacgaatggtcgaacacgtactgaaaagtcaacggtattaaacattttaaaacggagggagtagtaagtaacatcaaacacaaaagatgaagaggggagcaaaggagagagatattcttatttcttatgggtagtcgttagttactccatggatagctcatgctattgactcccataaagactccttccacaatatatacattggtacattgaaacatgagctcactacataccctatcttattataagttgatgtccactatctcctaaaattcaacatgtaagtgtaccatatcatcaccactagtaaaatataacctttcagtgatggtgggagtatagatggccaaaaggcctgaggcccgacgggccgccccacggcacaacattttggcccgtgcctccccccccccccccccaccggcacgttgggcaggcctaggccaggcccgacacacaaagaatagggagtaaaaatagacatattatatgccacggttcaagaatagggacgcaaaatatagttattttagctatatatatgtcaacctaaagaggagggagaaaaaatagacttattttatgtcacagcccaaagaggagggaagaaaaatagattcatttaaaaaaaggcatgatgtgccacccgtgccttcgggccggcacggcatggcccgactactggggggccgtgcctgggccggaggtgcagcccatgagccggcatggcccggcacaaagtgctgaccgggccgtgccggcccgatggccggtgggtcatgcctagccatgcctgggccgggccaggctgggcgggccttatggctatctataggtgggagagagcaaaggagttgtcttttcgttaagtagcgctagattaaatttatctcagattccaattagccatcctccaaccccattgcat

SEQ ID NO: 75686 - DNA, 26213 bp, Oryza sativa
tgcttagatgtgatgacgttgttaagggccttcatagggcaacgtggctttcagcccgagcactccaccttggagactcagcatcacgtccgcgtctgaacctatcaaaacctgaagatcacgcgttcaaagaggatcatgtgttctttgaagttatcgagagcgtgtagcgtggagagggagagatcttggccgcactacggaggtgaggcttgtggcttccaatacgtgactttgggtatactccctcctaccctaaatgtttgacgccgttgaattttttaaatatgtttgaccattcgtcttattcaaatcttttgtaaaatgtgtaaaactatatgtatacataaaagtatatttaacaataaatcaaatgataggaaaagaattaacaattacttagattttttgaataagacgaacgggcaaacattttttaaaaagtcaacggcgtcaaacattttggaatggaggtaatatttattgaagcttctacttgatgacacatgcaccatagaccttgtatctttcatgggtcttatgcctacgtggcacctgggaccaaacaggtttgtgtctggttactggtcaaacaaaaaaaaaccagtgctcctatctgataaagacatcgaaaagttggcatagccctagaaaagtcttccctagaaggggtctcagggtcataggtaggataagtacactgttaggatactaactcttctagtggagcggccacggcaaccacaactttaggtttcaaagcagctataatggcggtggatctacttgagcggcccctggtgctagcggattggggacggctgaccgatgagcttcctacagtctggcagtaagctgcccttccccgtgccgcactcattctctcgtcccaaacactatttggtcgcttccttgggagttgttcctccacgtgttcctgcccttggcctggtgagggcaagtgctatggtagatgtgactatcacctccaaatttatctattttattcaataatgaattaagaggcaactcatacaatgtatcacctctagtatacaaatattaatatatctaatactctcacatcctttttgaaatttgtgtggaggttgcctcttgatttaggggtggctcatcatctctctcctcacttctctcatccacatcatcactcaattcaatgtggtattcttagggacaacatatgggtcattatagtactcgccctgaggccattgtgcctctgcggggatagaacagaggctagggtggacatgtagatccaacatggcaagctagggatactcactatatccccgctctgtgcatggcctatggaggattccaagagagattttgattacatgctttagaatatctttgcgtgagcatgtggggcgccactgagagatccctactcagtacgtgatcaatattagaacaataacgtgatctatgcattccatgttgggggtttacctcatcttttgtcagtgaaattcgagcactaacgagacgtcgatttttttcttttaaaaaaaattcaaacaaacaaaatgcactcaagaattaaggggaagaccggtggagatatgttggcagtgtttaccccatgaaactagatatttttttgcgaacgcagaccgctggatttcccaatcaagtttttaaaaatcaaactaaatttcaatatttttgataaaactaaaccagatttccgatttcacaaaaaccaaaaaaaaaaactgttaaccctgtgtttttttctcaagaatggtttggtgaacctcgcatgttcgaggtcgcttttgaagttttgataatagggttgcactcggtgcagtgtgcccttcgcagttcactgttgcgttgtggccgatggtgatcgattatggtatctataacgttgaatatttcttctgtcaaatcccctggtagagaagtgtattttagtcccagtttgtaaccccatatagttccagtttactatcaatccggaactaaagatcgctatctttagtcccgggtgaaataaccaaagatggcccccttttcttttttttcctttttattttctcccgaatcaagtggcatgcaaatcaccaaatcaaaccccaaattcccaaatcaaagtaacatccgaaattcacatcacaaatcttaaagttacttatacacacaaatcaaatacatcacaaatcctaaaaaataacacacaaatcaaatacatcacagatcctaaaaaattacacacaaatcaaatacatcacagattcatacaataaatcacaaatttatacatatcagtgaatcacatattattaaaaaaacgaaaaacgaagccgctgccgccgctcgccacggccgccggctgccgggcgcagcctcaccggcctccggccgcctgtccgccgcccaccggcccgacggataggaaggggaggagggggaggagaggaggaggtggaggagaggaagagagggtagatttgtaggagtggaggaggagaagaagagaggcctgtaggagtggaggaggagaagagggagagattcgatctatgtgttgcgattgtggaggagaggataagtaatagggattatatattacgcgttcacttgatctttatattagtcccggttggtattactaaccgggactaaagtggtaatctttagtcccggttgatgccaccaactgagactaaagatcctcggcctcctaacatacatctgactggggataaaccgatctttagtcccggttgggaatcccaaccggaactaaaaatcataaaatggcagtagggttttcaaccgggattaaaaatcatttttagtcccggttctttttggaaccggactattgtggttttagattgatccagcaaatatcatttctccactaatgctagttcgataacgtatgcctcttcttacctgattctaagaggcagtgtatttagatgaccattgtcagtgttaagttactcgaactaccccgggacagagatgacagaattagaataatatatatttgcacccagattagcaatgatctatctctgggcagccgttatcacaagcccagctgaagccaaaatgacaacttgaattgctgcccaaagtccctgtccgccgtacattttggctcgtcccaacgaaggcgacggcttagatgcgtcccccgtcaattacatgtactatctccttgcaattgccaattgcaagcaaaacgacagggaattggtacccgtttgtttacccctccgtctaaaaaaagctcaatcctaactacgaatctggacacgtatatgtctagatttatagctagagtttatctttttttttttaaggacagactggtatgtcggacgaccttttctatcgccgagcagtaagatatatccaatcacactgatcgagaagtttactgttatctcgtagaagtggctgccattcactggatccgtcttcagctaatcgctagtgatgcctcaagttggtaagccgaacacgtacgagagcaaagttgccagacaaatttaaggcttggcgtttcgtcaaagctgctggattaattagcttagctctgctacttgcgtcgagttgtcccatccatccaagcttggtcaccactaccataatgtacgtactgtttgatgtgctcgacacggcgggaggatcaattcgttttgtattgttgattgggtgatcgatcgtttttcgttaggtgcagtttggcgagagaaatgttactacgtgctgcaggtagcacgcactcgaaaatatctgaagatacatatcacttgtcctcgtgatcacctcatctatgcgatgatgatgatgattcataaaaggttttgctacatgtttgttcacaaattttctttaagactttattaaatataaatactacatctatattttaatgtatgacgccgttgatttttttttcaatgtttgaccattcgttttattcaaaaaaattatgtaattatcacttattttattgtgacttgattcatcatcaaatgttctttaagcatgacataaatattttcatatttgcataaaaaaattgaataaaatgaatggtcaaacgttggttgaaaagtcaacggcgtcatacattaaaatacgaagggagtacaacgtaacttgatataattacaaagtaactctgatgtaattttaaaccgttagatttactttaatatttgtataagaatggatggaaaaaatcacagtgcaggcacaggtaaggggatttgatcccgtgaccttcgcttggtacaaatagcgtgttacgatgtgatttttgaaagttacgtgtgagttatactatagttaaatacaagttacaatatataattaaagaattatgttatacttacgtctgatttttttagagaaaattcaacgttaaatgtgtagacagccccatcataaagggcaccaaaaagcgcagcgttgggagccgtccgatcgcggaaatcaccggtcgacagagatttttttttttggctcgatggcgtgtgacgatccgatccaaccgcgcctccctcacccgcgttacgccgctgcatatacacgttgtccgtatccccgcgctggcggataaggaaaaaaaattggagggactcaattacactgtttctttaaccttcagctatttagaaaactttagtttatcatttatatgatgaaaaaattaaagggggtattccagaggtatctataggtctggtgggtgtaggggggactcgagtccccctgcacctacgttggatccgccctgctcgtgtctcatcaaacaaccttagccactgcgcgcgtccgccggcgtacgtacgcacgtacgttagccgcctcgcgcgccaccgccacgcgacgatttccacctccacgcggccgcgtactgccgcgcccggtacgcggtcgagaaaaaataaaaccacagccgagaggaggagacggcgcaaacgcgcgtggcgcgcgcacgccgcacgtacgtcatcgcgcgcgcgtcgctagctagcgaaacggcgccccccacccctcgcgcctcggctcctcccgcggctgcgcggccgcggacgcgcgcgtgcagcgaaaaacggcgcggcgcacgcagcaaacacgcattctgcacgcacgcacgggcacggcaacggcgaggcccccacggcggtcaggtacgaggaaacaggggcaaagcgagcaaatccaccccccaagctagtgacgacatcatatcagtggaggagggggtaataaccgagcgaacgaatgatcggtgcgtgcaagtagggcacaaacggccgggagcccaattgcaggtaaagaacgaaagaaaccggcaagcctttttccactctctgcgtgtggacagggaatgaatcatcatgactgtactacggtgtacgtgtctatactccacgcacccaaacaaacaaaaaggtgacgtgtcgtgtgtgcgccttggcagtggcgaatctagcgccaacttggtactaccacctctccctacgccctcctagtgcatactactacagacgatcgaccggtagccaaccaggccaggcaccaccgcgacacagttcttttcgtcatcctcttttccctttcctgttccttttaagaaagagctgagcaacagtactgcggtagcacatgaggaagcccagctctcgctgattaacacaatcgctgacagattagcagtaagtgtatataagccattcaatctcctcaattattttcatcaggtcctaatccagctgaattaattgcatcaccacaccagcagtatgcatgcagtgtgagtaggggtccagtattccaatactactcactccatcccacaaataacatatttttatgattatgttgtttgactatccgtcttatttaaaaaaattttaaaaaatagttacgcataaagtattatttatgttttatcatctaatataaataaaaatattaatttctaaaaaaataaataagatgaagagttataaaagttgtatcttaaaaactgataaatgtattttttatgagacaaaggaagtagtagtccataaggaatcgtctaattgttgctttgtatgatagtgtctatggaaaggagaaaagaaaaggagggagagatctacccaacaaattgctggtcactagggagaggtgagggcgatgtggcaggggggaggagggagggggggttgagttcagtgaacctggggagggagtgggatccatggcacggcaaacggacgccggaggtaggcatcaacgctggcaagtagcagccaaccgaagcactcatcgatgattatatttgcacctgtcaatgcggtccctttctgacccccagcacaagtgctttgtgtcctcatcgtcgatgttcacctctctcctgcataggagcaacatcttgcttgcttagggagcttaaaattctgataagtatatcgtgagatcgaagccagctagtgagaatatgaaaaaaaaactgggttttccaacttttgagttctggttattttttttggatttcgtaactataaattcttagaatcattgaaaaaaatctaatatgtttgagaaatctacaggtttgaaaagaaactacatatgttaaaagttcatccaaaacaggcctttctttgattacgtcttcagaaatcagaaatatctccatgacaagagggtgtgggggctgtgggcgttcgccgagacaggctagaacgcatgaactttacctgattctcgtacgtggttcatttccttcgttccaaaggagacttcaaacactgaattcctgtactctcaattgtcaccgtattgttctattatgattttccgttgttgcaaacggctcctaaatacgagacatgaacattcgtcatgcactagaagtccaagtgcttacgaatgattttttttttcttagctgattcagattctgaatttttgttcaaagatccgtgtaaactctgccgtgccgatcactgccctggtaaaataatttaaggccggagctagagactttctgagagaaccacttggcggaaaatggtgatcagtgaaaaggttagaatccttaaaccacgatgcaactgaacccaggccgtctctgtcactgactatctctcatggcaataattcggagaggaccacacccaatggcaagagccagaggagaaattcccaacttggccaatttgctccctagttttcgatttgttgtcagaagcaaaatctcgagatataatccgccatgaagcagactcgccctggagcctgaaatttctgccttaagccataaacattggctacttgctgaaaagtacatcactaagcatcgcaaagacgaaaaagataagctaacagctacgagtaaatgaaagactttgtggttgcagatccgaatgccaatatgataaagcaaaaccaggaaccaaatccagtgtgcaaatgatcttatttaagctttttttttcaggtcacagtcctgtagccaatcaactgccccagtattaaatcttcagcatcaaagtataaatatagcacgaaagaaaagccaaaaatcagcttatgccttaaccaccgactgctcagaatatacattgctggaatgagacacaaatcattcccaacaagtaagctgggcaagacaaataagctcatacatcgttaacatgtaagcttgattctgtcttgatttctctagatttctgatgtcacacactagctgttgacattccagaaaagcagaactgcacaggaaagcgaaagcgagcactttcaaagttgcagattgtagatacgcaatatgagcacaactatataacttaataagcacattacagcacacacatggccaaggcagttatttgaatcagtctccaacatacttcaaatcatagaccacaccatacagcaaacatagtataaacattgtcatagagagtacagctgatagcagcttgtaatattctagcattactttggtagcatccctctacaaaacatagcagacatcaccagctcttcatcttggccatacacattcaacctgacaagaaaaccatatcccattttacaacatatgtaatctgtacatgaaaatgtatctacaagaaatcaaaatagtaggtagtgtggagtgccttacatggtttgctagtgacagaccacactgaccagaacatttcgtctcctcagtaggcaccagctgccatgagcagctcatcaaggctccagatgccctcgttgcttgccccgtcttgtgtagcatcattttgcagaaggttgtccattgattcatctgagctgctctcaacataaggtaatggcaaatacttcatctcgggatcgaaggtgggcatgttttgtgcgagattaggcatgccatttccctggggcacggcgataccatagttgttcctcattctctttggcgctccacctgtcaggtaagcaggttcaccatatgctggcatggcagcattaggaacgaagactgaagtgtagtctggggtcagggtgtcatcctcccaaccaaagtctgaagagccaaatgagttgctgctcgtatcagagagcatgttcatctcgaatgtctcagtggaagcaagaggtttgactggaggcatgagatcaacaggctctgccggctttgcaggcacctttgcaagcattgcaaacaaatcattgtctgaactgtttagctgaaagaaagcatcatcgccacaggtcttcagaggtggagctagtttctcttgcttggcagcgttttgcttcagggagagcttctgagcaacagctggttcatcaggaaagttgaccttggctttcttgccacggatcttgcgggcttcagcgtcatatgccctagctgcctcctcagcagtgttatatgttccaagccaaacacggacacccttgctggggtctcggatttcagctgcccatttgccccagggacgctggcggatccccctgtactgattcttcctcttgtgctttgctgatctagcagtaggtccatcatgttggacaagctttgtagtcaacatcccatctacacgaaagcttatttgttagtatacatctcaacaaacagatttggaagaaggatataaaggaaatatcatagctataaactgtaagttacacaatacactctcaagcaacatgaagatgaagttatactggatgttcacagacaggttgagacatgaatcagttcaattgatcacttctcaaataaatcatgacatatataagaaatcttaaagtccatgaatatagcaagcatatggtgtaagcactgtcaaagtgtagaactactcacttgccctatgattaacaatagataataatctacatatactgtctacagtagtcatctactcacctgcaacgttctatccaggaatgagatctcagatgcataaaactaacgaggtccctctgagggtatattttgatgtagctcaaaatcaactgtacaaactactaaattagagttccttatattcgttagtttttttaaaaaaataaaataattctttaaattcgtatcccttgaatgagagtacgagatcaccaacaaagttcaaattaacaacctaaagtttcttctgtttagaattaacaagaaaaaaaaaagaagggagctttgacagcatcacctaaagtttcttctgtttagaattaacaagaaaaaaaagaagggagctttgacatgcatctaacaatctatataaagagtggaacaactaaagaacccatcattttttttatttttagataatactacagaacccatcatactctgaaaactaacagctaaatatgataaatcaagagtacaagaaaaaaatatgcctcaaagagtactccaaatctcaagatgagatggtggcacagatgaaactttgccaaggaaaaaaaaaaggccattaagttttgcgtaattacactactagatcacttattagaaacaaagcaagtaaatccagcgacagaagagcatccataaacataggttaatccaagaacatactacaactctacaaagccaaattttctctaatccaacacaaatattagtgattaaaacacataatgacactgcgaaatcacaagaataaatatctaaaactcatcactctctctttgctactccaattcaggaaaaagaaagaagagtagaatctaggacaaagttgaattcctatttcgtagtgtaaattcgtaaaccaccaaacctacagatgctatccatctaaaagaaccagattcgctagcaagtttacgtacacaggtattaatgaagttaagaactaataacacgctagattgaagaaaaaaaaactatactacacagtgccgtcccatggttcgcatcaagatcaaatccatggcgcaacctgatgaagccccatttggcagctaccccatgagaccccaattctctccccaaatcacacgaagaacgcaagaaacggacccagaaaaaaggccgcatcttgcgctcgtctaacgagaaaagggggaaaaagagctagctttatgcgttattttttcacctgcagttgggggcgccgccttggccgcggcacggacgacgaacctcgccgccgccggcggggggaccaccacgaccacgtcgtcgtcgtcctcctcctcctcgccgccgcccccctccgcctcgtcgtcgctcatgccacgctcgaactcgcggaagtcggcctcaaagtcctcctccgccgccgccgccttccccttccgcagcatccccggccacagcacgtcggccgtgaccctcctgccctgctgcttcttggccaccgcagccgccgccgccgcagcggccgacggcgggatgaacccggagatgattgctccgccgcacatggccgctaataagctacagatcaagaaaccaagaaagataaatcgagaagaagaacgcagtgaacacttgctgccgctcacgcggagggcgcagtgggagaggaagccgggggtggtgggtggtggccgctacttataaccgcggatgcagctgacgcgctactcgacagcgacggcgtaatcaaataaaaagaaaagaaaaaaaaatggaggaagaggaggaggaggacgaggacgaggagtggaggagacgagctctcgcgtcgcctcggtccttttttaccccgcctaattaccaacctcctcttctgtccatgatgtcactacaaccactaatcaaaagattcctcggtaaaaacaaaagattcggccacgaacagggatgaacaggagagggacggtgtggtaagaatttttctccgaggagatattttgggatgatttttactatcagctttttggagcgaaccagatcatgtgacgaactgccttgcatggtgtcatcacggtatcatcctcctcttttggtttttcttttctttctttttttttttgagatttgggaaatgtttgctgcgagaaggaacgcaagatgtgtggggcgagagccataaccgatgggcggcaccgaattcgctggtgctgttttttgtttttgtgttcttgcttcgattggtggtttggactttggaggattgcttcgctcaagatcgacaaaaagaaaaaaaagaaaagagaaaaaaaaagttggtttggagtttggggttgattgaattggtttgacgtttttaatcatttgacgatgctttcatttgcacggttgcatagtgttttgtttttttccctcttttgttttttaaagacgattatggaacggaatatcacaccaaaatcaatgtgggaactgatcagcagtgtatcagaccccattttgatcatacacatcggggtatctctaagtttgtcttaaatgactttttcttcgtttcagggtatttttcatttggctttcaaataaaagtaaaagtttttatatttgtatcattatcaatttgaaatcgaagaccggaaagtaaacttagatgaaaaataaatcctataatcaaagcttcaaatttcaaaatttggaagctggtggtcagctaaaaattagatgatgagagtataagattaatcggattagctagatatgtcaaatgcgatttattttaccaattagttgtgttttcgttcctgcgagcctaccaagcttaccaattagtgaagtttgtgtgatttggtttgtcctatgtaaccatttgctttgtttcaggttacggtttctacagaaactatgagaacaataacgtaaagctaaaacagtctcataaaacttccatatacacctaatagataagatgatttggatttatcctatgtgactattgtttcgtttcgggctctataacatggttcaacaaaaaccatgagaacaataacgtagcgctaaaacaatctcataaaacttccatatacacctaatagataaggtgattttgtttatcctatgtgactattgtttcgttctaggttctataacacggttcagcaaaaaccatgagaacaataatgtaacgctaaaacaatctcataaaacttccatatactcctaatagataaggtgatttggtttatcctacgtgactattgcttcgttccgggttcttctataacacggttcagcaaaaaccatgagaacaataacgtaacgctaaaacaatctcataaaacttccatatacacctaatagataaggtgatttggtttatcctacgtgactattgcttcgttctggttctatagcacggttcaacaaaacccatgagaacaataatgtaacgctaaaacaatctcataaaacttccatgtacgccctaacacctaagacgatttggtttatcctacgttactagtgctttgttccagttttttataagacggttctatgacaaccatgagaacaataatataaagctaaaacaatctcataaaacattcatatacacctaatgtgattaggtttatcttacgtggttattgctttgtttcaggttttatgacatggttctacgaaaatccaagagaacaataacgtgaagtaaaaaaaaatctatgaagcttccatatacacctaagatatgagatactctgtattggacaaccatacaaaattttgcgatgaaacttaaattcatagcatgatattaaaatgacaaacaacaaacaaaaatacagaagccaggattaataatgtactccctcttcaaaaatataagagattttgggtggatgggacacatcctagttccttgtccagattcattatattaggatatgtcacatcatccaaaatctcttatattttggaacggatggagtactaatttatttgtcgtttgtccatgttaagaacaggtacaataatgggcggtagtagttctacgtaggattttgtgatgatttggaggagagctgggaagagagagagagagagagtgagtcggcgactaatttgtcatcgggttgcacgcgccgctcgaggagactgtggggcccgccttgcgctgcctcttctcgtcgccaactcctgcatcgggcatgcctttcgctgcttgcctccgtcgccaactgccgcagccactggaccgccgcccctcagcctcgccggcaccgacgcacgcccgccgctatctcccacatccggcgcacggcccctgtcacccccgcctgcacaatcgccgccgtcttctgcctccgccgtgcgggccagccgccgctgcccccgccgcctgccgcacggcagccaccgtcttccgatgtccgccgcatggtcgccgccgtcttccgcctcagccgcgcgacccggtcgccgctgcccccgtcacccgccgcacagccattgtcgtcttctgcctccgccgcgcggcctggccgccgctgtcttccacctcagttacgcggcccagctgccgccatcttccgcctccgccaccatttcctacgtccgccgccgccgtctttcatcatcgatgacaggaatcgagggaataggagaagaagacatgaactatgaggggatagaagagagagagaatgtgaggtaggagaagatggtgggtcccacgaatcaataaaatatttgtgttatagtatttctattgtattgacattagctatactgcttaagctgtttttttttggagccaacagcgggttatattattgaccttcctctaacatgaatgaaagttgtttgctattttgtgtgtggttgtctaaatcatttctctatatgtgggatcgtttttagaatttttctaatttttaacatggaagtttccaagtttctaatactagtcattaattatctcatttacatatttttaacttataaactgctcatgggtaacttctaaaatatcctggttgctttcttaaaaaaaaatcctggttgcacaattgcacgtcgccctcacatatccttttttatttcttttttgtacatgctcacatcttctcgatgcatcatgtatgtaacacaataaaaagaattcggcatggtgcatgcatttccctctccatttacccaatggattagcattatcacgagtaagtttctctatgttcatccaccatgcatgagaacaactactcgtccgctgtaaatcacatgtcgatcgaaggtttctttcccgggtcaaaaaacgttctcgttcatctcatggccttggtaatctcaacaagctgtacaaaactgccactggcacacagactggagtactggacgtatcacaccgaccaaggaggatcatatggctacgatcctagaagtgtctgcacgtaacaaattttggctgtttttgtgacaaactatcggcttttgatctttcccttcgtagtattttgttggattatactccttattttccaaaattcttttttatttttttgtgtgtgtgggtgtgatgagtcgtatcgtgactgaatggtacattcacgcatggatgctcatctacattgcacgccacatttatgaaatcgacaaaagcagctactcctcctgcctaaattgcaggccgtgtcgtattcagaaactgtataaaaacatgtggacagatctttttttgagaacatgtggacagatctgacatgctcctgattagctgtactgtgcattgtataatatactccctccgtcctataatataagggattttgtgtttttctttcaacgtttgatcattcgtcttatttaattttttttttgtaaatataaaaaacaaaaaattgtgcttaaaatactgtagataataaagtaagtcacaaataaaataaataataatttcaaaaatttttgaataagatgagtgatcaaacgttgcaaacaaaaactcaaaatcccttatattatggaacggatggagtagtactaggggtgtgtagttccacgctaaaattgaaagtacgaagaaatttggaacgatgtgacggaaaaattggaagtttgtgtgtagaaaagttcgatgtgacgtttttttttcaaactttggttctaaacacggcttatggttgtgtttttcgtgtgccaatttttttcttaagtatacgatcacacatttgtagtattaaacgtaaactaataacaaaacaaattaaagattctgcctgtaaactgcgaaacgaatttattaagtctaattaatctatcattagcaaatgtttattgtagtatcacattgtcaaatcatggcgtaattaggctcaaaagattcgtctcgtgatttacatgcaaactgtgcaattggttttttcgtccacatttaatactcaatgcatgtgtccaaacatttgatctgatggaaaagttggatgtttgaagaaaacatggcctagtacatatgtacacccttcgtcccagaatatagtaacctagaaccggatgggacatatcctagtactacgaccccctgtctagatttatagtactaggatacgtcacgtccggtcgtagattgctagctatattatgggacggagggagtacatacagagaggaatttttgactcaattgtttagttttttcttatatttttgcctctgtaagcaaactgagcaagcgatagattgacttcgattacaaaacaatactggagtacatactctgaacatcttggattcagttgcagatagtgtttatctgtttatctctccaatatacaatagttctaacaagatcatggcagatactgcacattattgcatgaaagttcagcccatccctctggtttgttggacaagaccatttcctcatattttgcagctcaagggccaaattagcagaggtcgtcattgtatttcttattcttctttccaaccaacttgatttttatatctatactgtatttgtgtgaaggaaatgtcacccaactgaaccatacttcgctgcacttctgtgtccgtatccggacgtcacctttatttttggctttgtcttggtttggcatttcgcatggcacttgggagcaccacagaaatctgtacttctttagttaattatatgtcatcaaacttcatgatacattgaatggaacaagatgctgaatttggactatgcattagtgtgtacaatataatttgtttaaagaagtgatgaattccattggagcaattataaatcacaccctttgcctgacgaagagtccgagaatgtgtggtgctgtggacaccagcacagtgtacatttagatgtcttggatggcaccagggccgtccattcacgagggttcccccgtacaaagttctaacggagacataaactcaattgacgaaataaaatgataataatttatacgcgagtccatgtagtattttgtagcaactaggaagatagctcgcgcatttgcgcgggcatgtgtgttaagttgtttcaaaaacaattataacaaattaaatttaaataaaaagtaagatgcttttttttttaattgaatgttcattctctctcttttttttctgtagaaatcttgaaaaggttatattgctaaatgctgattaatctatccgtcatgctggtcctcccttttcaatggggctatctttatgatagaattttacttgtatatgctataggtgcatagtttcagcgaaaaacaattagaggtaatgtccttacctaatgaaatataaacctaacctagctactactacatttgtttactcatgcccaatctgaataaatttgtaattgcatacattcagtatatatgaaattcttacgctctctggatttttaaatgtccccaaaagcatcaatgaattaactttattgcacaattttcaatagggtatttagtagtttaaaattaaataatgatccaattttcaaggtttcaaacaaccaaattttgcaagcaaggacaacacaaaaatatatgtgaacaacccttatgcatctagttgttgtattattcaaaccttaatttaaggattaataaaattaaattcatttctaattcagatcaagaaaaaaataattttgctaaccctaaggcatataaatattaaaactattattatacgttgccaaaattaaataaatcttagaggattaaataaactcatataatacaatttattatagctaaatcgattgcaatgttttgatttgaatttgcatggattgagatatatcgatatgtaatgttagcattagcttatttatattgtaaatagaggacatgcaaatttgtataagagaatgcagactaacctcatcatttaatatttggttggatcagataaagtcaactcatatatatactctctctatctgggctcatagctaagattcagcaatgcaataagtgtcaataaagtttactataaacactaaaatattaatcggattcagtaagacaatcaattaatgcgcgcgttaatgaggcttatgacaaaattaaatttgaatattatgcctaaaattaagtggtagacggcatgctagttgatagcgagttgtgtgtggttacttcatcgttcataggatttgtcagcctaatctcttaacggtgctcaaagatctatagtgtgtgtatatttatcgaaataagtgtgtatgtgtgtgtatatgaggcacatttgtgcctcggaaaaaaagtaataggagttaaaataaatgcatgcatgtgggatcagatcaatggctttaattgattgaaagtattttgctaaaccaaatagtatacttactcatcaccaagataaagcagctaccagagaaactttacattgatcgatcatgcatcttgtcgcattatctgctgctatactttggccacatgcgttgctatggatgcccatgcaagtagccaagctgccaacgtgttgcacgaatgcatgactaattttcgtcttctcctgtatgcatcaaatcccatagatagttatttttttagataatcagagataattatagatgaaatcaaatcttgattgaggaaacaacaccagagttgtaaaggatttgtatgtagtggtcatcggtcctcttgcactcgccgcgtcaatatgaatagatcgatgaagctagggcgcgctggcatacaccgagagatcgtcatggccagccggccgccgtcgctaggtttggaacaggctccatcgctgtttaaaaatcccacctgcgccgtgttcctatctactaatggctgaacgattgatacaaggataatgatcggttgttgattggatgcatccacatatacgtactacgtatgtatgtacataacaaataattataggatagatctaatggttaaaaaaaatgggtccaccaaattaaatcaaaatagatggttggatgttttgctttcttttttagaatttataggactttctttaatttattagagcgccacgtgtcggcttaagaacgtttgtaaaatgccacgtggcggcttgagagcgtttgtaggaagtttaatggacttttagtatataatagatagataatagataatagatagatgatagatagatagaagatagatagataatagatagaagatagatagataatagaagatagatagatagatagatagatagataatagatagatagatagatagatagatagatagatagatagatagatagatagatagatgtaaaatataacacaatttagttatgaactattatccaatattcgataatttagttcgaatcaaagcattaatcaaaattagagaactagactacacaagaaaaaggatttggtggatctgatgcctgataggtgactacgtttgctgttggagttttggggtgttacggtgcgccgtgctctctgcaggcgtgttgcacaactagccagatagagattaaggcacggcagcacgtcggcaagtagccgagcacagagcgcgtcaaccgccaaggatgatccagctacaatgtactcccttcgtccctaaatataagaaattttggtttgacgtgacatattctagtacaataaatctgattaggcttcatgggcatgttcggctgccggcagccccggcacgaacagtgccgcactcactatgcgcagccgcagccacagccgtagccgtcgcagtcggcctgccaaacaagccccatattcagattcattatattaggatatgtcacatccaaccaaagccccttatatttagagacggagggagtagtcaataatcaatcgagaaaacaaatcaatgctcttgatcctaggaaatcaatcggagtaacaaagttcacaaatggtttacaaaaccaatggtaatcgtgcttaccatcgagtataagtaaagataaaaccacaatagccacaccaaattcagataaatttcaaatataatttaaatttttaatttgatatgatttcttacagtttgctgcggttaccgacgataacatacttattgtcgggacgaggtaactccatcccgacggcaaggaaaaacatacccttattccattcgctacttggtcttgttggcatacgtctattcatatacgcagttgataatttaaatgggggactctgaaattcgggagcctgtactgtcccatacttcactcgtccttgtagatgggcctaaatgacgcttgaaattatggaaaaataatactcaccataatgtaaggtaggagtggttcatagtacagtagtactattttcacaagactggtagttcaaagaatggtagggactagggagacgatgaatcgctgaaccgaacaaacctcttcctacttttgccgctaacataagacccggtcatccgagaaaatcgtcccacctcattcattttaaccacaaattttgacaatttgacactttgcaaaaactatttttacaaatgaactgctgccaaaacttatttcaaatatgacccttttgctcaacgccaaatcatgtggcgctgaatttagacacctcagagccacgtcagctagtgctgaatgccgtgccacgacggatgggagactaaatcagcgtgtaaacgtacattcagcgtcatgctatttggtgctgaggtgtttaagttcagcgtcacacgatttggcgttgagcaaaagggtcagatttaaaataagttttggcagcggttcatttgtaaaaatagtttttgcaaagggtcaaattgtcaaaaattatgcattttaacggtcttcagattttacatggacatggtcatacgagaagtaggtgtcaaagtacataggcccatctttttctcgccccaatcgtaacttcaattttacgaagatgaacagataaagagaaagcgacgagatcggtgagacgggacctcatcacaaatcatacagcccgtgaggacggacggacgcgcggttgagcgaatcaaagctcatccgcagcagagcgagtggcactgtggcatgtacaggcctacagtgtacaggagagagagaggaggttgaggcgatctctgcggctcccgttattacacgcgtgtgtcctgtcccctagcagcggtgcgggcgacttcctttcgttgcggcgacgcgacgcgcggtgggatgatactgggacggtggttttgtgttgtgccgcggacagaagaaccgcggcgatattgcggcggccgagcctgggcaggggctagggtggtagtagtacgagtagttcgtgggctgttttgccgacttcggttttgccgtgccgccgcagcgcgcgcgcggggaggcggcaacggcgatagcccctggtctcggtcgcccgccgccacacccgcggtcacgcaccaaattgcggcgccacgcgcccagcacacgcggctacggggaggggacgggaaaaggttgtgccgagtgccgacgcctgtgggggaatatctcgatttgactctcctaaacatataatctaatttatatccttgaagcacaataccgaacatcttaatcttttaactattaaaacatgtataatttaacttacttatcgattttggagagcggcttatgtcattctcactcttcccttttatctctctcctccttatctcccttcggcccctcctatctaactctcctgcactaccagcgccactacctccactgcaccgccagcgccactaccgccactcccccatctgccacttgcgaaggatggcctagatccaggtgcctgtggaggagtcgacgacagacattgccaaatcggggtcatcaagcccgccgagctcttccttggctgttgatctacattgacttttgcgccgacctgctccatcacgtcgcctctcataagtcataactggactagcgcactgccgtcggctgtatcttcatctcctgagctccgcgctattctccgtcctgacgactagccaccgtcttcgccatggggaccccgccactgcccagggagcgttgtctcatcctcggatccacgccatctctcttgaccagccgagcgcaccgtcatcaggctacatctccatccctcaagctccgcgccgttctccatcccaacgaccgctcgccgttttcgtcgtggggtcccctcccctcccaccgtctagggagaaccatctcctcggatccatgcccgggcctccaccctcgtcagctctgttgacacagtgataaaagtggagaaagtgtgtggaatagagaaggagaggaagagagagggggagtatgacaagtgggtccccactttattttttaatttttttttctgatgactagtatgagacgtgaatgccaacgctctcaatactgtcctaggagtaaaattgcaccgttttaaaatagttggaggggttttcaaaatatccggtatcgcggttgagtgacatacgaattgaattttacccataattgaggggcccgacttattcccgcacgtggccgtaatgttggtccgtcagttacactgggcctctctgctgtgtttcggggtcgcgagggccgtcgatggacggcccagtaggccagtgctgaaggcccacacagtttccccgattccccacccgtcacggcgccgtctgcagtaaacggcaaagtcctcccctccgtctccgtgtccgtcgacacgccgccaccgccacgggggttggggatttctttcccctcctccaagccaagccggacgcggacgccaccgccctcgccttcacctccatttatacctccggcgagcgccgcggcggcggcgacgcacgcatccttccttcctcctcccgcaccaccggcgaccggtaaaacggagagacccgtgggcgagcttgttcgaggcggggcaccaccaccatgtcggcccccgcggcggtggagcagcggctgcaggcgctgcggcagaagctggggaggaagcagcacttcgaggaggccgtcgccgacctcgccgccgcggtccgggaccaccacgccgccgcctcccccgccctccgcgatttggtaaatgaggccgacctcccctagccagcgccccccccccccctctctcacctcacgttacttcccgatttcctttcgttgcggcctgggttaggtccaacgtcgccgccgctgtggtaatgatgaatctaggttcgattggtccggtaatggagtagaattcttactctaaagtcatcatcaatgggcagaagaaattaaaatgatcttctctgggattgttaatcctattaaaatgatcttctctgggattgttaatcctatgaaaatgatcttctctgggattgttagtcctgtcgtgtcagtaaggaacacgtccttagaataactcatctcatcccaacgaaattgttccttttcttttctccaagtagcttgatatctaaatttataacaagaggctaaacgttacaagtaaataccaatcaaaatgcagtgaaatcagtacgtacccatcaaaatttacatattcttcaagctagcatggagcatggttaaattcaaagcaagcaataaaaagaatctgccggagtagtagtttattataatccaatgaatcggcttggtaagatgtgacgttaacgttaacatcgcccaattcacgggaatcaagaaaccgaaataacgatcaccatgaacgattggaattatttgtagacagaagtagcgatgagtgacagagtaatctggctcaggtgtttcctgtggctttatgcacactcaatcgagcaaatgaggaatgacatacatggacagaactatgctaacaaaagtgatttccttggataatactaatccttttgtttcattatcttctgatgaagtaatcctgttaatgtaaaaacttctgatttttttaagttaaggttaacttctgatgctgatgcttttttagttaaggtcgtcctcagggattccatttttgtgtaccagtataccacacccctacaatcagttgtttggattagcattcttttccatactctaccttcattaatatcatccatcatatcgacatatataatgctcatttagcacaatcttttgttctttggcagatgtattctacagtttgccgtgtggcaactgtccttcagactagatatacagcacctggattctggcgtgctggtctgaacctcttcttaggtacagagaagctggtaactaatccttcagaaaaggagcaactgaagactttcattctgagggcccgggagcatcttgatgagaaagagaacgaggaatccatgccaaacaacagggaaacaggtatgtcattaataattgaataggatgatgtgacattcatagacacatctgcatacttagattggctatactctaatgattattctggaggcaacctgtgatgcatatgcaattaaatttatttcttggtgaaattgataaacataggagttcttcaagtacatatttgtctgcagtgtattttggtgaaataaactttccttaaaatattcacccttataaatatctatttgctaagaagatgtaaacttttttttccagatacaagatttctttttgaagggcatcttacagtgggacctgaacctccacctcctgcctggcttgttgcccagaatttagcacgagaacttagcattttagctgaaccttctggagatcaaggtgcgaacaacaacggagagtccagggctgaggagatggcacctgctgctgctataatgaatttcttaaacaccatgacagtggatggagacctagaagccgctttggaagaatctctgcaggtaagaaagaacaattcttgagagaatcaatttatttggtatacttatttcattattttttcagccctgaacttctatgttagtttcttgttgcacttttgcacactgcaaactggagtagtatccaaactgtgcacaaccataggcttttggcccatgttaggtgctatagagaaacaagcaaatttgataaatttgttgaatgtcttgatcagtggtttgtaaaatgatttttcaattactagtctgctgcgcattcaagtgctgatcaagttgctaaaagtggagctcatcatgctttgatgcatgccaaatttcttcatgttattatgttattgcaattatcaacttggtttagacccacattctcaaatttatataagcttgtcacttgctacaacgagaaggatatacttgtatctcttatgattgtctagtaaccaccactgaaattcttcgaaaatggaaagcccgcatttcatcattttgtcattcagttcaatagggtaacaagatttgcatattgttatggatcttgaatttggaactactattttcagaatgtgatggcgaatcctaaggtgcctccagcttcaaaggaagtcgttgcgaatctaccagttgtaaccgtgacagaagaaatcatagctagattgggcaaagagactcagtgtgctgtttgccgggagagcttgctggtggacgacaagatgcaggagctaccgtgcaagcatcttttccaccctccatgcctcaagccatggctggtaatgtccacataacccctttgaatcatctgaaagtagcctcgacgcatcgttacaactcggtgtagctgaacattatacccatcatggttgtgttgtgttgcacgcaggacgagaacaactcctgcccgatctgccggcacgagctgaggacggacgaccatgtgtacgagagccggaaggagcgggagcgagaagaggaggaagacaggaagggcgccgcgaatgctgtcaggggtggggagttcatgtatgtctgaacatctgaatttcaaccgaacgtgattatctctctgtaacgatttcctgaaattcagagtgcactggagttgaaaattcatgtacaaacaacgtttgcttcggttcaccaccgtatcttcgttgaatgatactaccactatacagccagcttattacagcatcattgttcgttgatgtgcatgtgatgaagtacttgagttgagacattgttattcttttattccctttttacacacagtattcagtcgcgttagtctccttcgaatatgggggtggtgagataacggatgacgctgatgataactattcgatgatacaaatgaataaactaagcattgtaaagttaaattttattttaacaaggtttcctaaagaaatagaggactaagattttttttaagagagattgtaccgtcgagattgaacaaacgcgaactatattactactgtagccgttctacgagcttagtagcactc

SEQ ID NO: 75687 - DNA, 5118 bp, Oryza sativa
ggtatttctattaccgtacctcggcgataagaccggtaaccatggtaaccgcatcgtttatcagtaatgtaaaacctggtagtagtagcctagcagagtaggttgtgttggtggtcacttgaaaaattgcgattccatgggctgatgcccttacgtgggcccaccacccacccctgacgagtggggcccaccaggcagcgaccccatcacacgtgagaagtccagtccacagctcgctccatcgctgcgatttgcaacacggcgagacggatcaaacgggcgcctgcccccacgaactagacaagcagcaggtcaagcacccaacccaaaatcccagagaaaaacacacaaacaaaaacaacatacaactgcacacaccctgccgatgcagcgaacgtgtccaaataaattaaaaatcccccaatcgatcaatatacgctgcaccacaccacatactcaaaagaaagaaaagaaatccccccaatccccatttccagcgaaatctaatctaatcatctaaaaattcccttcccttcccttccgtccgagccagagcagtagtagtagtagaagtaatgaggaaaagaaaacgaaaagcgccaagaaaacaacgcaccaacacatccacagcagcagcagcagcagcaagcatcatcggctcaggcttcatcaggagaataggttagatgtgagaggaaggaaaaaaatccgaggaaaagtctcgagcccaccccccacatctccactgctgcagctttgcttgctcgagagaaagaaagagagaaagaaaataaaataaaaatctctcacaaatctctctctcgcagccgtcaaaatccaatcttggcgcatccccggccgcctactgttctcgccccccctctctggtaataattgtcaggctggtggttggtttgctgctgctaataatcgagtcttttcctcccaaggagaggcgttcaatttcttggtcaggatttgtggaggtttttcttggattcatttcgtcatctcgtcgcggagccaaagcttttggtttttttttttcctttggttggtcttggctcgatcgggatggatgcggggtgggttgggctcgcgtccaattcgcctccaccaccacaagtacgcttcttttttattgtttccggagtggggattgtagagagctatttcggcaatcgctagggctccgtgtgtgttctctctcgcccactttactctttttttttctatatcattattcccctttgccctccaaatcgaatcctctctcccctcctgcggcgccgcggggagggagcgatctggggagggggaagccgtcgattgactcgattctgtgtcgcgggggctccgattcggcctctgaattgcgccctggtatgtttgccccgcgtcgattcgtgggttcttgccgcggatttggttggatttatttaattttgtgtgatttgttcttgctgttgttgtagggttccatgagggcgtgaggtgaagttggggaagagagagagagagagagagaggggggtagggttgctgcggcggccatgtcgcaaatccagagcttctcgcggcagaactgcgtgctcctcgcggtgctgtgtgggaagcacgctgagaagcgtgcccaggcgaggtcggggctggaggcgaagcggctgcggccgtcgtacccgttcccggagctcagctcgtcggggagattggaggtgagctagcattctcggttggtgttgtggggggtggtgatttgttttgttgtgcgagctgaaaacgagggagattttcgagtgcaggtgcacacgctgttcaacccgacaccagagcagttcctcgaggcgcagcgcgtggttcagcccaacttcttgtacatccaggggcaacagcttgaggatgagaaggagattggctcgctcgtctggggggacaatgacgtatctgatccgcaggcgtttagttgtctcatcagcccgccatttccgaccatagtaagcacaaaccttttgtcgagcgtatgcaatatttgtactctttagttgaaagagcagtagagcaacctttcctttgtctactattagctgttaatggaaaaccaaaaaagaaggcctcacaactgcatcatttcctagttacatgatggtctctgatatgttctgggcaccacattgtagtgccataccatggtatgtgagaatttgaaaacttcctctgtccgggtggtgctaaccctgcttaacggttgtcaatacaggtttatctggaggttccaattggtgaaaaacttgctcaagcagttcattcaaaggtagaagtcttccattttcctttttcaatattccatcttgttaatcaaccaaaccttataacatcgttttgagactgtagttcgttcagaagtaccaaacgttttccttttttagtctgtctcatttagatcatatcttaaccctacgacatagtagtagtacagtgctagtagtttttcaacaaatgtctagactctgtaggacgaaatttttgctctatagattcttttatctataaacaagcactgaaatgttgaacaaccaagtatgcagtactattttacacatgacactatttggaatttagcagtggtgatgtttcatttcaggggattccatacgtaatatactggagaaattcattttcatcatatgcagcatcccattttcgccatgcattaatgtcagtggttcaaaggtaccagcatccttttccctctctaccatcatcatcatatggcaataacaactaataattttcttgtatatgtagttcggtgagccatacttgggatgcttttcagcttgctcatgcatcctttcgattatactgtgtaagaaacaaccatgtacaaagtgttaagcttgggcctcgtctactaggggatgctccaaagataaatataacccctcctgagaatgagatggttgaggaggaaggttcttcagatgtgtttccagctataaaaatttatgatgatgacatcaacatgaaatttcttctttgtggagttcctagcacaccggtaagctttggtattttatatccaaatttccttacatcttatttcctctattgtacgaattggtttaatggtgttgttaacctcttctcttctgcaggatccttgtttgttaggttcattagaagatggcctgaatgcacttctgaatattgaagtatggaataaagcattgcagctctactgtacattgattattttttatggaccatggagtaaattttacactatttcctgaagaaaagatggagtataatgattctatgagcaacctttgttttagataccttaactcaagtttgaagaaactaggatctcagtatgttagatactattgaaactgttctgtttttttaacattacaacattttgttttcttgttcaatatttagaaaagggatgtattttgcgtgttaattgttctgattaaggaaagagagggagggagcggaaatgttttgatgtactgatgtggctcacaacagcactatgcatgaaaccaccctaaataacaccacacaaataaaatctagatagacatcttagtttcagtctacaagatgctagcaataaaatggtggttcaattttttacttggcaccaccaaatctcagactatgttgtacacatgctggttctgaaaatctgaagttagcagtccatccttttcttgtattatttcttggtcgaaggatgcaaacacatagactagcatagtgatatttgatgcatcaggatttctttagttattatccaccaagcttttatgcaagttctttcttctgtttgtgtgttgtttttgcaacttattgctctatctaacggttgatcttgtttttggcagattcgggggtgcaaacttcagaatcgaatcaggtacgttgaattgttgtctgttctagctgtttacatacccgtacctttctgtagcatactaccatgtccatgactcctttagttttgtgccatctgtcaagtttgattgtcatgcataatgctgtcaagtttcttttaggggtggacaaactgtttcagaaaatgtgtactagtgatccttttttcctttatgttagagctactaataaactgtagcttatactgtatacaatttgccttatgcatgttggagttgtcccaatattgattttccatcatacttaaaataccacttaacaaattgttttctcttctgctgctgagtatagttgataagacttctttcatatgtggcagtgcttctccaccaccacttcatgctgcatccttaccacgtggaatggttacaatgcgttgcgacatcactacgtgcagttcttctcatgtgtcacttcttgtttctggtagcgcacaaacttgttttgatgaccaggtatgaatttctgcgaacctggatatataattcctgatcttacatgtacaaaattatatggcatctacctttctgcagcttttggaaagccacatcaaggatgagatcattgagaagagccaactagtccatgctctgccaaataatgatgataagttatcatcaagtgtgcctttcacttcaatgtccacagcttgtggggcttctacctttgaagtttggatgacccttcctaagtgggcagcacaggttggataactgtattgaacacacaagatatgctgtgattagaagtgcagggtgtgcttatttgctcatatttttattcattacttggcttctctttatcttttttttttccgatgcaccgactgaaagttcataatgttgtgtaattctattgtaaaaggctcttctcatgcttttgcttttgatctccaagaacagtgattagttatgaaagcaacaaaagtcttcaatctcattatctaatcctcacatgtaaaacattatttgttaatctttgactgaccatcaatatttttatctgaataattaggttctgaagcatttagcgccagacatctcatacaggagcttagtggcacttggaattggttgtataaatggcacgcctgttgcttcatttgataggcgagatgcaggccgccttttttttttttggtacaaatca

SEQ ID NO: 75688 - DNA, 2553 bp, Oryza sativa
gatgctgcagcggaggatcattcagggcgagctgatccgcgcgcaaaggacgggcggccagcggccgtcttcgcccccctcgctggccaacgcctttttccctctccgcgcacgctcgccggccggcgaggaaagatgctgggtggggagagaggaggcgtcggtcgctccctctcccatcgtccactcgtccgtggatagagatgatggtgggtcccactcttttttctttggtctaactgacatgtgggccccacattttgtttttatttttatattttgcttccaatgccatgtcaccgccacgtaagatgaggaccaagtcaaaccggccacgtaggcgccacatcagccaaaaccaccatcaaaaccactgagggacctgttttgcaccggttttgatagttgagggaccattgtatctggtttttcggttgaaggacgaaaatcggattcgttgataagttaagggacctcaagtgcacttattccaagttgacttatatagctcactatgtaggagtatttgtggccatgtcaccattgaggagagagataagacaaaaaagagtgaacggtggttagtcgaccggcatctacaaattctacacaataataatattctttaaactttattctgatgtaatcctacgaggagatcgaatagtttatcactatatttcaaccaataggcatctacagattccacataataactcttttttaaattttattgttgaggtaatcccacgatgagattgaatagtttatcactatatttcaaccatatataagacaatgcattattttcaagagcttttctccccattggaagggatatacacctccctgtcattttaggatgtgaaaattttaaaccggttgaatgtttataacagtgaatgattgataatatcaaggcttttgttatccttatcaggtatagatatatatatatgtatatatatatatatgtatatatatatgtatatatatatatatatatacatatatatatatatacacacacatcatgctgttaggttggagatatataggagtaggaaaatgctacacacacgactacggcgtccgactgtcgtacgaccacggcgtaagcgacgtgatctattcagctccggtgtgattctccatctcgttgcgccttccaaaagcccaagtcaaagctaagcagctaaatagacgtttgctttgcatatcttatgaaacagtgatcaaacttggttgtagtcttgtgatttcaatcagagaactaaacagaatatttgcatgttttatttttatttaagaattagaaactatgcttgtggttttggacatcactgcatttatattttgtttaatgcaacctgttatagccataaaaatagaacttgaaactatggtatatactctctccgtttcatattacaagttaaactactttgacattgatcaaagttaaactactttaaatttaactaagtttatagataaatatagtaatatttacaatatcttgggatgaaaatgttactatttttttacaaatttgatcaaacttcaagcagtttaactttgatcaaagtcaaaacttcttataacctgaaacgggggagtatattaagagggttaaaaaaaaacttgtctggaaaatgggcatctgcagctgtgaaaacattacaagagaatgttagatagagatcgaagttagcaggcagtgattgagatcgaccaaaactccggcagaacagttgtgtagccatgtccaccatgttaatgctgtcttcctgagtttgggcttagagtctagacttgtatatgggcttgcatggcattggaccgattcatatacagagagtcgtctcacgccgtcacgttgttcgttgttgccgtttcagcgttcgttgttgccgtttcagtcgtatggtagtcggatgatttgcgtcggacgtatagcagggttgataggagtatatgttttttcgggaatatgcaaaaggctttatagttcctcggttttctgttctttgtttttcctatatgtagttctacaatcttcttagtatgtttatacatccggctaacactttgttaatttataaaaactcctggctaacactcaatacttgtatttttctactacaagagaaaaattaaacggcatatatatgtattttaagataatgctactaaacagcatatacgaagttgaaatgctaatctttctaccatacctatcaaattagttttggtgccaaataatgtctcatattgtagttccctgaatacttcgatgatagaagaggccttctactccctctgtcacattgtaagcgtaaccatgagtttatgtgtctaactttaatcgttcatcttatttaaaaaagaatcatcatcatcatcattattattagacgataaaacgtgaatattattttatctgtaatttatgtttttaatttttttaaaaaaaatagataagatggacgatcaaagttggacacagaaacttatggctgcgtttaaaatgagaccaaaggagtatttggg

SEQ ID NO: 75689 - DNA, 13444 bp, Oryza sativa
  unsure (1)..(13444): unsure at all n locations
atccatccctaatataatatcatagcaacccaaaggcaacaccttaaagtcagttttaaaaatttgaccctgagtccaccagtcacaaccagaaatatactgagagcatgatatcacaccaccatcagcaactttaactgaaacaacatgctgtaaacattggataccctgaagtttttgtgccacagtaatatcaatgaaggaatgagaactaccagaatcgactaacatgagtaattcatacccctgtacccagccatttaaccgaaaagaagtcaaggattcagtaccagtaacagcctgataagaaatagccataaaaactggtctacaggttcgaantacagtatcgacggactcatggtttaactgatcgtcctgcaacgcagctaaaagttcctgaacaacatgtaactgaaccgaggagccacacttatgctctctgctccaatgctcaccacacgtgaaacaaaggcctttagcacgcttgtaggatttcaaggcagaaaacttatcagagcgagactgtgagaattcagactgtttcctatcctccaacacagaaccttgaggatggttggacacaggagaaacaggtgcaggttggcgagcaaaatttttagacaacaaaatcggctcaggtttcctgtacacagcagggtgacttccttctagtatttcctcttgcaaaaaagccaacgaacacgctgtatccaaatcttgaggtttctgcatcaaaactccagatctaatgtctttcctcagtccttccacgaacttggtaacaaaataattcagaggcaaagaactatcataagccaacaactgatgcataataccatcgaatttctccacataatcagaaactgaagaatcctgaacaatgtgaaaccactgccgaatcaagaccttctgcctatccttagtgaaacgaagacaaacttgatcaaagaactcttgccaagtaaccccgaccagtttggaacgcaccgattgtaaccaaaaagcagcgttgccagtaaaattcagtccagccacacacacccaattcttaggatgaacaccataaacctcaaagtactcctcgcaattactcttccagagctgacgactatcaccattgaattgcggacaagacataggtggaacattacccccaattcccgaagcacccaaaagagcagaggcaaacgcagactgttccagagcagaggggagcgaagtaaattggggcggagtttgcataccatcgggcgaacccggagaagaaggggaaggacgaggtggctgctgcaccaaggactggagtttgtcgacttgatcttggagtcccaccaccgaaacgtgcaaatcatccacgcgcttctccaccaccggcattcgggattccaccgccactttgagagccaaaaactcagatcggctcttctcttccgacagctcccgatgcttctcactctcctcccgtttcttctccacctcctccatcttcctcaacaagagatcgagcttactttcctaatccatgatcttggccgcttgcttggtcacgtagcgaggcttgtcgtagcacgccgtgattgacgaactcgctcgagatctcgccgacctagttgagggagccgaagcttttgcggaatatagttgccgaagcaacaaattcccacctcacccaggaattacagcaaaatcaagaggaggaaaaaatttcggcaaggctctgataccaatttgttaactacccccaaggacagaggaagaatcgcccaaacagaacaacgatacacacacacagatggatttcaccaacccgacagggttgatgccgccgccgccttcgccgcctagttcatcctcaactcatccaaatgaatacagagttagttttaagatgctttctctctcacacgcaactatcgacagcctggacatggtgctcatatggcccattccggcccactcactctaggattacatactcggtgcctaacaggtcttccttccttagtctgcttaacctccttggtcttgacagtgttctgtagctcatccggtacaactgtgttgctgacaagcaggttcatcacgatggacaagtcttgttgctgtgtacatatatacaaggggtagagcatgtcaagaaacacaatgtaatttgttaccggtactaattgctgtagcacaagctgcatagaacaatgtcaggcaaattataaacctcaactttgagcaatgtcagtcaggtggagtgaatcacattagtactggttcagcgtcggaggagttgacggcgttcagcgtcgccgcgtcgacgcggctgtccatgttgaagctgatcggcaccacctcgtcgtcgacgtagtacgtgttccgcagtgacgcaagcagccgccgcagcgacttggcgcggttctgcgtgatggtgttcaccgagatccgcatcctgttccagtctgcgtgaaatccatagattggttagagctttgatgtagtttttggttgcaacaatggcggatgagagctttgaggtagaataagcttactgggcagcgaggtggggctgagggtggccatccagagaaccttggagatggagttgctgacttcgatgttggctcagcccaggaacactctcacactcacgaacacaaacgccggtgagggagacgatgaacaatggattttacagcgacgaacgccgcggagccgatcgctcctgtatcttggctttattcctcactgaaccttgcaaagaaacaacgaaggagtacaggggcctcttatagaccggtgacacaccgggagctagcctccatgccggccattgcgccacgttccgcagaacccgctcgacgtcgccgtgagccacacgctcgcccggacgacgcggcttcctccgcaagaaccgacgccacgcacaccacgcactcccacgactcgatcaacactgcaacggccatgcaaacaaccatgcagcagccatgcactcgcgatcacgactcaatcaaactaacagaacgcacacgacgcacacatgcagcagcacgacacacacacacactgactcaaccacgccaggaatacaccatgacgtgtttatttccaacattcgacaccaagctcaaggccaacggcgccgacctcccggactacttcgtcctcaccctcctcactgtcatccacgccatcctcccgcagccctccgactcctgcaaccctagctctgcgtcgcagcccgccgaagagtattgcgcagcggccagcggccagcggcagtctccgcccccctcgccggccaacgcctttttccctctccgtgcgcgctcgccggccagcaacgaaggatgccgggagggagagagaggaggcgccggtcgctccctctcccgtcgtccactcgtccgtggatagagaggatggtgggtcccactcttttttcttttgtctaactgacttgtgggccccacattttgtttttattttctatttttatatttttcttccaatgtcacgtcaccgccacgtaggacgaggaccaagtcaaaccagccacgtaggcgtcacatcagccaaaaccaccatcaaaaccgctgagggaccttttttgcaccggttttgatagttgaaggacccattatatctggttttacggttgaaggacgaaaatcggattcgttgacaagttaagggacctttagtgaacttattccagtcaactttgtatatgccattagcccattatactctaaccatgacggtacgtgggctgcttttttggtaggccgtaggcttaagaaaactttttggtgggcctagcagaactgtctaggccggacagcccaacacaatgtcatggcatgcgcgacccacaaaaagtgaaacaggaaacccaaactgtttcttttgccttgtagatacaattcccacctacaagaacagtgctgtcactccgttgaaatgaaaattttcactctacgtccctcgtctaagagccgaatttcaatctgatcattcaacagtaaaactaagtgcaacacatcattatgttgcaaaaccggtgtaagtgaggtttcaagccaatattgagtccaatttagactaacgtgatacctatatggcttatttgatttggttttcatcctacgtgttattgacgtgacacctacctatatcacttaaagcaaaaaaaaaataaagtaaataattaaaacaattatatagggcccattgacagcaaaaaattaaaataaataattaaaacaattatatagggcccactgacagcaaaaatttaaaataaataatgaaaacaatttatatagggcccacatgtcagtgggtgcctattaaaaatatacaagtaataaacctacatgtcactcacctggattataagttgtcgatcgaacactcgaactcaagaattttttttttcaagaaaagctgtatatagatgtgttacatgcgagtgcaattttgcgttccaaagtgcataaacaagtttggaggtttgactatcagtcagggactaccgccggcgtcgagcagctcgccgcagtccgggttgggacagctagcgcgcgaaggcgcctgagccgctgaccgacggcgagctcgcagagcgcgacgccaccacgcgtacgtcgaagccgccgatgtagaggtagagcaggttaattcttaaagtcctccggggtgcacgacggcgtcgcagtcgcagtggaagtccgggaaagggcagcgcagcgcacgggcacctctcctcctccgccgcgacgcggggcctcgctcgcgacgtggctgacgacgacgcaggcgatgcagagctcgcgtacgtgcgcgcacccgtcggacacgcggcggccgtcgtacagaagtacagcagcctcggctcgtcgcagatctctcgcagtggagccacccgatgtcgtcgtcgctgatcgagcggcggcacgtggcgggacgcctccctggccgatcgattacgccgacggcatgcaggcctcgaggaactcctggttgggctccagcgccgcctcggccgccatgtttctgtcgaatgcttgcttttgcttctgcgaggaatgaacacgtttcagctactttgttcatgggaaactgtttgatgctcacaactgacaaattgtttatgtaaccgttggcagatccagctaggacctgagaaggttccgtgacatcactaaagaaatgtgctgaaattattttgcatgtacatgtacatcttcaaaaatccatctttcccaagatattagtattttttgacttcaatacagtcttcgagatgctatacattaaccaataatatctataaaagtaagatgttttaaataaaaaaatattgcatactatgatagtttgttcaatgaaaatatagtaacatcaaatttacgtgatcgatcttttttatttttttcctattagcagtcaattttaaaaatgtttgacttagtactattctaaaaaatacttatatttttatattttaggacggatgaagtaaccaatagcaatattagaaatttaacaagcttagaaattaatgtaccctttaatataaaaaagaaatatactataggtatctaattaagactgcgttcgttcttgagctgaacatctgagatggaaattggagcaagcaattaacatatgattaattaattaattattactataaatttgaaaaataaatttatttgatttttagtaacttttatatgattcttttatgaaatatattgtttagcagttcgggaattatgctaattaagaatgagatattaccttaagcctagatgccggaacaaaaacaacctaagtgtgtgttaaaggcgtgcacttatatggatgcgcatgctaataatagtgcacacacatattttccatgtaataaaattaggattcacccaaaaaaacacattatattcgcagcctgcgctaacctgcagggagccatatataaaatttcgttttttttttatcaaaagtgggcaatctgtaagaaatcgttagctcagcctatcgtgggctgaagtactaacagagagtaacaggctactgggctcatccccttgtccttaaccaagtttctaccggttctctcgcccaaaagacaatatcaacgcgcctcagctttgtccaatcatactcactagtcgccatatacagatgaaaaaaaaatgttccaaatattggtcgatgagaaatcgcgacatatcattatcgtttccgtcaagaacaagaactccgcatatacaaatggagtaatggaaacaggttgaatcgaatgatcgccgactcgctacagaacattactagcaatgattccccagattaagcggacggtctgagcaagtaaggtcgatgaatccgtcttcctcctccgattgtgaagatttgcgaggagtacacttgcatgaatacattctcggattaaaggatgaaccgcagtcgtagcaaaacacagtgccacatctgcaaacaaaatttatcacatgaatgtaagaaatttcatgccgacttaggaagcaccagtgatgtggtggtaaagtcgtgggtgtatgactctacccaccagagttcaaattaatgctggtgctcacaaatattacgcatatatatgtgaactttctaaaaaactttagtgagatcatgtatgtgctcctggtttctatttcttagagcatgtgttaggagacgtattcgcggagatgtgagtgttgtgttgcgtgtgtagtgttgtgtgtgcgtgtaagtttgccgtgtaatcgtaaaaaaatcaaagcataattccataactacgggtctacggctctatttgaatagctgaaagtggtttgatggatcatttattttttttctacagttatttcaaagcataaacaaatgaattataactactgcaaaattgaaagtagctttataaaagcattcaagatgtcacaccccaatccggcaccgccgtacaacagcacctgacaggagcgtgtcgtaggaaaaacggcgtgaaccgcttcctacgaaaccgcgatctcagtaccagtcccaggacatagcgctggtacccacggtgacaaatatgaatcattgcaatccttataataaatagaggacttatttaccttaacttaggttgcattttagaacagcccgagaatgcaaccgacgacacgaacgaggaaacaccaacagcagcagcagcagcggaaccaacggactaacacccaacaccacaggcgacggctgggaactaggacgaaaccctattcttcatttcacttcatcttcatttcaaggtgtaggaactatatatatatttatatagagcaagggtgagtactttcgtactcagcaagtcacgagaatttaggtgtttgatgcaagcttggaagagaggcaaggttgttttgcaaatcctttgttttgaaatcattttgaaattactaagtggtttacttctttctaagtttgggccgaaaagagacttgtgtcttgattcgactttaagagatgtttttcaataactcaattggtaatgtaccgacccccgggtcagatcattacttctcggctcccagagccatttcacttgattaagcggctcccagagccttttcattttctcggactcccagagtccaactgcccagcagcacaacaatccgcttcaactcgggaagcctagtctatgatgcccgtagacatcccgaatcacacagattcgtttcttgaccactcaggtcatccatctgccacataggctgattctggtaacgattcccaaaccacaacaacttttcacaaagcacaggcaaacaaatctacgctacaggaaacacctcacatccgcccatgaccgtgggtacggctgttcgaacagttagttaacctctgcagagggggtacactttacccacacgacattactaacccggatcacccagtccgtgagatcagccatgtcgggagaccctaaggttttcatgacaaggcatttcgaaagccgacacagggttgccatatgccaacgagaggggtcccagaccgacaacaggttaggtcccagaccatattgtgccaggaagcccgagggttctacctgacaccagcccgttgaatccacatgtctcatggcatcatggctcctccgattagctaattactcagccaggggcgtcccattgcacccgtgtggtcgcacttattatatgctcggatgaatttcccacaggaatcggtccttatatgcgaatacaggacagtaccacataggcacaacccccgcatcgcgagttttcacaatctattttgttttcaaacacaccgatgccatatgtcgggttttcaaggctctcaaacacaccgatacaaacaatggtgtatgtggaatagttggtatatgtgctcagagagcacggataccgaagtaccacaaaggtggaacgacaaggaatcagggtagtacaacctacaaaaattagtgcgactactgggtaggtctgtcggtttggcacgcaaaccgaggccaagcaagttaagtgtgtgattctactaatgcaagttgcaaacaaaataataatgattttccaattataggagcaattggtcaaagggtgatttgtcttgctcaaggtcttcacgaagcttcacgtatcttcgagaaaacccacgatcgatgaaaatccggtgaccgcaactatacgcaaacaatcaaaaacctaaacaaaagaccaagaaaaaatatcctatttagactaaataatagtaccattagatagatcacaattttacagaattactggaagtggaacggggtcaatcggatgagcggttgagaagatatggattttcgaagtttattggattttctaatcaaaggaaaaacgatttaataatttattaaaccctttttggaaagaaattaaaggagggatatgatttagacttcctcgggtggctcgggtgcgactcgagaggacaggcacgactcggccgaactaatgggccggccggcccggagaggcggcccaagggggcgcggggagagtgagggagagggagggccggtgggccgagtccaccttgcggggtcccgagtggggcccgcttgtcagtggcgcggctcaccgtggaagcggtgcatgcggcgcgcgctagggttcgggtaggagtggcgcacggattggtgcaccgggtggaccgaaggatggcaggcccacgcgcagccgttaggctctccgtggaccgcgcgcactgagagagagaggagggagcggacccgccttgactcggtcttcaccgaggtggcgctgacgtggcgcctccgtggcatgccacgcaggccggcgagaggaggaagaaagaggccggccgagatggacggcgggcggcgggggtctcaccggagcatggcgcgacggtcttcggccaagggggagcacaccggagtgaagaggggcacgagaggaggcgagccagtggctcggattcgccggaggaagatcgacgacggcggattgcggcgacgcacgccggcggtgagaaaaaagggggaaacggcggaggggcgacaaggattcaactcaaggtggtgggagtatctctgggagtcggggattctgtttccggcgccggatagggtggaggagcaccgaggagggctagcgtcgacggcggcctctaggagctgacggtaatggcggcgaggccatgccaggcgacggcattgctatggaatggtttggggaggccctagggagttcaaggacggtgttggctagggtggtcgacgagctggggcccgacgacggcgcgcgactgtgtgccgcggctgaaaaagcgcaacggcgaggcgcgcggcgcattgtgcggcaggaggaggaatacggtggggagctcaccggtgagggaggagcggtgttggcgacgcggagggagtcgcggcgaggtggtcgcgacggcggggcggcgcggaaccgagagggcgcggccgagaaaaggagggaggcagcgaggccgaaaggatgatgagtgtgtgcacacgctcttggccacggcagtgcggcaccgagcttgacgaggccgacgccgaggctcacgcggccattggcacaacgcggcagcgaggaggcagtcgcggaggggcgggggcgagcagctggcggccggcaacaatggcgcgggtggttcgagcgaggtgaagacgaaacgagaggggagggcgcgggctttataggcgaggaggagaggtcggtttggaggagggaaaccgacattggcggtcaagggagctcggttggtgttcacgggcggcagcggcggtttcgttggcagtgcgaaagcggcgacggtgtggatgtgttgggcggcgaaggcggtggatcgagcggcggaaattgaaccgcgagcgcgggctggcgcggcttggcgtggtcaaagtgggggcggcgaactggcgcgcggcgtcagcggcgttctgcctccgcgcgcaatggcatgggcgtgagagagaggtcgagtctgagagggaaaaaggggaaaagagggagaaaaaggggaggcttgtccatgccgttctgggaggaagagtgagaggggagcgcgagcgctggctcccgtctttggagggtagcggcaatgggcatcgggagagaggagagagaacgagagagagaaaagagagctctctctctctcggccatggcgcacgcgcgagcggcgctcgagggaaggggagagcggctgggagagggaagtgggctgaggggaaaatggcccacaacacccgagggaggcaaaataaacttctgcatagagatttgagttgggaggatattgggattggaatttggattggagagaatttgagaaggattttggaatttaaccttgatacttggcctctaggaacataaggtggagtcaagggaaggattcgaggtgggatttgaataattttggattcgaagaagtatttggcgaggattcaaggaaggatttgaatttcgaagacttgaattggaatagaaatcttgaggtggacgattttgatggcgatgagagggaacaaggacggatttgaattgagatccatggcacgacttagactcgcacataaagaaaagaaatttttgcaatcaggattttgccgaattagtttttaacgtcttgctaaaagcgcggcgttacaatattttagtaagaaaacttttacacaaaatgcattggttagcagtttgagaaacaagcaaatatttctttaaaaaagattttattttctccataaataatggtcagttaccgctaagatatttctctcccttttcagcgtccacttcgcgagggaagttcagtacgtgttcggtcaagtcaacaacggttagtcaaaactaacgaatggaatacgtgtttcagatgagtggcgaaaatttcgccccgatttcgaagtttggaagcaaagtttagagatttgagtctagcgatcgaaattaaagattgaatcgaagaggaggatcggagtagtggtgaatcgatgagtttacctgcatgtcatgcgcttgcacccatcgatcttgtcgatcatggcgcggcagctggggcagcgccgccactcgcgccccttggcgagctgggtcagcgcgcaccgtgcgccgccgtcgccgccgccgccgccgccatggcggtcgtcccacggctcctcgcactgcaggcagaacgcgcgggaacaggtcgggcaggacgccttggacgccgcggcgcgcaggggcagggccgcggccgccgcctcgccctcgagcgccgccatctcgccgcagtcgcggtaggggcaccgcgcgcgcgcggggccgacggcgcgctcgcagagcgcgacgcaccaccggtcgaacacgtcgatgtcgagcagcttcttgcagcgctccgggtgcatgacgccgccgccggagcagccgcccccgcccgccaggaggcacggcacgggcacgctccccgccgcgacgcgggcctcgatgtggccgacgacgcaggcgacgcagaacgcgtgggggcagccgtcggagacgcggaaccggtcgaacaccagcttccactccatgcagacctcgcagtagaaccgcccgatctcgtcgtcggtgagcggccgcacgcggcccgcgcgggacgacgacgacgacggcgggtccagcatggagccccggatcagctcctgcaggtactgctcccggtcgagctcctgcgccgccgacgccgacgccgacgccgcggcgctcgccatgggagggggacgacgcgtacttggcgctaattcttcggcgagaaggaactaggaagtggatggagtggacttgggctagtgcgggtcgtcgtcgtcgttggtcgcgatccctttagcctttaggtgggtgtgtgcgctttttaaagttgggcaggtacagggtacgattggaacggttagagatgagctagatacacaacaatattatgcttaaaggcacaatatttgctaacattacgtatcatgctgtgagtatatttaggatatttaggttgtctataacttccatatacttaaatcaatcaagtgagatcattatttgtaagagttttgtaaaaaaaagtacgtgtagcaggactcttttttttaattattattattattatgcatgtgcacacactactatactcgtaatcccatacttacgcacccaccaattctcgatatcttggcaaattcattacaatccgcatcaaccataatgctaaatttcaacaaatcgtgaagaaaacaacaaattttggttgtgatcgtgatgaaagtcttgaattttctttgtaatagtttcctcagttaaagttatgatagtagtcataacccatgctttactcaattactgaggaatgactcgggcagtgacccatgccacggtgccactccactttcctccctcccacctcctcgccaccatcagagccatccgtcggaaatcttgcggtgacaaggatgttagtggtgtggggccttttctcccatgagctcccagaggttgcgagcacaaggtgatagatttggaggatggatctggccatgatagtgactgtgatggcggcaacgcggttgaagcgacgacaactatgaccaatggtgttgaagacagttccagtagtggatctagcgctggtgatgctagatccagtagcttcgaggctagatctacgtgaccaacgcgtggtagaggaatgctcgcaaggcatagcaatggcgacactgggcaatggtgagaccgcctgcgtggaggtacgggatgggtgtgagcagttgctgtggcaaccccctcgtgccgacaggatgcggtattggtagcagacacggcgataggaggaaggtgggggttgaccacctttgtgtagaggtgttggcgacaactctcct

SEQ ID NO: 75690 - DNA, 1429 bp, Oryza sativa
tgtgggtttttggggccaattcgaattgtatgttttgattgaaataatcaaagagcatttttgggtccccagtccctgtatataggagtcgatgattgcttaagaataattggtgacttgctacgaatgtgggatagtacgaagtacattatttctaacccaattattgtttcgagatatggtagctttaggatggtgaattttgctgctgtcaagtgattgctccattcataacttttcatttgaactgaagcttgttcatgtctgattcaatagggtgccagatgcaagctatgtgcttccaggcagaacgctggctattgattctcggagacaaaatcttgcggttgaagaaggacgctttttcgcaaacaaccagggtttggagcatcccaggttgtctgaaacttcagtttctccaaggaaagaatcttaccttcacaatttggatctttcaaacgatcgaactgcgtattgccatggtcggaaatcaacggagattgtgttcagtacaagagtgccaatctctccccctggctcaaaaggccaaattccctgtccgacctcccctgtgcaatcaagagcattcgggcaatgcccaggatcccccactgctcggcaggatgattcacgaagctcaagctcacctcacccttttcctcgtcctccgggctccccatgctcatcatcacgtgtcgtcagttcacagtggaagaagggcaagttgttaggcagtggtacatttgggcaagtataccaaggatttaacaggtacttgcttttgaaagcatttactgtattttcatccttacggagatgaatatttcttttctacaatgcatactgaatcgctattcaaaaatgtatttaatgcagtgaaggtggccaaatgtgtgcaattaaagaggtcaaggttatttctgatgattctaactcgaaagagtgtctcaggcagctacatcaggtaatattcatcttgtcaacaaatagcatctgtcagcagatatttaaactttacatctttcgtactaatactacttcctatgggcaggaaattgtgcttctgagtcagttgtcacatccaaatattgtgcagtactatggcagtgatctggtaaatatagaactcatgatgattttatgatcttgtcttgagcatgtagttgcatcataagttaaacgaagacatacaatcattcaatcattacgaactctgaaattaggtgatgcaacagttagattaattgtaagtattattttccagtcataaaccactgttctgaatttgttaagagggaaactctgtggtatatattgtatgaaaatctgattttaatttgctattttatatatttttgccagagtatgcttcgttattcaatacagtctagtgagacgctttcagtcaatctcgagtatgtttctgggg

SEQ ID NO: 75691 - DNA, 3795 bp, Oryza sativa
tcctgcagcccgatgggcggaggccccacttcttgtagaagtttggcatggagaattcaccttcttcttcttcttcttctccggcgatggcggcggcggtggcgcggggtggtggttgcgccacgacgggcgattttgtgaggtattgcaccgggagaggcccatggagctctgggtcctcttgcagctcggcgatcacggcgtcgcggatgacggagtcgtaccagtcgttgtcgtggccgtcttccatgccggcgaagacggccggcgtgtccctgtcggcgagtagggcctgcctcttcgaggaaaccgagtcgttctcgttcgcgacgttgcggtgaacctcttcttcttcttccatgccgccggcggcgcctcctttgccggcggagatggccggggttctgtgttgcccacacttgccggcagagacggcaggggcggcgtggctcccttctcccgtggtggcggtgacggccgccggggtgtcggcggcggcggcggcggcggtgagctggcggtcggcggcggcaatgcgagtccatatccggccgaactgcgcgacgtttgggcgagggtttgcttgcaatgctgccatgaggttttctgccctagcccaacggccattgccggcgccacgggcatggccggtgccgggagcggcacgagccgccatacgggcggcaggacgtctcccgccggggcgggagcgggggccgcccgccagcgatgaggccgccggggcggagtgagagttcagtagacggcgccatggcagcaggtaggccctgtggtaaggtggcggtagagctcgtgccgatgtcggcggtggcggcgccgcccggcggccgcgggaggaaggccgtcgctgatcttgccggtgccggctgctgtctcgtcgccacggtgcggcgcccaccggatcgtaacggaggcggcacgtacagttggacggtccgcgccgccgccgccgccgccggcgcgtcatcatcatcatcgatgacgatgggttgggccctgctcccggcggcgccggcggcgagggaagacgtcgatcctacgcgatccatcggcggcgcgaagctgctccagtcgtcgtcgcccagctccatcagctgcgacacgtacaggtcacgcgcgaacgcctcgtcgacggcgacatcggcggcggcggcggcggcggcgtggtggctgctcgatgctcctcctccagtcgcagcagggtggggttttcctccttccatggcgaattggcgcgatcgatcgacttcgattctctcagagattttctagggtattagggagtcgatcgatcgatcgatcttgaatttcttgacctgcatgagaagaaagaagatgcgaattagggggggatttcttgtttctactcagaaaattaatgtacagatccgaggctgactgtactatctgaatttctatgtgttcagctcataaattgtactattggcgcctatatatatatgctgaataacaggaggtagatcaaagtttattcgggagtagaattgcatatatttccaaaaacacgtgtgcatgcgacttcatcggttaatattgatgaatatatactactcttgctttttgttcaaatattgttgtattttgttctcacttatattaagcaaaatcggcccttgtacaaatggtgtgcacataaataatctgataaaaatgataaacccacaaatacaatgaaatagatcgggatgtggatttagagtggttcctacatattatacacatagttttgcaaatatgtaaatatgcaaatagttgtcttgcgcaagcataaatacggtgaatgcaagtacataatacacatatattgaattgaaagtgtgattaatcagccatggtaagaaatgtcggttaggccaagaattcagtagagaatgatggagcagtggcaatggatctagtctgatctacgatgatgagaaaaaccgagaaaacatgaaggtaacttactagtgactatgaagaactaagggaggaggaagacacagttgccaccggtagacgagccacgccaaaagttgttgagagactagcggtcctcaccggtgtttgtggatggaccgatgggcctcgtcggcaatcacggagaagccgataggcttcaccggtgtttggcggcgataaaggggtagggcggcggatcgggattgggaggcgttagggtttgagggagaaatctataagcttcaatgggagtatatccgattgattgagatccgacagccacgatttatttggtttatgccaaaatctcttggatatatctattagtaccccataaattgtctcttccaacctcctattttaatatctcacccacctacttatttgacttttctcctactcattcactcctattcaacttttgatttctttgaagttaaaaagaaattaaaatctactaaaaaagctatcaacaattttctactcatctacccgtctattttcactcaaacatagaaacctatgcatcttgattcaatagaaagaataattgtttgaacaacgacgatcatttactaagaggttgtgaggaaaagatttagagacaatgaataatgctaggaggtggaagacaagtttccaaagggagaaactagcatgaggtttgtagtagcggtgaaggtcatgtacgccaagattttggtagagaatgatggggggagtggaagttagaagcaacatggaagtaagggcataggaattcacgatggatctaacttgatctacgattatgagaaaaaccgagtcgacgtgaggggaacttaccagtgattatgttgaacgcaagaggaggaagacggttgtcggaggctgtcgagagattggcggccttgccggtggttgcgaagggaccgacgggtcttgccggtggttgtggagagactggcacgcctcgccgatgttggcggagataccgaggcggcgggatgtgggaagacggcggcgggtcgggattggggaggtgttagggtttagggagggaggaatttatatgatcttcgatgggaggagatgcggttgattgagatccgacggccacgatttatttggtataaggaaacttctctagtgtatatccattaatgccccataaatgttctcttccaacctcctattttaattcctcatccacctacttttttaacttatcctactccttcagtcatattcaacttctattttttttatttttttgaaaataaaatcagctaaaaatttatcaacaattgtctactttttcacgaacacagagagcatttgcatgttgattcaataggcagaataattgattaacaactacgatcattggtcaggaggtggtgaggaaaatatttagagataacaattaacgttgggaggacaaagacaagttgccaaagggagaaactagcatgaggtttgtagtggttagcatcacttgctaatgttttggaggaggttagggggcctcagcaagagttggaggtgatgccaattcctaagtgagttggaaagggaaaacggcgggtggatcgctatggttttggcaactgcctctaaactagtagacatcgattaacaccaacataattccctttccaccttgtatgttaatttcttcccaacatacttgtttaacttctcatagtccttcattcttctacaacttctaaaatattcattattctaagaaatcaaaatcaactaagatgcaagctttgcatgtttaccatgtttggctactcttacatctttttattttttacaaacatg

SEQ ID NO: 75692 - DNA, 1242 bp, Oryza sativa
ccaaggatggcatgctttcaaggaaaggaacgctaccagaacatccatctagctccaatgaaacaacacttggaaaagacatctgagtacgggtagctggataaaattcacaggaggcaaggctcaagattttaacggatggagatgacatcttctcggcattgatacggcagcacttcatcttcagagcaatcagcgccgggcagcaggagaaatcaagaatgttatcgttgccaagaacaccatcaagctctaacctggtgaggcgctgagagatgagaggcacatcaggcagcgtgatgtacgcgggcaaagagatccgtagcacccgggcatttggtgggctgccccaaaaaaacagggctagcatgatccagcggttgacatgccaatccttccccttgtcctccgggaaatcgaagtccaggtcgcacagctccagaggcgcgtcgcggcggcggcggctgacgaagaggccgtccacgaagcggatgaacctgccgaggccgtcgccccgcagccgcggattccacccctcgacgtcggtgacgcggagcgccggcgcgtgctcccagaggtggcgccagcgccgggcgagcacgcacgtccgcaccgcgtcgtgcgccgggagcagcgatagcacggcgtggagcgcctcgtccggcagagcgctgacgcggtcgggcactttctccggcgccgctcgcctcggcggcgccctcctaatccggggcggcattccgtcgaacagttgccgcgctgagcgattagccgggcaacggagaatgatagagagaagcgagagatatactagttttataatccatcgaaccgccgccgcttcgatcgccgggcgttggcgagcgcgttcattcgtcccggaagggaggccgcgcgtagggccgaaaaatgatccgcactcctatcctccacctccgctactgcagttttcgagctccgattcatacactttctaaatactactccctccgttttacgatgtaagtcatctagcatttcccacaatagcagactaagtagtttctaagagcaggtacaatagcagactataagtcagctataaatatattttaaacagataaatgaagagagagaagaacagcgagctacatatctatagccagctgcagcacggactccaagacgtaatgtgtgtatgacatgtggaacccggtaataataatatagtaagcaactattgtatgaactaggaaggtagcc

SEQ ID NO: 75693 - DNA, 9723 bp, Oryza sativa
  unsure (1)..(9723): unsure at all n locations
acataatgttatagcatagtatgtacagatatttataaaacccaaatgttcatagtcagaagatattttcggtgaatcggaataggtgaatcgggataaggagattggaaattaattgtttgactcactctatccattctaaaaaccaaacttagaaatatatatatgaaatttgtatcaagatttatactttacgggatgaagaggttactttcatctcttaagaccggtaagacggcacgtatcatatgtcaatcaccacgttccttcgacttcacgtcagaggatcctaattcggcactgatatatcagtgaccaggtgagagagaagcgagtcagacgagctcaatcccttcccgacggccggctcgacggcattcctcacacgcgagtcgccactcgccggcgcggccgctcccttccccgcacccagcaggcgaggcgaggctcgccgggccttgccttgctcccctcccccccttcggcttcaagttgctcttactctccaagttgctcttcctgtctcaactctgttcttctgttcctaaccccaatttcgaattctagttcgtaacattggttaaaatagtcgaatgattaaaattgtccttgtcagtggttagattaaaattttactaccctactactgcagcagttaagtgctcatctaaagactataagaacttgacaagttgacatcaagtgtttgatctgaattcactgtatttattatctaatctgcttgcttatcttgagtggttaactattttacatgacacctggtcagcctggtgttgttcttttttcttttcattgcttcactttatgtaattttgtctctgtttggtaatcgaaatcttcagagttcacaatcaaacaatgggcattctctagcttgtctgcacataaaagataggatatgttgttttgttccctttatagtaaccatattgattcagatccaccaaacttatattgtttacccttatgaccataatcaaatagtgtaagtgtggtgcaatagacgcatgaatttctgtatcaaaggcctatctgttgggaagcaggaagctttatcaaagaagtgctctgttgtgagtacagggaggaggtgataataagtcactgttaggataaaacttttgtgagtgataacaaggacaactgcatttgagtctattatcaaatcactgaaattttctacttatctcatgcaggtttgtgtttaggttggccgttttggatcaaagcaaaggttctgaaggtttgggctgttctctattgacgtgtgcatgcagtctcccttattattcagaaacgacgacagcagtggcgttgctgtcctctgactagtcgtgtctcattctccgtaccatattgatgcaatctagacatatcgtttgctgcaatgtcctttttatgtgtttctggccgagcggatgtgcgagcctggattcttcgtttctgtgttgatcttcagtggctcagttcaactagttggcactttggcctgctatgtcaccaattaatttgtgccttttattattaggccttatttagttcccaaaacaaaaacttttcacccatcacatcgaatgtttggacatatgcatgaagtattaaatgtggaaaaaaaactaattacacagtttacgtgtaaattacgagacgaatcttttgagcctaattgcgccatgatttgataatacggtgctacagtaaacatttgctaataatagattaattaggcttaataaattcgtcttgtagtttcctggcagaatttgtaatttgttttgttattaaactatgtttaatattttaaatgtgtgtccgtatatccgatgtgacaatcaaacccaaaaaatttccccaactaaacaaggccttactagtgagaagcgctatggttgttaacagatgaaaataaataacatgaaacaaaatcttggccaaatcttgtttgttaagagaaaaataaaggtttgtcaatgataaaatagtagtaaattgtattcaaattgagatcatctaatgtaaggcatggttacttacatgtgggacctatccacaggctcacatatcagtgaccacatcaagtgggaggctacgttagaggaactctcttcgctgcactactatttgatcatgtgctctctccgtctcaaaaaaaaaaaaaaactcaacctagacgggaggtgtgaactatcctagtacaattgatatggacaattatatatttagattatcgtagtaggagaggtcatatctactttttttttgacgaagggagtaggtatacgcttgataataaataatactccctccgtttcgttttgtttgtcgtttccgacagcttcggcgagattaaggttgacgtgaatttacccttttgcccttcctcttcactgattcattccccttcccttctacgcgtgacggcggcggtgccccatctcgatcccgagcgtcgtggcagggccgacggcggggacggcggtgctcttccccaccacccctgtcgcggcttccccttcccacgggcagcggcgccggcatcctgcttccccccgccggtgagcacacccttctctttcccctcttcccacaccttctctcacctccctcccgtctcttcgcgagcctgcgcccaccgccgccggtgaagtcgccggccaccgcatcccgccgccgctctccggctactaggggtatctggccgacgcatcctctcctccgaagctgtagagtagtgtagtggcgggtggcgttctttgcgatttgccaccaccgggcagcgccgccggctcgccatcgccggagcccagcaagaagctggcgtactgagattttggtcagggtagtactcacactgcggcactgccaagtccggcggctcgttggaggtttagcatattgggtttagatgatgctgatcacgttcaagatgatgatgatgatgatgataatgaattgatgttggtttaataaggttttagtgggtggtgattaaggtttgatcttgaattgttcatgtggcagtagcttttgatcttttgattattcgcaatattacttgtagatttgctctgaatttttgcaaggtgtgttgtagataattcttcattttgcaggaacgatttgcttctaataaaatgcttagtgtgacaatgaccatcatggcaccaatatttcacttgtaattagcagttttacctaggtaatctgtgactaatgcaatgctgacaccacagttgagctagatcagtggataaagtagatattatctgaacattatttgtgcctaatgtaatgctgacactatagttgagctacaccagcagaactaaattaaaatgataaattctatctgattcctggacaacagtgtatggtttacggagtagtttctttgaattgatcggttgttgtttaccatgtgtttcttgtcttctggtattttttaccatgtttatttggttgttcatttcttgtccgttcttgattttgtatggaagatactgggtgttcttcctggacgccgttggtcatgacgaaggaggagggcagggtaggtagacgtcgcaaatttgtcacaccatggaagaaagcggctcagaaggtcggcgacgncggtgcagaggatcgtgtcgagcgcctcgccgccgcggcttcgtcctcaactgctctctctccaaggttcgtattcgattttttttcgatgatgtattttgtgttcctaaaatgtgttattttcaggaaaactctatagatgctcactattgcgaggttaaatgaattttcacatctaacctcacatagttcagttcatggctactgcttgtgcaaaattcgattaattagagcaaggaaatagcattgtatttctatttacagggagctattgctggttgttctagtttatgcaaacatttagcataagtcttttccttatcttattgcttcataaattggagttcttgttattgtataatttcttgttagatcacatggttgtctgtccagttatgctatacaaccagtactagatgtcttacagaatggatgcttttaccttttctcagaaccttactatgcttttcactcttaacatttgatgcaacttataatccaaaatgtgcattcatgacaacttcgttgcaacaccttttgcagggttacactagatgggtccaatgttggagggaaaaaaggcaaaaaaaggaagtctccctgcgtggcaatgccattctttagaaccccgttgagcagaatgttactgtcccctagcatacggataaggtctccttctatacaacaacgaacatcaccttctgctacaacccatggaatttgtcaaggtcgagagcaaagaacaatggatattgatttaaatttggaaccgggagatacatatgctgccacagatcccggagaggctggatttgatcacagtgctgccacagatgctcaaggcaatggagaggctggattcgatcacagtgctgccacagatgctcaaggcaatggagaggctggatttgatcccttcgattcaaatgctgatgatgatgtcctagtcactctagaggagataggtgttgaccctggccaggagaatgtacagcctcagtttgatcctttcttcgattctgatgttgatgatgctatcctagttcctcaggagaatacacacaagaatgtcgtgcttgataatgacaaacggagagcaatctttgacgccatgcttgtaaaggcaagaaaaggatatttgaagggccatgagagcaaggaggtttcagctaaattctcggtgcctatcaggacagtacagcggatatggaaaaaaggcaaaagctgtttggatcaaggtatttcagttgatgttgcgagtggaagatctaggtgtggcagaaagaagaaggtggtggatgtgtcctgtctcgaagatatttcaatattgagccgcaccacaatacaggatgtagctactcaacttggtgttagcacgagtaaggtctacagaatgaaaaaagagggtgctataaagcgtgtatctagctcattggatccctacttgacagaccaaaacaaaattgatcggctgaagtggtgtattgaaatgcttgacccaaggagtgtgcctcacaatcttgtcttcaaaccactgtttgatttcattttcatagatgagaagtggttcaacattacgaggaagactgtgcgatattacgcagctccaactgcctcgcgtcgcatcaggacaattcaaaacaaaaacttcatcccaaaaataatgatcttaacagctctcgccagaccaaggtttgactcaaatggaaactgcatctttgatggaaaaattggatgttttccttttgtgacatacacagctgcaaagaggtcaagtgtgaaccgtcctgcagggacaatcgagatgaagcccattgagtcaatcacaaaggaggtaatccgaagcttcatgatagaaaaggtattgccagctgttcgggctaagtggcctcgtgaagacgctggcaaacctatatacatccagcaggataatgctcggcctcatattgcaccggacgacagaatgttttgtgaggccgcgaagcaagacggctttaacatcaaacttgtttgccagccggcaaattccccagatttgaatgtcttggatctgggtttcttcaactccattcagtccatccagtacaaatcagcctcaacaacaacagaagaacttgtagccgccatcgatcgagcatttgaagattatccagtgaggctatcaaacaggattttcttgtctcttcacgcatgcatgagggaagtcatagaagtactcggtgacaactcctatgatcttccacacataaaaaaaggagtgcttgaaaggcaaggtcgccttcctttgcaactaaggtgtgatgctaagtcagtaaataatgctaacaattatctcaggtaaactactttggttatattttattttcatgaaaatcgcttcatgtgcctaactagtttgatgtgtgctaattagtggcattctttttactccttttcaggaccatggcagatacctgatatgaatttgtttgttgctgcagcagggtgcggatatgaaattgctgctaagctaatctgaaattttttggtgttgctgctgttgctgttgctgctgttgttgatatctgaaattgttggtgttactgctgttgctgatatctgaaattgttggtgctgttgttgatctgaacagaatgaattggaggctttcttttttttctctctttttctagaaagtagcccatgtgtgcagtcattctgtgcagaacatgtcctttgatttttgagaaagcaggaggatatatggacctgaatatgtcctttgatttttttattagtatttttatttcacatgaacacattagctaagcttatctaagatcaatggtgtgaactgtcaatggtcctttgatataattacagactagctatctcaatttacaagaaacagcaactgggatggcagcagccactttacaagctctgtgtctgaatactctgtttacagactagctatctcaatttacaagaaacatcagctgggatggcagcagccactttacaagcttggtgtgcatctctgaatctgtatctcaagttccaatttttgtttccaatttctcattataacatccaaaattcccacgcatattacatcactgacagtactaagcactaatcatctgatcaaatacacaacaatcagtccccagtgaacacgaccagaatttcccagaaacagaaaaatttccccttcgatgaacatcaaatagccaagcaaatgcaatgtgcattctctaaaaaacgaacatcaacaatcaacatacggctaaccaaatcagacaatctgcaggccgttcagtagcttaatctgcaatcaagtgcacagctatcttaaccggatgaaataatcaggtaaattctggacatccagctgaagaaagaaaaaagaaaggaggagacttgtggcaatggagcttttcgaagcccggcgatctcctgcaccaacgagacgtgcaccagcaccgtcctccacgccatgtatcagcctgcgaacccgccgcggccgcgagcagcgaacgaaagaatcagggaaaagccctcgagccaaagccgaatcgagaggaggagagggcagccgtaatgagggcgatgatggagaggacgaaggcgaaggcgaggagcggccggaggacggaagacgacggcgatctcccacgctgccgccgccagcgtggctcctcctccggccatggtgccgcggcggcgctttgtcggcggaaggggactatgcgcgtgggaggcggcgccggacttgagcgccatgcgtgaagggcctccccgtggcaggggcaggaggaccgccggcggaggagctcctctgcttttccgcgccgccgactgaggggtaaagatggaaacggtatcggccggtgtactacgacgtcaaacattttgactctttttgaaatgagctacagcgacaaacaaaacgaaacggagggagtacttaattaatcacgcgttaatgtgcaacactgttttcccgaactcagcctaaatagtaaaggtgcagtgttcaacacacacaagggaacacagcttcactaaaggatgagatattcaaatattgtttgtataagcatttgagaaggatctatatggcagcaggttcaatcaaaatgggttagtcctaaaaaataaaatcaaaatcacaatgggctgaattggaggataatatgtgcatttgttgacatttccatcagtaaaaacagtagaacatgcacaaaagtatcagcagatagtacatgtaagacatagcaaacaaaattcagaaatactcaatgcatactgtgattaagtcagaacttatatataactatggacagtgcttggctctacaacacatattgacaactgcataataggaagcgtgggtgttcatagataactcacagccagaacatcggatactaattttctctagtggtacaccattggcattcaagaccttcaaaattttgagaataatcccatcaacctctctgcaatagatttcaactatttgaagatggctagctgcaaatggttgttccaattgattgaaacttccatccattcccactaaatttttgggtacctgatgccaacaaatactttactaaacagatcaaagcaggacatacatgtacaaaatatagtaatacctttgaaactctaagaaaaagcctttcaagaagaggtgcgtgttggagaaaccaagctagtgcactgaggtcaggagccacaaaccatgcattcagaaacaaagtctttaacttgctaaatgtagagcaccactttaaatccctgttgaaaaggtactgcacataatgcaaggtcacaagatcaaataacgaatttaccaaagaaaagttaaaatgcaaccagtgatcatatagtaatgaacgtctgatgaaaaaggttttataattcatctcttctgtatgttcatctaatgtgtacaaaagtatcctaaggctggcgcaattcaaataagttagcaatcactatctatctggttctgtaagaaattgcaaaactttcaattatgctgtagcatgacaatcatgaacaattaggtgaagtgtgatgatttgaaaggaacaaatgaaataagcttatgcatgaagtcatatgtcaatgtaattttagctatggttgcatcacaagaagtgataaaactcaagataatgctacgagttacgagagaagaagctgcaagcataccactttagaataagctaacaaagtcaagtccgtagcttccgtcaagccttcgagaaacacgcagtcgtattcatcaggcctataataatcatgacaacccttacaaccagcatccccgcaatcatcgtaccaaccatttgcgcatcggtcatgacagaaatgatcaagcctaaccgccgcggttgccaacgaaggcatcgtctcgagcaacggagtcctcccggtatttgtgttgaacttgaaggtgacaaggctagggaaatccatcctggtgcgatagtcgcagtagaagacgcagtatgttatgctcagatgcttcaacgatggagaccacatttccaggccaccaacgtagcaatccttcatcttgagatccaccagcgaaggacagctcgagaaatcaagaacctggtcgtttccctggacacccctcagctctagggttgtgaggctgtgggagacgaggggcgagtccgagagagggatgggcacccgggggtgggtggagacggcgaaccggagcgcccggacctggcggcgaaaggcgcggcggatccaggtgtcgccctgcagctcctcgccggggaaggcgccgtcgaatctgaggtcgaagtcgcaggcgtccagcgccgcgcccccgcggcggaggcggagcaggctgtcgacgaagcgggcgagcgcgtcaaagcttgcccaccccctgtccccgacgacgcggacggcgggcacggacctccagaggtcgcgccagcggcgggcaagcacgcaggtccgcaccgcgtcccgcgacggcaggagggagaggacgtggtggatcacgtcgtccgggaggtcgctgatgcggtccgctccgctcgccatgtggtggcggccgggctcttc

SEQ ID NO: 75694 - DNA, 7639 bp, Oryza sativa
gcttgaagaagggcatcccccgctcgccaagtcttgaaacaaatcggctgagcgccgccatgcatccagtcagcttctgaacgtctttctgggtacttggcggtttcatgttgaggatagcagtaactttctccgggtggcttggatgcccctatgagacaccataaagccaagcagcttccttgacggtactccgaaggtgcacttttcagggtttaatttcatcctgaaaacgcggatgctcgcgaaggttttttctagatcggagatcaaatcatcttttgcttggtcttgacgactacatcatccacataggcttcaacgttgcggccgatctgtgttgagaagcatctctgaatcatgcgttgataagttgctcctgcgttttttagtccgaacggcatggtgacgtagcagtatgccccaaaaggcgtgatgaatgaagtcttcaagcagtcggattccttcagtcggatctgatgataccccgagtagcaatccagaaaactgagaagctcgcagccggcggttgagtcaactacctggtcaatgcgaggcaacccgaaaggatcttttgggcaagatttgttaaggtcagtgtaatcgacacacatgcgccattgccctgttttcttccgaactagaaccgggtttgccagccagtcgggatgaaggacttctttgatgaagcctgctgctaacagcttggtcaattcctccttgatcgcgtccttcctgtcttgtgcaaatcggcggagtcgttgtttaataggtttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtctcggcttcagtttccccactttttgaaatcttggcagcgggcacttctccttcgctcaccgtggttgcagccagtcggatttcctctcgggcagacgccatctcgcgggtttgggccatgtcgcaactctccttgtcgcatgtgacagcttgcttgatgtcgctccgtagggttaggactcctcggggaccaggcatcttcatcatcatgtacgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccggaagggtgatctggccgagtggagtggcggataatcctggaattactccatgaaaaggcgcattgctcggtttcagctcggagcgagggatctgcatatcatccaaagtcttggcgaaaaggatattgagtgcactgccgccatcaatgagggttctgcgaagcttgacgttacggaccactgggtctagtaccagggggtaccgccccgggtggaccactcggtcaggatgatccgagcggtcaaacctgattgcgatctctgaccatcgaagatattggggcgtgtcgggctgaacagcattgatctcccgttcggtcagcttttgcttccttttagactcgtaagccatggggccgccgaaaatatggttgagctccttgcggtggtcttgaaatccagccggggtgtcgccgtcgtccttcttccttgacgtgctttgttcctcgtcggagttcttccgagtagacttggtgtactgctccgcgaactgcttgtagatgaagcactctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtattcttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttacgttgttcagaaaatcgtcggatatactctcgaagggattctccggatttctggataacgttgtaaagatcatattgtgtgccaggacgctcgaaggtgccttggaagttggcgatgaagtggtcgcgtaattcggcccaagatccgatcgtaccacggggcagtccatggagccaagatcgggcggaatctgccaaagccactggtaaataattcgccatggccttgttgtctcctcctgctgcgcggattgcgagaccgtagacggtgagccacgattctgggttagtggtaccgtcgtacttctctattccagtcggtttgaagccggctggccaatccactcgacgcaggtcgtcggtgaaggctgctaccccatcaaggtcgtcgtcgtagcggtctggcgagtggtgacggcctcgagctgctcggcgctgtatgattgtgtcgcgaagatcgatggggcggcgacgaggcggtgaacgtggccgttctactcggcgctccccacggtagtcgggaggcgagtgcacggaccgctcgtcgtgacccctgctcctgcgattggatcctgcaccggtgatgctgaggcttggatgacggtagtcctgagatcggaagtgggggactcggctgccagtcggcgtgtggacgctttcggagttaactgggaccgaagccgcgatcatggtcttcgtctggttcaagatgttgacgacgtggtcggaacgattgagctcgttttggttgaggagggtgtcgagaagggtgatcgcggcaaccgcattctgttgaggggtgcggaaaaccggtgtcccttcgacgtcttgttggccgatgagatcacgcgctcggcgccctgcttccaaagctcgctgacgtcgatcttcagcctccttggcgatccgctcacggtcctgctgctcacgccgtagccgttcctgttcttgtgcttgctgctcctcttccagtcggcgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgtggtagcgagagctaaactcatcgtactccacgatgtcggtggggcgcgagtcgacggtgggagagctgtagtggtcatctagctgatccgtcgaaaccgtgccgagtggttggaggatgacgccgacttccctgaagctaggcgaaatcggtgttgagaccgacttccgcataggcctacgggatgaagacgctgtcgtggtggagacggccgctaaatcgtcggggagcttcatcaggactggtgggtaagccccatcatcttgatctggtgtcgttggagaagatgcgatctcagccgagtggtttgaagccgactcgattgagatggtcttgaagtaggtttcagccgcgtttggaatccaaacgggactgagatccggttctctcccgactggtccgattccaagtcaaggagagaaatcttgccgaaattgtcggtgacgaagtcgaggctgccgaaccgaaacgtctgcccgggtgggaagacgaggtcgtcgatgccggaggaaggacccattgcactgatcggcgaaaagcttgacgctacccctacctggcgcgccaactgtcgaaactagatttcggcaataataaaagggggtggctatcaagctggaaaagtgtatgggtttggagacaaaagatttatacaggttcaggccttcttataaaagaagtaataccctactcctgtccggggatgaatccgccgagtgtattattgattgtgtgattcgggaaaaaatcagcatatgcccctagaggcgcccggaccccccttatatatgggaaggagtccggattacaaaagataatctatattcctaacggaatatgaagatacaggtaaaatacagtcgtaaccgactaaatctcagggtgtttccttgatacacaagttaagaaacaaacccgagatacagataagatattctatctacattaagtatccggtacccaatccaaataccgtcgccgtgtagatatgggatacccataatctccacaagctgtagcacatttttatgatgttcaccggtatcctccacgaaatttgagtgttctctactaaaatttgcctatcgtcatttctaaattccagtaagtctgtatgtctttccaaatgtttgcagcaaatcaaattacaagaaaattttaatcaggttcatgcatgcatatatataaagtacatactactcgagggactaggtggcagaaggatactcgttaatttaatttgctttgcacgtgtgtgtgcatgtcactgctaaaaacggccgggttcatctgtacacacatgttcagttatggggtgagtaggacaaaattctccaagtctccaacatccgatccaagtagcggcgtcatcttttgagagctgacgtcaaacgacgtccgtgtgagctcactgtttcttagctgaacatatgcttaactggttgacaacttgccactatcaaaagggtaagtactcttcgtgccataattaatatagattaattaattattataccgttttcttgatgcgcgcgtgagaaaaagaatgagatgtgtgaaatggataactatacgatgaatttccctgtcatatgcattttaatttatgatagagatgaatgatcgaaacttaaatttatggaaataggttcaagcaattcacttattatagtgcttcacaatgttcttttcttagtattccagcactacagctcattgacaatgacccaacagtacattgaaaatatttcagtagcgtgtggatcgaacaaatcaataatatttctattgtatgttagcacaattaaaacaaattaaagcttatgcaagtggggtgatctagttttctgaaaattagcaagcatcggctagagattttattttttcatgagaatacaacttataagccgctggttaaacaacggttatgcacatttttatcaattatacagagagctttagcaatatgttactccttccatcccagattagggggcgtgtaattttttggctggttttccagcatacaaggcgtaatttctatttgattcacgtactgtctcccgagattaccttttcctgattcacgtgcatttgcagtggcaatttcctttgtgtgttacttaatttattgctgcgcacactgctacacgaaatattttcctcgacgctagacccatttatttccaggcgggacataattggcaccgcatgggataatcggaggaccgacaacatgctgtcgcccgcacgggaaaacacatttatcccgtacgggccactttactcaaccgcacgcaaaaataccgtgcgggcctctttactagccccgcacacaaaaataatcctcatcctcactccttaactctcccactcctctcctaccactccactccttctctactcccggcctctcctttcctcacagcagcgacagcagcggcgccgggcgacagcacgcggcggcccctccctccctctcccgttggctcccctcccctcccctcccctccccttgcagatccagcggaggggagggatgggggcggcggatccggcggtggtgggcgcaagcggaggtgacagcggtggcgggcgacgacggttgtacacggccactccctccccttgcagatccggcggaggggaggagtgtctttggccggcgacgggagcgggaggtggatccggcgtgggaagagggcgacgacgacggcggcagttagggttttggttttttcttttttttgttttgattttttattttaccgtgggggcggcttaagcgcccgaccgcgaaaatcgattttcgtgggcggtgcctcacccgtacgaaaaaatcgtgattttggcagacgatggattccagacgggcggaaccaccgcacacaaaaataagtttccactgcacgcaaaaatcgtgattatagtagtggccggaatattgatatttcccatatttagtacatacacaaatacgaaaaaaggtagataaagcaaaaggtttcgcctcttgcatgtgcatctgtgtcttctatgctttctaacctctcattaacgttataaagttcacttcccatagaaattaggaaagaaaattaaaggaattggaaacgttactctctccggtttcaattatattatcagcttttatttttagtaataaaataaatcctgacctttacttaaagaaagctacaactaattatttaaaaaatttgcaattcagcttttatatcgatcgagttaattaatttatatttttgacaggagaaagctacagcatttattttggatgttcattcctgggactatgaattcgtcttggccctttgatcattgagcagctatgcccacggcgagacagaattgatactatgtctttacaaaatatgcagcattaaccaacaaaaatgaacttacgatgctcattagtactgcatgcatgtagacactggaaataattgcagatagtagaaaatattctctttgccccaaaatataatgatctagctaggtatatatttgatacaatgtttacaatgaatttaaacaaactctatctctagatttgtagcactaacaatctaattaatctatacccacgttacaaatattttgggatggagataatataattctgaaaaccgtgtataaaaatcctggggtgaccggagacatatggcataaggatgtcattttcaactgtaagataaccacgtatacggaagtctaatagaactctaatgaagttaaaacggattatcgtccaaattcatgcatgcaagggtggccagcacgatacagagaaaaactggtttcattaaccacacgtgtgccactatatatcacaaaattaggccatgtactcatgtgcacatgtgtgtagttatggatggcacaaggacagtttaagacaaattatgtctgtgcgctatctgtcctttgcggccgcgtcgtggataggtgttgaatttaatttgagagtgctctcaaatggccacatgagctcactgttcatcactgcttgatcatctgctctgaaagttctgacttgtctgaatcgatttatttggcatcgatcaagtggctactacagtgtaatgttgttggtgtacataccgtatggtaccaacttgattgttggaaaatttctgccaccgtagtggacacaaggtgcttaattgccacttattatgtgtacgtatattacgtatgtgctagtgactgagtaaagtccttttgcacatttttaaacatcgacacagtctttgagatgctactttaacccacgatatctataaaagtaagatatctatcttttattata

SEQ ID NO: 75695 - DNA, 1091 bp, Oryza sativa
tctaggtactccacaaacatatccctaggaacgtacgtcggcgtgcccgccggatacgccatgtgtggcagctcgcagaactccttggcgaggtgtagcttgaggcggtcgtaggcacggtggcgccacaacgatgcggtgctggactcacgctcgacaatgatgtatggcacatgccgctgtgcaaggcacgccgccgttgctaggcctgctggccccgcaccaacgatgagaacaaccacgtcctccatagcattcattgctaggtaatcacgtagtaggatgtaactagtgagcagaagtagcgagaagtgtagatagtagtgtttttgtggtacatgctattgagggttacaggaggtatatgtagcatggaaattggaacggattcacattgctaatagcagataattcttttttttatcccatttggatgaaattctggataaatccgttgcatgcattaaatgcggccaaatgccatataagttataattcttgtatagttgcgtttatatctcaaaattgtgttataatgtgaacttggaaaatatagtgacaaaggcgtgttcaaacacattaattaatttctaataatggttgtaagtcaaggagaatggacgtgcctgtataggcaacaaaagttatttgtttaggctagagaaaaaagtatgggacgctttcacaccattgttttagaaattaccgttggatatactctttgtttctaaatttacagacttaaagctgccgatcgtataggactattttacattgtaacacaaattgacatgtaccatatttttatttaatcatcaacccactgcaccttaatgagcatacatggactttaggctttggttgacaagaaaggtgactgaaataatgaacttagctcgtatcgaatacttgtctgttgtctcgtacaaatgtacaaccgacggtacgaatgttaaagttgctcacaaacgagaacatacatgcaagtagactgagcgtgccttgctaaacatgacggacacacaaaggctataagaatgtgatatatattcattatactccatgtgcatcaggactgaggaatatgaatg

SEQ ID NO: 75696 - DNA, 8071 bp, Oryza sativa
ccttctcctgatcattgcactgcaggagattcagcttcttctcttatcgcatggagccagtcatttgcctccatggggttggtagtgctggagaaggtgggtggcctgacacgtagaaactccggcaacttggactgagggggagggggaccaaactgctggtgctgctgttcggcgtgctgcatcatcctctgatgcatctgctggtgctgctgctgcatctgctgcatcatggcggccatcatctgagtctgatgtgccataacttgggcaagcgtcggattctcgggaagtggtggcggaccattgccagaatcaccgttggggtgcacaccatcagcgcgttcttcgccgttgctgccctcgcctgccgtgcggttgccagtcctggtgtagaccatctggagggaagagcagacggggaaaagaagaaaaacagatgctcaagaactaagctttattatataggaattaaaactgcaattgttctgatctgaattaaaacacttaaaaagagcaaacaaaaatccttattaagacagccatatcataggcacatgatatcgaccgtcgactgaccccaaacgagcaacctaaacacacaaactaacaaacaaaaactagacagtcgataaactaatgggaaaaacgagcctaatgctcggaacggctcctgcggtcggtggagtcgaaggcgtcctcctgctcgtcacccggtccctctgagcgactcctggagcctgacggatcagtctcgccgctgccactgggagtagcagacagccaacctccggtaccactggctgaacctctggcggctgatgctggagcgaaggagagagtgaacgcgggagctggaactggagctgcaggaactgcgggcggaaccggagctgctgcgggagctgctggtggaggtgggttcctgggcgcaagctggatgcgcacaggtgcagtcgtcctcttacggggcgtggtgcggatccggactcctcctggcgctggaagacccttcaactgagcattctccttcttcaggcgcgctacctcgtccttcagagcgacgatcctcatgagcttcccatcgttcaaggccttggtcgccttgtgcaggtccgagtgcatcctatccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtaacctggccatcatcaagtaggctgcctcctgacaggcatgatctgcggtgcctcctgacgcctcaaccgccatgttagcgaggcaagtccccacgtagccatggacctccaagcggacacggtgaggaagctcgccactgagcggtgggatggtcgtgtactccggcgcgtcggggtagcccaccaccagggtcatgcgtgccaactctgccacgaaatcaatcatgccttctccgcggtggttgggtgggtgaccggccatctagagaagacaaaggagtaggatcaatgcatgctcaaatccaaatttaaataaagcaataaagactcaaataaaggaatcaaataagagcaaaattttatgcatagatcattttacatgagtgcgaataaataagactcacataacgataaaataatgggaaattagatacataataataataacgaacaaagcataaataccttgcaacccatgataccgagctaggaccgaatgcatttcacccatcaaatcccaactgactgacgaataaatcccaataattttactaaaaccctagactgactcgttttgaaaaactcactttaaacgagcgaccaagatttttcccttgaaccacaagaacagatccccattttcccggaacaaaatccaattgcaaagaacatatgcaatgaagaggattcagagggctcttaggtctttccatttggcttgtcctacggtcaaggtcggctctgataccaacttgtcacgcccagaaattcccgaataggattccaagcagaatgtgtattaaaacccccgtccaggaccagccggggtacacaaacgacaatgttgacatacagatccacgtcttacaaacatcataaaggtcttacagaaatgcagcggaaaacaaaagaaactggagctaagccttgacttgaactgcagcgggaacaccactccacaggcatcctcgacggcacggacgaagcctactcctcagggaaaccttcatctgacacatacccgtcctctggggttgggaaaagtagagcaagactgagtactacccactgtactcagcaagtcataccggaataggggtatgatgcagggaattaacaaagaagagctagagtggttcatttgcataaaaactggcatttataaacaggaattgaatgcgaaaacggttgtaataattaagcagtattaaacatccgctgtccaacgctaacccacgttgcgacaggcccaaccatccacctaaactatccaattcaacagatttcactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctataatctaggttttaaatgagatccccaatgtgtgctagttgatctaagcatggctaagcaattcctagtccaaagtctaatcatgttataacccaagctaacaaaggagcatgatatccaaaagcatggctgtaacaataggtatcccacccatagtgatattataaaacaatgcaatatttgaaagaaaacaatagagcatttgcaaaatgggatcaacatgttcaagtgacaagcatgacttgccttgctctgctgctggagggacctcggcgactatctcgaagtacaccggagcgtcggagggatcggaatctagcgacatacaaagcaaacattgcaaacaggctataaggctactgaaacagagaacaaaaccatttttaatggattctacacatttttcttgatttactgagacttgaatgggattaaacggagctcggatgaattagttatgaattttagaagattcactgtgtttattactataaaagaaatccttaaataatttattgcgcaatatcaaccagggctgacgtcagcgagggggcgcggcgccgacatgcggggcccaccggtcagcgaccgggagagagagaaaggggggtggcggcgcgcgggcccactggtcagtggcacggggaaaggaggggcggcggcgccacgtggcggccgaaccgacggccccgatctacccaagggtagatcggacggcgacggggacctcgcggccgggggcgcgcgggcgcggcgcgagacagcggcgaccatggcgccggcggcgcggcgctcacacggcggcggcgcgcatgcggcagcggcgcaaggcggcgaccgaaggcgaccgaccggcggcggggagcggcggctagaggaggagcggcgggcggcgataaatgcggccgccggcgcggctcggcatcaaagccgaccggccggctgggttaaacggcgacggcacgcatgcgacgacggcggctaccggcggcacgggaaacggcggcggcagtcgaaggcgacggccgacgactcgaagcggcggctagcggctctaggaggagaggaagaggaaaagaagggaggggatgcctcaccgagggtggccggcgcggaggaaggcgatggcggacggcgacggcaagccacgggaggacggcgtcggctagcggacgagcttcggcgtgccctaaggaaggagaagagagggattagagagagagagatggaccatggcgatcgggatccatggccgaaggcggcggtagaggtggcgctcacccgtgcgcgtggagatgagggctccggcgacgaacctcgacggaggaggggtggacgaggtggacctcggccgcgcgaagctaacggcggcgacggcgtgagacggcggcgagcctagcggcggctagcggcggccggagtagcaaaagcggcggcggcgggtggttgcacggcgcggaggcgttggggagttcgggagaggtcggcgcaatggggaaaaagcgagagggggtgccggcgatgcttaaataggggatgggggaaccggacttggccgggagcggcgggattcgacggccgacgtgggggaagtggggaggagagagaggcgggattcggttttcgaatcccggccatctcgggcgcgggcgcgagcgggagagagaggggaacgggcgcggggaatgcggcgcacgcgcgggcgtggtcgacgtggcccgggagggacggaggcgtgggcgcggcggcggtttcggcgcggcggcgcgccgggatcggcgggaggtgggggaaggacccgacaggtgggccccacctgtcggcgaccccgagagaggaggcgggcggcggctgccaggctgggccctcggcctgcggccggcccagcaaggagggggggaaagaaggaggggaatgggccggcggcccatccgaaaaggaaaaaggagggaaaaagggagggaaaagaaaaagaaaaaggaaaaggattttccctggaattaaaaattgcactttagtgatttttaattggttgaaattatttctagagctctgaaaattccactaaaaatcctgttaatgaatttcgacatgtagaactcaagaaaaattccacatgtcaaatccgattattgtttgcattgttttcttagggttttatcctgatttcctctgcattttcttggggtcatttgtaaattacaattttggcttgggaggaaaacttcggggtgtgacactgatatgaccaaatctctgaaggtcattcctggaaccgatgctcaagatgcctaagccatagaagaagtagaacaaattaggcagagagccatatcggctatccagcaatacttgtcccaataattttgtaatcagcgaaaaaaaattttttgcactgtattgtgagatatatatatgtccccctagttttataatgtcaagagcattgataaaaatatgaaacaactaagggcgatataacaatatcggccattgtacatcggcaaactgcaaccgaatacatcagaacaactaagggcgatataacaatatcggccattgtacatcagcaaaaaccgcaaccgattacaataaaacaactaagggcgatataacaatatcggccatctcaaggcgatgcaaacgcaccggctatcatgtatcggcaatactagccgatcacgcgtcaacccaaacactcgggtgatatttcttcaaatacttgccattaagcgctcgcccaaaaacttctccatgaagtccttgcaacatgtatgctcctttagacacaaccttatggatttggaacggtccttcccaattcggcgaccacttgccaaacttactatcacgagtaccaatcggcaaaatcaatttccatacaagttcttcttctgaaaaatcttattataaggtaccactttcttattataatgccgagcaacacgttccttatccctagtaacttgtacaagtgctcgcaatcgcgactgaaccaagtcctctcgttcatcggccataagattatagtactcgtcggctattaaatcattttgcaactctgttcttcttgagccgattcgaatttcccatggtaaaacggcttcatgtccataaacaagcttataaggaggaacttggattgatccatgacaagccatccgataagaccacaatgcttcggctaaacgggtatgccactgccgaggataatcagaaattttccttttaatcaacctgatcaaactcttgttagatgcctcggcttgcccattagcttgtgcataatacggtgaagaattcaataatttgatacccatactatcagcaaattgaacaaactcatcggacacaaagattgaaccttgatcagttgtaatagtctgaggaataccaaatcggtagattatatgttcttggacatactgtattgcatctccagaatcagccttcttcaaaggaatcgcctctacccatttggtgaaataatcacttgccactaatataaacttatgtcctttactcgatggtggattaatcatgccgatcatatcaattccccatcctctgaatggccatggtttaatgataggattcatagccgacgctggcgctctctgaattgcaccaaatttctgacaatcttgacaacccttgtaatatctgaaacaatcttctaacattgtcggccaaaaataccccttacgccgaagtaaccacttcatcttatgagccgattgatgagtaccacaaatcccctcatgaacttcgccgattgcaattttagcctgatcagcgctcaaacacttaagtaatactccatcaatcgttcgataataaagctcatcatccaatagagcatacttcaacgccttatatcttaacttcctagaagccgattgagatggattttgtaaatgctgatgcacatcatatctccaatcatcggccgttacggcagcaacttcaacctgaacatctttgatcatcgacttatacctcgatgcccctgagctaaatcattggcctcaacattctgctctcgagacacatgcttcaaagtcactagccgaaacgtcttcatcagttattgccacttctcattataaaccatcaacgtatcattcttgcactcatattctcctgccaactgactgataactaacaaagaatctcccataatttcaatagcatcggcttcaacctccttgagcaattgcaaccctttaagaactgcctcatactcagcttgattattcgtcgcataaggtttaatagtataagcaaactcaaagcatgccccccgaggcgaaattataaccaagccgataccacaaccatgagcacaaaccgacccatcaaaaaataaagcccatggcacaatctcaaccgagccgattgaatcatcacgatagtcaactatgaaatcggctatagcttgccctttgactgccttcggcgattcataccgaagatcgaattcacttaatgaaaatatccattttccaacccttcctttcaaaattggaactgacaacatgtacttaaccacatcggccttacatatgacagtgcattcattggacaacagataatgccttaaccttgtacatgaaaaatataggcacagacataacttttctacagaagaatatctagtctctgcatccaagagtctacgacttaaataaaacacaaccctttcttttccttcaagctcttggatcaagactgagccaattgacttctcaccggccaacagatataaccaaaaaggtactcctttctgagtagaaatcaaaactggaggagaactcaaatattccttaatactatccaaagctttttgctgctctgccccccaagtaaattgctgattggccttcaatcgtaataatgacgtaaaaggctctaatctaccagacaaattagaaataaaccttctaacga

SEQ ID NO: 75697 - DNA, 1618 bp, Oryza sativa
ggattatatatatttttttcaactggatataatataataaagatcaacgctttttaaaaaattttagaggaaacaatagctggctagaatattgtactgtgtcctactccggtgctttctactcggagtagaaagtaatctaggcccttgatcatatttaattataggattaagatctagttctactcctatcagaattagtggaagtagaaatgtggaggggtgtttttgtccaggaaaaataattcgcgaaggggtattattggtttccgatccatagatcgatcagcatgtcatcctcatcggagttggtcgtgcaagatcttaatcgatccatgtaatccatgaaacaacacagtgatcggaaacggcagaaacgaatgagccgagatgccgccggcaagcaaatgacattgcgtgcgtgcgtgacgcttccgccgaagcccaagcccggaattttttaccttaaccccccccgcagaacacctgctcaagatcgtggctcgctcggacgccaccacactcgtccgctcccagacggacgatgcgactgaggaagcggacaaggcggtgatggcgggaatacggatggcgacggagggggcggacaaggcggcgaggccgggggaggaatacgaggtgactgcgtgcaacggagttcggacctgatacgatgcgaacagaagaaaacatcccatgccaaaattacccctaaacgatattaggagattacttacctgtcctttaaaataaacagtcaagattaattctacttggagtagaatactgcaagtagattgcaccggagcattactcatgtttttttatgtttcagtttaggatgcaattttgcactcccagagatatatacatatatattttattatagttattactgaatttagtgcgttggaagagtttgtctgcctcccctctctcaacagaaaatgtctatttgtctgcgaggatgaactagtaatgtcgttgccacatatagtttggtcggctttaaatctgtttctgtagtggctgattaagacttaattaggagtcaataaacattatttcgaagttcatatatgttcatccctatctactcactagtcactacatataaagtttgcttcatggaccatcatgtttccacacaagtaataaatactttgccttcatcaacacacaactagccagtagtatttctttttccgaaataagatttttattttatagccaaaaataaggtcttaacactccttttttttggggggtccttgcaattctactagtccataactaattagatatttagcactttaatagcaaaagaaaaaatatccctttttttgctcattatatatatgtacattaatttgaaattcttaatattccatgagagttaccaggcaccgatacattatatatataattaattaaagcatgtcaacactccacttttgattggttattttttcaagatatatacaaacccaaggtttcagtatacaccaaatcccaactaccatcctaacagatgtcattttttttcaccaaatgtattcatggtcgctgttgacttggatgtatataaattacgcattctgttaattagggccatatg

SEQ ID NO: 75698 - DNA, 1515 bp, Oryza sativa
aaagacgttttgggttaactaatttgattttgaagatggaaatgaaacaaacggacatcataattccaaacgtgacgaagtttgttctagtattccctgggaaccaaaatcatgcataaccagtttgataataacattacttataaatcgatgaaagaggatcccaaaacaaggaaagaggaatcacaacaaagataagtaataagcttgatcggaaaattgaaacagctagaatacatgcaaaacttccaacattaattagtaattcagattagacagacgatcaaattaaatggccagctggcctttagtaattactggaaaatattatccttttgataaaatatggttgcggtcttttttgggagtagtataaatggaagaaattaaccctcagctctaattaaccagacaactgtattcctctatctccaagataaatacgaaaaataattaattagaaaaactgaagcgctcgctcataaatatatacaagattaatacaaagaaccgtatggggagcatggctaatttctttcaaaaggttagattaaagtatatgcatcacagaaattttgcttacaaactaacacacaagcatgattggaggcaaatcaagaaaactatttttttgcacaactctctccgattaaatgaacaaattaacaacaattaatacacccacaaaaaataacatatgccaaccatagcatccaagatttcgatccgattcaaaccaaacaggcatgtacatatgcccccaaaattttgaacacaaaattaaatataatccccatctaccaatttctagacaaaagaaatataaatcctcatcttctctccatgagaaagaaccaaagaacaacgaaccaaataaatctaggtagatgaactagacctatagcattaatttctttgcaactatatatctagcaccagaaatgaaacaaactaatcaacaccatcaaagaaaaattaaccatcaccaaattaagagataaaaaaaatcaaaatcaatcaacacacaactatagtttaaccaacaacaccaacctgatctgccctccagcttctcggcgatgggggtccagttctgagggccgtacttctccaccagctgccggagcttctcgtcttccccgggccgccagtggcctctcgggcacgccgacgacgacgacgacgccggcttcccggcgccgtccgacgtgttcgtcgtcgacgacgacgccatgatccttcacctagctagagatcgaatcgatcgagtagaaatcaagcaaaacttgactatagcttgctagctagctatcttgcatatctatctttgtttttcagatcccaaaatgattttctcttataagtgagaggagaggaggagagaggggatttttcttgggctaattattagctagcttaagtaagtagaattagaggggaaatgggagattgagtgagggagaaggggtatgggtagtgttaggatacccatacccatatatatatacaagagag

SEQ ID NO: 75699 - DNA, 2394 bp, Oryza sativa
  unsure (1)..(2394): unsure at all n locations
tagctctccacgattaaattgtgcgggacggattgcgacaacctatgttcgattaattgttggtactctcacacaacttgtaaagctctaaatacatgcttattgtccatgtcaaaaaaaaacatgcttattgcattgtatatatactgcaaatgcaaatcgatgatcatctcttgaattcgtcgcaaaagtttgttatggtcaacatctatgagcccatacattcccacaggaggtaaaccgttcgagctctgccattacagccacccaacagaagcagaaaccctagtaatggccaatgaggcagcgtacacagaggggtggttggcttggctgcatatacatatcctgatcgatcgaaaagcccaaatttgcagtcttttcagcatgggatgcaccgcagaaacaagggatgcattcaatcttccatgctgctctgttcattgtgtttgggagatttggagcaacacatgcatgtacaagggatgtgatcagagagcagttagttggcagtgtgatatatgtgtatatttatgcactggctgcattgaattgatgagcttgatgtacacatgtaactacatgtgtgngnctatatatatatatatatatatatatatatatatatcggggatatataccctttctcggggtttcataaaatctctctatattttttttaaaaaataagtatataataaacatatgtactgcacaaaagatataccatttaatttcatttttatgagcttaatatagggtcattttgaggttatttaattgcttgagcatgccctctttgtataatttgcatttaatttgtctgcagctgttctcaacattgtcatccaaggtggtaactgattgatctatatcatgggattccatacttgattcccaaacagatgtcctcataataattcttgtcactttgtttagttttagagaggcatgcacatgtttatatgcaaccaaaaacaggaagctgtttaggctaagtaatgagccacaaccaaaagtctgttccaaaaggacaagtagggcccaggaacaatggacaaaatctacaagacaaaagcaaatggaggaaatttgatgcaaccaatattcaaaaaatacaagaaatctaaatttgcagtatgtatacataatccgtgtttcttcattttcattctgtaaaaagtaattttgctagctcttgctaaatagaccttcgaaggaaatgttgacaacagttgaattttcaaaactatttaagccaccaaggaatatcataatttctctggttatcaaattagcttatctataagattgacaatgatatctaccatcacattcctggaagcaaccaatcagccaaatcagttgcattggtttagcataaatgggcatccaaattaacatagcatctgaattttcaagtcaaagcagtttcacctgtgagatactgatgttgaaaagagaccaagacctattaacaacgaattgtatatgatttctggtccccgattccgttcaagaaaacatgaaaacgcactcgcaacagccggtaatatatgagcaataatttagtacataataatcaaagttagttttgtcattctgacttggcatatgttaatggtgtagctttaccttgttgccttggaattggttttggttcctggaaagtttgttagtgatgtatcaaaagggtgtagatgcaaagaaaaaagtcggaaagctatctctctggatcaatgtagtatagaagaagtttttgcttggtaaaagattgtgagctttgacaaaataaccaccacacaattgaagagattaatgtagaccctacaattagttaaataaaagtcatattcacatatatgtatatccattcgaacaaccattgttttttcaggaaggtgtttgtaataataaggattgttttgtcctcagcagatgcatgttatggcatggttatccttgagaattaaccaaaagtatcctaactttgcaagattgaacattattaatatggtatgtacatatatatctacagtggtttgtatatgcaagcaacattttgcactttatatattagctaaccattaattatctaaaaaattagctggccatgctactaatttcagccataattgaatattatttgtccatattatgagcctacatacatatatatatatatatatatatatatatatatatatatatatataaaataagaaaatctgatgcgtagaaatgtttctttcagacatattaccaatgatcattacttatacatgtccacggagagacgatttcgttttctccctagatgcacaaagacgtaaacaacacacgagcatggttagataacatctttaattaatttgttgttaattaacaatattt

SEQ ID NO: 75700 - DNA, 10392 bp, Oryza sativa
cagctcgacttgaatctccgacagcgaagatggctggagttgataaaagattatgacatggggatacaatatcatctaggcaaagcaaatgtggtggcagacgctttgagcagaaagagctattgcaatgcagtatgtaccgaaggcatgtgtgacaaattgcagcaagatcttgagcacctaaatttgggcatcgtggaacacgggtttgtagctgctctagaggcacggcctacgctcgtggatcaagtcagagcagctcaaataaatgatcctgaaatagctgagctgaagaagaatatgagggttggaaaagcccgagattctcatgatattgagcatggcacaatctggttgggaaaaagattgtgtgtacctgaagacaaagaactgaaggatctgatactcatagaagctcatcaaactcagtattcaattcatcccggcagaactaaaatgtaccaggaccgcaaagagaaattctggtgggccagcatgagaagggaaatatcagagttcgtcgcgctctgtgatgtttgtcagcgagttaaggcagaacatcagtgacctgcaggattgcttcaaccccttcagatcctggaatggaaatgggaagaaatcggaatggatttcatcactagtttgcccaggacatcatcagggcatgattcaatttgggtagtcgtggatcgcctcacgaaggtcgctcatttcattccagtgcacactacctatactgggaaaaggttggcagagctctaccttttaagaatcatgtgtttgcatggggtacctaagaagatagtatttgatcgagggagtcaattcacttcaaagttctacaagaagaattggggactcgtttgaatttcagcacggcttatcgtccgcaaactgatggtctgaccgagcgagtcaatcaaatattggaagatatgttgtgagcctgtgcacttgattttggcggagcttgggataaaagtctaccgtatgcggaattctcttacaacaacagttatcaggccagtttgcaaatggcaccgtttgaagcattgtacggacggaagtgccgcactccgctcttctgggaccaaactggagaacaccaactgtttgggacagaagtgctaaccgaggcagaggagaaagtcagaaccgtcagggaaagattaagaatcgcccagtctcggcagaagagttatgctgataaccgccgaagagagctcactttttaggcaggggactatgtgtaccttcatgtcaccccgctccggggagtacaccgtttccaaaccaaaggaaagttggcaccacgctttgtgggaccatacaggatcttggaacgcagaggtgaagttgcttaccagcttgagcttccatctaatatggctggtattcacgatgtgtttcatatgtctcaactgaagaagtgtttgagggtacccgaggaacaagctagtccaggaagatctgacagatgtggagaagccgatacgtatcctcgaaaccagtgagagaaggaccagaaacaaggtgatcaggttttgcaaagttcagtggagccaccactcagaggaagaggccacctgggaaagagaagatgaactgaaggccgcccatccgcacctcttcgccagctcttccgaatctcggggtcgagattacgtttaaggggggtaggtttgtcacgccctgaagttcccctttttgctttaaaattcataaaataaattgtccgaagaaatgatttaatttaacctagaggtgaatccctaaattaataaatgcaaataataatcggaatcgacatgtggaatttttcttggattctacatgtcaaaatatgctaataggatttttagtggaattttcagagccttggaaataattttacctaattaaaataagcaaagtgcaatatttaaatcccaggaaaatctttttttcctattcccctcttttctttttcctcttttcctcatttgggtcgtcggcccactcctcccgcgccgccctcctccttgctgggccggcccacatgtccctccctcctctctccgggtcaccgataggtggggcccacctgtcggcctcgtctttctcctccagccggcagcaacagccgccgaaaccgccgcccacgccgccgcttcgtccgcatccgcaccccactccgtgcccacacgcccccccacgtcgccgcccacgttgcccgcccccttcgtcgccttcccgcccgcgcgcgcgtgcccgcatagaggcgggtttaattttgaatcccgtctctatcgctctctctctctctccccaaattccccacgtcgtcaccggccaaatagagcccattcccggccacaaccgccccacccgagcccctataaagcttccccgcaaccccctctctcgtttccctcactcgccggctgctcccgagctctccaccgctcccgcaccgtgcaccatccatcgctgccatctccactcctccggccaccgctcgccgccgagctaagccgccgccgccaaagctaccccggccgccgcatcctcatccaatcccgccgccggaacgctgctctctccgtgcgccggtgagtttcgccgcccttccaatctccgaccggccacgctagccgccgtgggcttcctcccaacccctaagtcctctccattttcctccgtaggagcaacctccgcccgcctacccctccgcttgtcaggtcatcgccgccgccttcatccttcatgccggccgccgtgcctgctggtgagaactccctctcctccctctttccctctctcccgtgtgcgccgccgtcctccgcgcgcgcggcgtcgccttcggccgccgccactgcttttcgcgccgcccaccgccgcttctcgcgctggtagccgtcgccggcaacgacccgccgccgccgcatcgccatcatagtcatccggcttgaagccgagccgagcaaagccggtgccacctcctcactcatgagccactgcccagtgggccctgtctaccagtacccactacctcacccttgtgcctctgacccgtgggtcccgcacgtcggcgccgcccccctccttgatgatgtcagccttgggatgagttattgcgctataaattgattaagggtttttcttttatagtaaaaacacagataatcttctaaaattcatatctcattcatccaagctccgattaagtccattcaagtctcagtaaattcataaaaatgcatagaatctagtaaaaatggttttgtttcctatttcagtagacgtatagcatgttttgcttgtttgctttgtttgtcgcgtagatttcggccgtttcgtcgatccgcggttccgcgaagatgttgctgtggtctcatcaacacgagagcaaggcaagtcatgcattataattgatcatgttgtacccaatttacaaatgtcccacatttctatcaaatgttgcattattttacaatatcatgtgggatgggtcctactactcagccatatattgtttaccttatgccattgataacttgagttttaaaatgactagatgttggtttaggaaatgcttagccatgcttagttcaactagcacacaaagaaggaatcacattaaagcatagactttgattaatggcatagctttggaatagagccaccgcaatggtgttagttaattaaaatacactacacggtgggccgtgggtgaatggttttgctagtcgtgcccacggcgattatggatcagttcgcgggatgccttggaagaacttatcgtacttaccacaagccagcgtgggcaatgtcctgtcacggcctcttttcggtatgccgtggtggcatgtcgacgcacggaaatgtgtcgtggggctgtgtcttgtgggtacagttgtacacctctgatcagagtaaaactattcgaatagccatgcccgcagttatgggcggtcgaccagattcaacgtgattagtctcacccctagttagcttttgaactggtgtagttcaggtggttggttgggcctgttgcaacgtggtgtagcattcgacagtgattggttaatattgattaattactgcaactgttttactgctttcaactactgcttttaaatgctagctttatgcaaaagaacctttttgcctcccttggatatatcctgcatcatacctcctcttccggtatgacttactaagtacagggggtagtactcagtcttgctctcttttcccccactccagagttgaagtccttctcaattggatatgtctcgaagaagttggttttgtcgctgccgtcaaggatgcctgtggaaaggaatcgcccgctacaggagtcaagtcttcaagcttagctcgcttttatcttttccgctggatttgtaatcttttatattttttgtaagacgtggatctgtaggtcaagaattgtcgtgtgtgtaccctggctggtccaggataggggtttaatgcacattcagcttagaaattctggctcgtgaatttctgggcgtgacatctacctcctcaaatcgagctgtagatgtgccaccaggaaaaagaaatggaagtaagtgcgatctccctatcatcaacttggacatcttggacgctggtgaattggcaaagctgtgccatgaagacgtcatgcgtgcagcattggagtagtagggcttcttacaagtaaccaaccacggcattgttggcggctcttaaatgccgattctataccgccaacatctgcataaagatcagacaataaaacatccaacatagtgataggtgcttaatctcacgtatttcacaagtgttgatatatatttatatgcagatgataaactctgatgttgggaggaaatctagactaaagtgaggagaattctgtatccatacaaggatgggctgtgaacttcatcgaaacatcagtaaattagcccaaaataccaagaaatggataaaggagaaccaggggaggacatgggccaaaggccaggccagatggatgtcacgccctgaagttttcccccctttgcttgctttaaaaattggctaaataaatcgtccgaagaaattatcttaattaacctagagctaattccctaattaataaatgcaaataataatcggaatcggcatgtggaatttttttttggattctacatgtcacaatatattaacaggatttttagtggaattttcagagccttggaaataattttaaccaattaaaatggagcaagtgcaattttaaattccagggaaattcctttttctttttctttttctttttcccctctttttcctcctttttgcgaaatgggccgtcggcccatttcccttttcctcccccccctcctccttgctgggccggccgcaggccgaggcccagcccagtagccggccgcccgcctccctcctctcggggtcgccgacaggtggggcccacctgtcgggcccgtctcccacctcccgccgaccccggcgcgccgccgcgcccgcaacggctgccgcgcccacgcctccgcccctcccgggccacgtcggccacgtccgcgcgtgcgccgcgttccccgcgcccgctcccctctctctcccgctcgcgcccgcgcccgagatggccgggattcgaatttcgaatcccgcctctctctccgccccactcccccacgtcggccggcgaatcccgccgctcccggccacgtccgaccccctctccccctatttaagcatcgccagcgccccctctctctttttccccatttcgccgacccctctcgagctccccatcgtccccgcgccgtgcaaccacccaccgccgcttctttccgctctccggccgccgctagccgccgctagactcgccgccgtcttgcgccgtcgccgccgttagcttcgcgcggccgaggtccacctcgtccgcccctcctccgtcgaggttcgtcgccggaaccccctccccacgtgcacgggtgagcgccatccctaccgccgccttcggccatggaatccgaccgccggggtctacctccctctctctaatccctctctcctccttccttagggcacgccggagctcgtccgccggtcgccgtcgcctcccgtggcttgccgccgccgctcgccatcgccttcctccgcgccggccaccctcggtgaggcatctcctctcctctccttccccgtttccccgtgcgtcgccgtcgcccgcgctcgccgtcgttttgggtcgttgccgccgtccgctgccgccgctttcgcgtcgcctccgctgccggatgctgtcgccggcgacgcgacgcgcccgcaccgccgccgctagctcgggtcggccgatcggctttgacgccgatccgagcccggggttgccgccgccgtcgtccgtccgatcggcctgagggcgatccgggccgtcggttcggccgccacgtggcgccgccgccccatcctttttcccgtgccgctgaccggtgggcccgcgagccgccgccccctttctctctctcccgtgccgctgaccggtgggtcccacatgtcggcgccgcgccgccccgcgctgacgtcagccctggaatttattgcgtaataatttatttaaggatttcttttatagtaataaacacagtgaatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgtttcgtcgatccacggtttctcgaagacgttgctgaggtctcgtcagtgcgagagcaaggcaagtcatgcaatacgtttgatcatattgtacccaatatacaaatatcccgcatttctattaaatgttgcattcttttacaatatcatgtggaatgggtcctattactcagccatttattgtaccatatgccattgataacctgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacattgaatggtgggttgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggtgcaagaggggaccgcccactgccttttgaggggtgggggtgaaaccttagcgtggtgtggatggttaggggagggttatgtggagggtcttgtcacgatccccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttcctgctttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagccgcccgctgctgaagtcaagcttcccggtttagctcgcttttatcttttccgctgcatttgtaatcttttctatttctgtaagacgtggatctgtatgtcaacaattgtcgtttgtgtaccctggctggtcctggacagggatttaatgcacattcagcttagaaattctggttcgagaatttctgggcgtgacaatggacctagcccaagttcggccaaaccaccaggttcggcggaaccactatctccaccattggatgtggggtttggcgtggacgttccagatgcatccctgatggcggttggagggcacttcggacatttcctcttcgccaaccgtcatacctacctctatataaaggcttcactccctcacttcacacacacacttccaaggttgagctgaattataagaggctctattgtactatattgtataatagaataggaagagagtagagtagaaggagtcggaagaattccggagttgtcggtaatcttctcctatttcttttaatctatttattactctgaattcaatataatattcttcttgagtaattagatttatcttgcgagaattacctcttggttagttcctaattagcatacgggattattgttcactataatcaactaaaatatagtgattgctttggtgagttataaacaccaaagtagatagtaattgctttgacgtggtgtttaggtaattgttatccagtaattgttgcgtatcccacagtacgttgaggtgggtgtagaggtggtgacagccctcgagatcaatgaagtcctccctgtccgggtacgtagtagagcgacatctgggaacagcgggttgccagtgcctgaagtattgcgttaggattaaaattaagcattccctagacactgtttctcactagtgaatcctctctatcctggactatcatttgcttggtgtccttggatgaaccagaggaacctctcatcacacacgttcccttggattcgatacccttggaatactccgtaggggaagtgctacatcggtatatccatgcgcttgcggattttatctgtaactgtatcaaatactaacaggcatggtgcacgcgctgctgcatgagcatcatgatgcttgggtgaccagccatttgcctgaaccgtgcggcgaagacataatgcacacaacatcaaagaagctgctcaacttctcgctagagagtaactgatgggcacgacgatgaccacatgtcaagagcagtcctcatgatcaacctagtggacaccattctcccccccaaattaaagaacatgccgccaactctgatccctagaatagtgactttatcatcatgctagacctcgagctatggcgaaaggatgcaacgtcaccttagttatctgcttcctcatgccccttcacatgtagatctggtagatgcataggggcatatctaggctaactctggcaacggtgaagaacatcctcaagtcgttgtccagggagagggatggtgggtgagatgaggtaaggcaagcgcatctactggagtgccggggtgggcccagcacctcccattgggccacagaaccctccccccaaccacgtggtgtgtaagatcaagtgcataattaagcatcaacttgtccattagcatcatatcaaaagaccagcgatggctcgccttctttgtgaagcttctttgcttgggttactcatgcagccacgggtaggcgatgcactgggctcgtctctctgacttttcgtcctcggtctaattgcctgaatggccatcgtagcgtcacctagtttcaccggtgagcatgtgtcgggacccggttttataacacagggatccacatgtcttcacaataccaactacctagatcggtaggttggcatacacatatataaacatatctgtgttgatggaaaacacgtggcctgggggatctgcttaactccagtgcaggtccaaaactcgccttcggatgtatgagcgtgctagttgatttgatcctgcaatcaacaagaaacaaagacaaagaaaccgtgattaaatccataaatgatagtcgatcggctagatgccgatgacatatcatttatctttgagccgatgtcatatgtgaatcgatcggcaattgttaaggaaacaagtcggaactatatctacccgatcggctgtagatatcaatgatatataatccttataccgacatatacttaaaccaagtgattgggatagatcggtcaccttgccgaagcagtataaatcacttaggttgaaatatatgttaataataagattatacatattcatagcatagccgatcaaatagatctagcatgtatcggctaatactccgatactactttatattaagatattaaagcaaatagaatat

SEQ ID NO: 75701 - DNA, 1088 bp, Oryza sativa
aaaacacaggaaaaacacagtaatagttgtttgattggagcacaggaaaaacacaggaatcggatgagagagatagactcaaagggaattttccaagaggttagagctcttgctatatttcctccaaaatccacatacaatgtgccattctataggaatttcataggatttggaaaacttcaatcctttgaatcaaagggctaagtaggaaaatttcgtgtaggatttgaatcctatgaaattcctagataaatcctttgattcaaaggggcccttacacttacattcttatcaaaatcctacgtttttcctattcctacgttttcttaatcctgcgattcaaaggggcccttagataggattcaatcatttgcttcaaagggtttcataggaaattttcctataggattgaaatcctctaaaattcctatgtttttcctccaaatcaaaggggccctacattctatcaaaatcttaagtttttcctattcctacgttttctcaatcccgcgattcaaaggggcccttagtacattacctcatatgcccgatacaacattagtggaaaatttcttgaattatatacccataactaaaggagaaatttaggattacaccatcatcaaaagtggcttcgtggccaaatgccactacttaaaaagaacaataaaatatcactctcaaccagacgcatcctggacaaaattacccttggggctctacttccttccttcatcaccgttgttcttgccgatggctattacgcgccatatctgtggcttcttggctgtcaccgacatgtacgtcatctgctgctgaaatatcttgagattgacgaagtcaacacggacgcctcactgtcaaggtttgtcgataggtaccaccgaaagaacaatttaattgtaaatacgagcacccgtgtaaatctacaacttgaacctgggtgagctgatttcataattataagaaaaggggtaactagctaactactactagtgagtgcgctcacttcgattcttttttctatttggtttcacttgttgaaggaaaaaacattttagaagcataattatgtgacaactctacgc

SEQ ID NO: 75702 - DNA, 8631 bp, Oryza sativa
  unsure (1)..(8631): unsure at all n locations
attaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacgaagtctatgtaataaggtgatccccatttgtgtgctagttgaactaagcatggctaagcatttcctaaacccacatctagtcattttgatacccaggttatcaatggcatatggtaaacaataaatggctgagtaataggacccattccacatgatattgtaaaagaatgcaacatttaatagaaatgcgggatatttgtaaattgggtacaatatgatcaaacgtattgcatgacttgccttgctctcgcactgatgagacctcagcaacgtcttcgagaaaccgcggatcgacgaaacggccgaaacctacgcgacaaacaaagcacacaagcaaaacatgctataagtctacagaaacaggaaacaaaaccatttttaatggattctttgcatttttcttgatttactgagacttgaatggacttaaacggagctcggatgaattacttatgaattttagaagataaactgtgtttttactaataaagaaaagtccttaattaattattgcgcaatattgccccagggctgacgtcagcaaggggagggggcggctgtgctgacaggcgggccccactggcagcggcacaaggggagagggagggggcggctggcatgtgggccccactgggcagcggcacagggcgggagagggaggcgccagccgggctcggctcggcctcaaagccgaccggcggccaaggcgaggcggcggcgaggcacggccaccgacggcggtgaccggcggtgcgggaagcggcggcgacggccgaaaggcggcggcagcggctgaaggcgacggcacacgcgcgaaggccggcggcgcacacgggaaagggggaaaaaggaagggggagaggggattctcaccgatgagcacgacggccggcgcgaaggaagaaagcggcggcgacgaccggcgatgccgaggtgcggatgggcggcggcggcacgctaggagaaaacaaagaggggttaggggtagggagagcgaccacggcggctagagcagccggccggagttgggtggaaatggagagctcaccggcgtgcgagggaaacggcgcttcggcgacgattggcggcaaccgaatggtggccgaggtgcgggcgggctcggtgagcgcgacggcggcgactgcgcggcacggcggtggctatagaggcggcggcgcgtggccggagacggcggtaggcggcggcgcaaggggcgacggcgcggcgacgataggaagcacgggagggcgcggcgagtgcgaaaaacgagagaggaagacgcggggagcgatttataggtgcgggagggggcggacgtggccggggaggtggccgatttggccggcgatgtggggaggagagagagaaagaggggtgggattcgaaatcgaatcccgccctctcgagcgcgcgcgcgggccgggaggttcgggggaagaggctgcgacgtgggggggggacgcgggagcggcgcggcgtgggcgcggcaagaacggaggaggcggcggcgtggcggattcgcggcggttgccgtcggaggcgggtggctggaggaaggggacgacctgacaggtgggccccacctgtcagcgtcccggagagagggggaaggagaacgggccggcccaaaggaaaagaggccgagcgcgggagggagtgggccgacggcccaatagagaaaaagaaggaaaagaaaaggaaaaagaagaaaggatttttcctgggattaaaaattgcactttggtgatttttaattggtaaaaattatttccaaggctctgaaaattccactaaaaatcctgttaacatattgtgacatgtagaatccaaaaaaaaattccacatgccgattccgattattatttgcatttattaattagggaattagctctaggttaattaagataatttcttcggacggtttatttagccaatttttaaagcaagcaaaaagggggaaaacttcagggcgtgacattcctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaatccgatatggtcccacaaagcgtggtgccaactttcctttggtttgaaagcgatgtactcccctgagcggagtgacacggagatacacataatcccctacttggaaaacgagctcccttcggcggttgtctgcatagcttttctcccgagactgcgcgattctcaatctttccctaacagctctgactttctcttctgcctcatttaaaacttctgtaccaaacaactggcgttcccctgtctgatcccagaagagcggagtacgacacctccgtccatacagtgcttcaaatggtgccatctgcagactagcttggtaactgttgttgtacgagaactcagcatacggcaagcttttgtcccatgccccaccaaagtcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtactccatgtaaacacataattcttgccagatagagttctgctaatttcttccctgagtaggtagtgtgcaccgaatgaaagtgagccactttggtgagtcggtcacggactacccaaatagaatcatgccccgatgacgtcctgggcaaaccggtgacgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccagaacttctctttgaggtcttggtacatcttagtactaccgggatgaatggaatactgagtttgatgagcctcggttagtatcaggtcttttaattccttgttttcgggtacacacaatctttctcccatccagattgttccttgttcgtcctcaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcagatgttccagatcgcgttgaacctcgcaacatagttgctctacccatgcaacattgcagtagctcttcctgctcaaggcatctgcaaccacattagccttgccgggatgataatgtattcccatatcataatccttgatcagctccaaccatcttcgctgtctgagattcaaatcagcttgagtgaagatgtactttagacttttgtgatctgtatatacctcacaacggttactgatgagatagtgccgccaaatctttaaagcatgaacaactgcggctaattccagatcatgcgtcgggtagttgccttcatgaggacgcatctgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccacttggtaactgactgcacattggctggatccacagctactccttgagcattcacgatgtgaccgagaaactgaacttccttaagccagaagtcgcacttgctgaactcggcatatagctggggctcttttaacttttcaagtaccaaccgaagatgctgcttatgttcttcctcggacttggagtagataaagcatgttcatcgataaaaacgcacgacaagacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgataacctgatcgcaggtctatcttagagaacaccgtagctcctttcaactgatcaaacagatcatcaatccttggcaaaggatacttgttcttgatggtgacctcattgagtgcgcggtagtcaacgcacatcctcttggttttgtctttcttttccacaaagataaccggagcaccccaagcgacgtgctcgggcggggggcccgatgtatcccttctgtaactgttcatcgacttgcttcttgacctccgccaactcgttggctcccattctgtaaggcctcttgtggatcggtgcagttccaggtaccaagtcaatccggaactcgatatccctttttggtggcattgttgtcagatcatccggaaaaacctctagatactcttgactatgggaatatcctccagcttcttagtggttttctacactgctacctcttgttcttcaccagcagcctggtttaaactaatccctggcttctgcggcactggggactggaagattaccacctctccttttgcattggtcaacttgatggtgcggctggcgcaatcaatcactcctctgtgccttggtcaaaaaccccccaaaaaaatttttcccccccccctccagatgacgtctaggtccttggattcgagaagaatgaggttggctggaaaaatcgacccttgaatttcaactgtcacagatgggcagtagtgagttgtggtcatgccacctccaggagtatgcactcgcataggtatcttaagcttcactaaagataacccatgtgcaccagcaaaacgcttggaaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctaccaacctcttgggctgttctggcagagctggctgatctgactgagctggaatcattaatggacttggagtcgggttgaggctgctgtgactgccactgttgttgtgactatcactatggtgggtcttattgaagctacccgggtggtagggacggtgctgtcggataatcatggtggaaggtccaccgtgacgtcccatcgtgtaacgaggcttttgacacttcccctggggagtcctgaactgggctgccttcctcttacgggtcattttgttacactgctcctcttgacgaatagccttgtccacaagcttctcaaagtcctcatagtctctagagatcaactggttggtcaattcgtcatcaagaccagacataaacttctcctgcttctcggcatcggtacgcacgtcctcaggggcgtagcgcgcgaggcggttgaactcatgcaaatactctataactgttctggttccttgttgcagggaacggaactctctcttcttttgtcccacaattccctcgggaacctgtgctttattgaaactatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaggtgggcggcttgacacgaagaaattctaacagtttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcaattgttgggttctcgggcggtggggacggactgttgtcagatgcaccgttggcacgtgctccattgatcggctcttcgctgccactggcgttgttcgagtcgcgtgaaccattccttgtctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcggccgccgactagcccacaagcaacaaacctaaacacgaaaactagcaagcaaccagactaagaagacgataaagctaagggcggcgactctgaagctcgaggcggcgcttgcaaacgagggataagactgacatctaaagtagacaagggataggaaccaatccatgctcaaacccaaattaaacaaagcaaaacaaaactcacataaataaccgagcatgatgatttttatgcatagaacatttttcatgaactcaaataaagacactaatgcaactaaacaataaattaatgcatagactagttgcatggaaaacgatgcgcataacattgcccccatcgaatatagacacgacctaatgcataacccccaataaattccgactgactgtcgaataaactccactaaaaattntttaaaggcctagactgagctaatatttttttttttaaaaaaaaatccgatccgaaagaacgaccaagatttttcccgcaaaccaaagaggcaaaactccaaattttcccgaaacaattccaggtgcaaaaaggcatatgcagatgaaaaaggggttcagagggctcttaggtttccagttggcttgtcctacggtcaaggtcggttctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcggctccactccacaggcaatccttgacggcagcgacgaaaccaacttgacaaaacagctccaactaggaagatcttcagctctggtgtgggggaaaagagagcaagactgagtactacccactgtactcagcaagtcataccggaagaggaggtatgatgcaggatgtaaccaaaggaggctagaggttcttttgcataaagctagcatttaaaaacggtagttgaaggcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcg

SEQ ID NO: 75703 - DNA, 1383 bp, Oryza sativa
atatagacacatgcattttgggacggagggagtactaactactaaataatgtctcctacgtacccatcgatttcatgagagcttcaccagcagatgtcttgtcctgctgtccacttcaatcgtttgatcctcgttaagcagaaaacagcaagtatgtgtggtgctctgatgtggtacaaagaaatttggggtatgctatcgttaattaaatgtgcgtttcactcaaataccacttcacaaaatggatttgataaaatgtcattcttgatcagaacatctacgatggattaatgtcatcccgggcaaaattgccgttgggctcctcttcttcctccctcccgtgccaatgcgtttaccgacgaccaccacacgtcatgtctgagcatcaccaagcctaagtcatagaggttccatcttgtagaggccatccaagatttggcatccgcaagaccgggtttgaccagagagcgccggtgcaagcgggactataagtgggttcacgggcctggccgcttgcatccctactaagagaacgaagaagagattggcagagtgatgatggagatcagcttgacgcgacaggatccattgctgacctcgtgctctagccgctgcaagaagagtggcactagtaggaggcagaagactccaagggtaattttgtccgagatggcatcatcccaaatttatcatctgtcatttttgggtatataactggagaaattgtatggtctgttccttaagagtatcaaaatttgaactaattttgatacctatcggctatctgagataatgtagtacctctatctgatacccaccgtaaaatcactcatattactcaatccatgtaagtttgattcctgatgctcatagaattttatgaatatgtatcttattcttagcgttcgtgtgttcgtcatgttaaagaaggcatgcttagcacggctgcacgtaccgatgttctcgaatgtgcgtgtcttttacatccgaaaggaaaaaaagagtatcataaagtcgattgtacattcgtagaggactaacaggcaagtacttgacttgagaaaaagaaacaactttcggcggttggcgatctggtttttcaggttagcaaaaacaagtgattcttccaaacatgccatctgtgaccactacaaaccttctttgaaggcgatgccatgatgtcccttccagtggcggacccagaaaaattgtactgggtatgcccatttagcaatcactccgcctcatatccttttaaaagaaagctcccaattacaatgaaagaatttggcggattttagtcggaattttacacatttctattcagatgtggtccataattcatgaaaaatctataggatttagcctaatcaatcccatgtc

SEQ ID NO: 75704 - DNA, 1077 bp, Oryza sativa
aagacgggatctgtatgtcaacaattgtcgtttgtgtaccctggctggtcctggacagggatttaatgcacattcagcttagaaattttggttcgagaatttctgggcgtgacaagttggtatcagagccgaccttgaccgtaggacaagccaactggaaacctaagagcctctgaacccctttttcatctgcatatgcctttttgcacctggaattgtttcgggaaaatttggagttttgcctctttggtttgcgggaaaaatcttggtcgttctttcggatcggattttttttttttaaaaaaaaaaaatattagctcagtctagggctttagaaaaattttagttggagtttattcgacagtcagtcgggaatttattgggggttatgcattaggtcgtgtctatattcgatgggggcaatgttatgcgcatcgttttccatgcaactagtctatgcattaatttattgtttagttgcattagtgtctttatttgagttcatgaaaaatgttctatgcataaaaatcatcatgctcggttatttatttgagttttcttttgctttgtttaatttgggtttgagcatgaattggttcctatcccttgtctactttagatgtcagtcctatccctcgtttgcaaagcgccgcctcgagcttcagagtcgccgcccttagctttatcgtcttcttagtctggttgcttgctagttttcgtgtttaggtttgttgcttgtgggctagtcggcggccgatatcatgtgtcagtggtatgactgcctcaattaggagttgcgtgcctctttttcagtgttttaatcaagattaagataattgcacttaaattcataagcaagattagtttctgagcccctgtttttcttccttttctcatatttctacctatccccttcagatggagataaggaatggttcacgcgactcgaacaacgccagtggcagcgaagagccgatcaatggagcacgtgccaacggtgcatcttacaacagtccgtccccaccgcccgagaacccaacaattgctcaggtgttggacaatcagactcagatgatg

SEQ ID NO: 75705 - DNA, 2361 bp, Oryza sativa
ttttttgcattggggccccttgcagccccaccagaggccggcaggggttttcctgcaaaaaaaccctccctcggtcaccgcctgttcctcccccgtttgccacgtcagcttgccgccccagaggtgagcggcagggtctacttttgtaatttttttggccgatagattatttctgtaaatattttttttaaaaaaatctaaaacccaaaaaaagtccgcagcgacatctatggcgagtgaggcggcccaagaggccagagcaagactgcttgtgggccacgtaggctgagatctagctggtctttctgctgtaatcgctcaggtccgttcgatgaaaaacgaacggtgcaacggtgttggacatccctctgactttagattaggatcctattcccgagaccgagcgcttgctccgggaacgcggcgatgatgtcccctccgacggagctccttgccgctactaccaccactcgctacaccactataaaaaagcaaaaagcgagatttagaaagagagatgccccttcaaatatatatatattttaaaaattattagcagagcaagtttaataatatagcccactactagctacaaatcatatatagctaatgtaactaaaagttcattaaacttcctacaaacgctctcagattgccacgtggtaatccttaaaacgctctcaagctgccacgtggcgttaataaaatccatcccttaatttttaattaaatatgtgggtccaatatttcttagccgtccaacttaattgagattaaaagaaccgccgccggaaccgctggctcagggccgcgcagagagaagctctagctcccctagggcatcgccatggtcatgatcctgcttctgctcctgctcggacgtccttgcctccgttcaactccaccattcaggatatgtggaagcgctgatgattaacttttggctattggattttgctattcacacgcctatgcacacgtataagtggtcgattcatgaatacaccgatggatttgcttgccggttagtaataaatacattccatctctaacctctgcttccctcctattttctatcttctttttatgtacagcggtatcagataaaaagttgtgataataaattttaaatagccataacttcaaaattatactctctctcagtcgtagaatatagcatcttttagctaagtatctagatatgtatatgtcctaaattcatagctaagagttggtatattttgagacggaggtagtacgtctcattttttttattcatcattgcatttacagctaaattgatagtttatgacccatattggcctgtattttaacttaaaattttcatattattattagtaaccacgtagaatactcctaagaattgctacataattcaaaattagtagactaagccatcggataaacattagtaaccttgaaaaataatttacatggtttttagttacatagattcttatccgcggagcatttctaagccaccatgtgataatcaaataaaatatgagagattcctacaaattttattaaaataaaataaaacatctagccatcaatttttatttaatttgataaacccattatttgcaaccaagcttaaagaaaaaaaaacccacatcccaaacggggggcgctgatacgcgataagccgcgcgcccccgcgcatgcgcggtcagtcggctgccctctagtctcttatgtatctactatacttatgtatatactacatatacacacgtatatacatatgtatataggtgtgtgtatatatatttacaaatatatttttaatacacatatacaaagtttatataggacgtatataaactttgtatacgatgtatacgaactttgtatacgattatacaaactttatatacatacatattaaaaaaaattaaaaaacaagaaattacatcacatatacaaagtttgcatatgggtttataaactttatatacgcgtatacaaagtctacatatgcgtatataaactttgtatacgtacgaatacaaactagcttggtatacatacgaatacaaattttgtattcgtgcatctttaaaaaaaccgaaaaaacagaagagaaactaaaaaaaaaagaaaaaccaaactgaacagaaacgaaaaaaacagaagaaaaggctaaccgaacagaaacgaaaaacacggaaaaaaacaaaaaaaaaaggaaaactcgcactccgcgcggcgcatccgccaccccctctgcgcgcgcgacacgtgtccagtcacgccgggaggggcgcgcgtgactgatcgcgtaatagccttctcgcgtcccaaaccccaccctggcctacacatggacacggatgt

SEQ ID NO: 75706 - DNA, 2827 bp, Oryza sativa
ctcatggattggatgctttttttgcttttggacgctgcggcggcagctgctactatcatactatggtagctagagtgcgtgcttttggagggagaatctgggcaaagagtgagaggaggaggaagatggatggcggctttcttggcctggaagctcacgatcgctttggtgctcgatcgatggcgcagaatctgatctgcttgcttgctttttttctttcgagtatgtgtgcaggtgatgccggtgtgatctgaattgtcgccgactcgtcgtcttgctgctgctgccgctgcttcttcttcccgccttttttcacctgcgttcccaacagaggcggttaaataacttccaccaaccgcgcgcggcgccggaaaggaaaaaaagaagagattttacacgtgtcatctctcatctgtcctgtgttgtatccttctcggaggattttgatagtattttccttagaagttctaacttttctgttaaatcaaatgtttgaacgtatacataaaacataaaatatgaaaaaaaaaaccaattatacagtttacatgtaaagtgcgtgacgaatcttttgagactaattacatcatgatttgataatgtggtaataacggattaattagtcttaatatatttgtctcgcagtttacaggtagaatttataatttattttgctattagtttacatttaatacttgaaatatgtgttcgtatactttaattttttttaaatggaactaacacggcccttgtgctttgctgcacgctgcacggggaatgcccgaccttttcaggttctcgcctctttggggtaaacgtatctgtttcttccaagagagttaagagtatatatatatatgagtatatatatatatatactactatgccccgttccctaattttttttccaaaaacatcacatcgaatctttggacacatgtataaagcattaaatatagataaatgaaaaaactaattgcacagttagggaaaaataacgagacgaatcttttgagcctaattagtctatgattagccataagtgctacagtaacctagtgctaatgccagattaattaggctcaaaagattcatctcgtggtttctatgcgagttatgaaattatttttttcattcgtgtccgaaaagtccttccgacatccgatcaaacatccgatgtgatatctaaaaattttctttccgcgaactaaacagaccctgtgtacacagtacacgttgcaggggtgcagagttctctgcttttcttgtagattcagtgagatctatgcgtcgtctttgggcaggattaccgattacacatttacacccaatcgtcaaatggccacgtgcaccaaactagaagaagtagaagaagaactctgtttcttttgctcaaaattgcgcaacatcctcaagatgttgttcgacgagacgacggcgagcttaaatcacgagatagctgagtatctccagttctccacgtcgcagagcaaaattagacccatccccaacaaaacacgtgcgtatcatccaggtatacacggtgtatacttagcgtggcactcaggctatctatgtggaatgtggtgccctgttcggtactccacgtggcttgcttatactggtgccacgtaagcactgaatgagaaaggcgttattttttttcctgattcctacttatgcattttctttctttcaaaataaaatcactttgcttatttcatttcccgcatataattccctaatattttagccttttttaagtcgttggttaaattttactcttatcccgattgttcacatttgttccgtcttaatgaatatcttcctacattcgccccgagatctagacaagaaattattgagcacatgagccactggcccaccgcccaagatctttctacgggtagtctaaccaccacctcacatgtgttcctctaccctctattctccagtggtttcgcccttaaccattctatcatagtcatagttatttttttcttctcaaatatttccatgtgggcacaccgtgtgcttctgctcctcggttgcttgtcgtctcctgatacatttatactttgtttctttttcctctttccctctgtcacttttgtctcgaatgcctcatgatcatttagaccttacaacccttattgtcactaacgtgcatagaggttttaatagccttaccattattgtcttgccacctttgtcactcatgcctaggctacctttatcccaacctccttaaggatactaatgatgtcaactatgttgactaatttctctttttattacttaaaagtgtagtcattcatcttccccttccctccctcacttcgtgtgcagtgcatactgcatactctcgcataaaaaatagaaaattccccagataaatagttgttagttaaaaaaattcccattctttaggctagatccattcccagtgatatagccaaaagtatcagaatttaggtattgctaaaactatagaagacaaaagatgaagcatagtcaaccctacatacaacgaatcaaaatgttaagggttcgacccattttctcgaagaaaccttggaatgaaccgcaatgtcgattgcttagctcattttctctagaaaatcttttttttttgaaaaagaaaagttgcctatccatttctactcattgaaacgggggaaaatatgtagtgcaaaccatatatacagtggaaactaccgttgaatcgaaaaatagacgtccgagattcgtccacgtcaccatgagttaaaatttaactcgcagattcactcatgagttaaaattttactaggaggggctgcaggaa

SEQ ID NO: 75707 - DNA, 578 bp, Oryza sativa
tgtcacaaatctaacacaaactaaacggatactcaactctcatcaaatctattgagctccaaatgtggcacatttcatcatagctgaccgaactattacatcttactccaggttttatgtctcacatgcaagtgtggcgcagtagttttcaacaaacaaccatcctaccccttactagctccttgggttttgggtcttcccatggctccatgtccgcgatctttgtcgccatggagggcaccgctattgaagtagtttttcacccttgttccagccaatatttttttcctcagctccatccactagtggctttgaaattgttaggcaaactttttggcaagttaccaaaaaaaaatatatggctagctagctagctagttcgataggtttcctcatgttgccgccactgctatacgtcgaatgatttggctgtgcagtcacaacgatattattttttcaaccaaaatgattacatttatatgcagaacatataagcttccttgctagtcatgtctatataagcacatatatattatatattttttagcggaaatttagttatcttttagtatctttca

SEQ ID NO: 75708 - DNA, 1507 bp, Oryza sativa
tcggacgtccatttctcgatccaacggtagtttccaagttttcactacatatgtggtttgcactacatatttttccttgaaacggcttacataaagttcttaaaacccagaaaatcacatgatgtacagtgatgatacacaatggttctcaactttttctttttctgttccaaactaggctagcccacgacggtcaacgtaatgcacaatacccggagatgctcgatcgtctaggaagggaggcatacgtatcctggtgtcgatcttgagattgctacgaccgctggtggtgaaaggcagaatttattctatctgcgtcacaaaagtcacaggccagctatgccgacggcgtcctcctcctcatgctcctgtagagtcatagaatgattagattggatagattgtgggcgagtaaggcctgtttaagtttccaaaaacttttttcaaaaacatcacattaaatctttgacacatatataaagcattaaatatagataaaaaaaattaattgcatagtttgcatgtaaatcgcgaaacgaatcttttgagcctaattaggccatgattagccattagtactacagtaacatatgtgctaatgctggattaattaggctcaaaagattcatctcgcggtttccaggtgagttatgaaattagttttttcattcgtgtccgaaaaccccttccaacatccggtcaaacgtccgatgtgatacccaaaaattttcatttcaccaactaaacaggccctaaaacagtactctagaacggagatgatgatatctactactccctccgtcccataatataagagattttaacattttgcttttattgtttgatcactcgtcttattaaaaaaatttgtgtaaatataaaaaaataaaaaattgtgcttaaagtactttagataataaagaaagtcacaaataaaattaataataattccaaatattttttggaataagatgaatggtcaaatagtgtgtcggagaatgaactcctccaccagggaaccgtgaggcccccctttgtgagttcggccggggcagcgggtgagattcgaggatttggtgagcgaaactgtgtggtcttgagggggttagccccctccaagacgatcagatcaaagaggtttatacaagttcgggccgctatgaagcgtaataccctactcctgtacatgattgattgaatgtagaacacaagtgcttgaggttgtgagacccaagcgccagttcgccccctcgtcccccctccaccactaggcctggacctccttttatacctcaaggggttaccacatgggcccaacaacctaacctagctctggtggagaagtattataatctttgcattaaatgcatgtcttgtctcttgacttgggaagccaagcacgcgtcgtcttgatgatggggcctgtcaaatcttgccgcctgacacggggggtgcccctgtcagtcaccatttaatggataaagacttctgggctcctattaaccgg

SEQ ID NO: 75709 - DNA, 6444 bp, Oryza sativa
ctacctcggacccgacccctctcggggaagggccacgtagcattggagggcagcctcctccatccagtctctgggaaggagtggccgccgtcctacctcgggcctgactcccctcggggaagggccacatggcatcgggggacagcctcctccgactagtctttggggaaggagtggccgccaccccacctcgggcctgactcccctcgggggagggccacgtggcatcggggggcagcctcctccctctaaacctgatacccccggatccatatcaccgacatagtgcaagaaaaaaatcaaaatccttatattttatatcatgagacggagggagtagtagcttgcaacgaactaaagcagtgacgtggccacgctcctgtaccgctgactatgctcaaccttggcaacgccgtcgacaaacagctgggtttatgtgacgacgcagacgtcacgccaagataattgtgcgatattgagccaccgtgccgccactacttgaaaaaagttatttgcaggcaagccaaatccatctttacgtacgggtattctgtctgtaaggaaacgcctatgaagatagataaataattttttagacggtagattcacccgactacgaaaatattttcagtgaaaaaaaaatgccgctgccggcgtgtgacaccctgaaaatttcaaatctagattacgggaacaaaattcaggattatcaaaaaacttttctaaaatccgtcacgctggattttatctcccattttctgttgcacttggaccacaaggacaaaaatctacggacaaaatctattttagattcaaatattatttattaaaagaaccatgattatgaaatgtattaattaagaaaatatttgtaaatacaattatctttctgaaatcccttttctatgaattagaacctatttgatgtatttgttttataaataaaaacaaatactagatattagaaaacatcattgtaagggataattccctggaaaactatttttacaatgaaggctaatgttaactaacctctgaaaatctagaagttaactattttggagttgttttacaaataaaaactagaggaaatttactagtgaaaccctatttgcgaactaaaatttttaaagaattcatttcaaaagattcacggaaaagtctagtttttcctccttgaaaggcctagcccaacacgcataatgagatttgtgttaattgtgtgcatttatatgtttgtgccaaagatctccgttaatccattcttgtgaatcccaatccttgttgggattcctccagattcgaattccacagttcgatcctcctcctaagttaataccctcctcgagcaaattattcgggcatctgcaaatactcgaacccagtgattttctggaaacgcctctcagtgtaatatccgttctctgttcctcctcaactccactagacggttacagtaccccgtcttttccttgaaccgtcagaataacacagataaatcgatccacctaaagagtgttcccccaaaccgacatccttccttaccctctctttcccccgtttgtcttgtcaagcacttcgatgttaaactgatcgaagtcccaaaattctttcatttgccacaataccatttctttccccgaacccttggaaccttgcgatcgaatcaaaacccgcttcatcttttcgactcagcctccctcagattcccttctttcctattttccctctactcgaaatccccgagttcggtctttcgcttgaaaccactaaagttgctcggcagatctaattgtcgtgcgtcgacccgtatattctcaattctatttctacctttgaaccccaccatgacgaatggatttgtatgccataaaccgctcctaaacccatagtcgatattgtccctacctttgaaacactaccgcgtccgatggatttgcatgcccaagcgtcgcttctaaaaatcccatcatatcgtcgtcaatttattcaagtggtcgcaaagaaaccctaagtcaaatacttgggcgactaaatggccgaatcacttccaatccaaaccccagttacaatttcagctcaaagtcaaaagtccagttatacagtccatttataaggcgcccagttatacatacaaaagtccagttatagagtcccgccttatatatgtttgtggagtgatgcaccgcattgatatatcttgttatttttttagtgaattttaaaaacatgaaaaaacgagatatgtgccctcaagagacaaatagactttctgtatttaacttgtttaaaacctaacaacctgaaattaaacgtttcatttatttccctttaattcgaagtttccaacattctctaagccttagatatacaccctccatcctaaaaagattagcttctgatccttagaagttgattttttcctttttacggaacattacacatcaatgcctcatcaaatttagccttacatatttataaagtaatctatcccatattaatggacgtgactacacagctagtggtagctggtttgtctaaatcatctaccacttcatctataagagatactatccacctatacttcaaatacaattttctcttaaactactcatccaatctacgatccgattacaccgttgtgttcgtaataattaaatctttacaacaagatctcacatgattatattttgatgaaaaatcacaaattacttttatgatatgtctaaattatttttagatttcactaagttacttcttagaaatacaaaagtaaattcagtaaagcttaaaagtaatttacatatgaagtaacttataaaaaaagtaactttaattaatacattttttcattgaacaaattatcatatatatataagttacttttagatttgattaaaatacttcctatacatttataatgctctgaggtgattacttttattattgtttttagttaattccataatttgtgctgattaatttaatttctagatagagtcatgtttttatctctacaacggatttacttcaaatggcatgccaaagttaccttcgttttgttctaagttacttctataatatatgtaaattacttttaagctttactgaatttacttttatatgtctaagaagtaacttagtgaaatataaaagtaatgtagacatatcataaaagtaatttgtgatttttcatcaaatataatcatgtgagatcttgttgtaaagatttaattgttgcgaacacaatggtgtaatcggatcgtagatcggatgaatagtttaagagaaaatttcataagaagaaaaaaatgcacaacctaatagaaaaactacttgcatgcatgtctgtaacgctactggtacttctcacgtaattgtctgcgtcgctcgttaagtctaaatcaagatgcctctcgaaatagattttgcgtatattaatatattttatttttaaatttgtcataagctactccaactccaagtagcttatgtgtgagaagagcccgttgacagccctaccatgaacaacctcggcatcgggggaaagttgacgtcgacgagcccctccagggccttcaccaccatccccatggtcggcctcgcgctctccgcgtcctgcacgcaccagcacgccaccttgcacgccctctccacctctcccatgtcgacctccccgcccagattgccgtccaccgcgtccctgaggtcgccgtcgccgtcgaacagcatcctcaccgccgtcaacgggaagaagtccgcctccaccgtgccgccggcgccgctgtcgtactcgtcgtcgtcggccgcctccgcctgccgccgccgctgctccacgttcctcctcccggatacgatctcgaacagcatcatcccgtagctgtacacgtccgccttcgccgtgaccgccgtgccggcgatccactccggcgccaggtaccccacggtcccgcgcgtcgtcgtcagcacgcggctggagtcgtcgcggcccatgagcttggcgagccccaagtcggcgaccttggcggcgaacgcgccgtcgaggaggatgttctccggcttgacgtcgcagtggatgatgcggtccctgcacttgtcgtgcaggtagtgcagccctctcgcgacgcccagggcgatctggtacctcgtcttccagctcaggacgccgccgccatggccggagccggagccgaagaggtgcctgtccagcgagccgttgggcatgtgctcgtacacgagcagcctccgtgttcggtcggtgcagaagccgagcagcctgatcaggttgacgtgctggatcatgccgatggtgctcacctccgcgcggaactgcttctcgccctgaccaacgccctcgagcttcttcaccgccaccggcgtcgcgtcccccggcagcgcgcccttgaacaccgacccgaaggcgccgccgccgatcttgtcggagaagttgttggtcacgagctgcaggtcacggtacgtgaacaccgtcaagaaggaggaggagtcctccagtctccgcaacgccttcgcccttttgcttctcatgacgagcaccgcgaccagaacggcgagggtcactgcggcggcgacaactccggcgacgacgagtccgatggtcattttcttggtgttcccggtgccggacaagtcggacgccacgccgaggcggatcgaaattctgtagccgtcggtgccggagccgttcgcgccccgaggttgatgaggtcgccgtaccagagcgtgcagctgccgttgtaggagtaggcggtgcaggagcagttgccgaggcacgcgagctcgcagtcgtcgtgagcgctcgcggtcgcggacggcgcggccacgccgccggtgggcagactgttcgccttgggcatcgtgaagaacgtgtcgtcgcgcttcgtcgtcttgcccgacgcctggccgccgccgccgcacggcatctgcaggccggtgatccgggcgcagccagcggttggtcgccgtacagccactgccgcggctgccgctccacgaatccctggaggcagccgcactccggcacagagccgtcggtgcagacgctgaaggagccgcagagcgagtagacgtcgcacagcgtgggctctgaccagaagagcacccaggtggcggcggactccacccacccccacagcatgatctgccccgccactcccacgacgatccgcgacaacagggcctcgtccttgacttcgaagacgacgtagctctcgttctcggcgtcgacgtagaggaaggtgtacggcgactgaccttcaggtcccgattcctccggcgcggtcgtccagttgccgccgccgcctctccagtactggtggctccgttccaggcgagccgcaggtgctggctcgcgccgccgccgccggcgtcgagctcgagggagaacatgcccggggtcgggtcgttggaacctttccaccgaccaggcgtgtcgcctcgccggtgagcttgttccggcggagcttgctgccggggagccacgtgttgtccaggtggtcgaagctctgccacagcacggcggaggtgttggacgcgtcggcaaggacaaggttgccggtgttgaggatgacaccgaccgtggagttggcggcggcggcgatgccggtgatgttggtggaccagaccggtgacctggtggcgcggtcgaggaggaccatgttgccgtcgctcgagatggagagctgcgacgattccgggtcggtgagtggggcctgcctgttggcaacccacagcttggtgtgttctcgggttttgtggtaccagatgcccatgtaccaacgctgcaaggcgttatctgttacgattacgaacaaggaaatggttaggtgatacttctacctaataaattaagggttaattagatttatgccacataaaattcatgtgttgtaattatgcctatgatcttttgcaaattactgtccattgattttttttatatatatatagatttggagcttcaaatcttacatatagttttcaactaatggatacagtccgttttgaagaaaataaccgaaaaagagacaaattaaacatgtcaaaatcataaatctaaagaaaaaaacagttgcaaaatttaattttggtgctctataaccaagtgtaagtacaaactgaatctacatgaatacaaatttttatgcaaaatcctactaacgaaaaattgaaagataggagtaaaaaatctctcacaagtgaaatagcaaactgcttgtaaaaaatgatatttatgcttctatgaccattaattttgaccaaattaccccctttttttcatctcctctactacccattctttcctgaggtttgctccggttcaacaaaaagtaccttgaggtaccggtacctcgcaataccaaaacattttcgatcgttggatctagctgtgcaggatgggcattgctagatccaacaatcggaaat

SEQ ID NO: 75710 - DNA, 11551 bp, Oryza sativa
ccatcaggagggggataggtagaaataagagaaaggaagaaaacagatggctcggaaactaatctttcttataaatttaagtgcatttatctgacttgaattaaaacactgaaaaggtagcaaacaactcctaattaaggcagtcataccactgacacatgatattgaccatcgactaacccacaagcacaaacctaaacacagaaactagcaagcaaacaaaactaagaaaatgataaggctaaaggtggcgactctgaagcttggagcggcgcttgcgatcgcagaataggtctgacatctaaagtagacaagggataggaaccaatacatgctcaaatccaaattaaacaaagcaacaaatgactcaagtaactcgccgagcatgatgatttttgtgcatggaacatttttcatgaacccagacaaaagatactaatgtaactgactaaacgataaattaatgcacaaaaatacatgaatagctataatgatacgcataaaatgtccccatcgaacctagacacggcttagtgcatatcacccaacaattcccgaccgactatcgaataaattccgaataaacttttactaaaaccctagactgtccctagtcgagaaatccaattaaataagtgaccaagattttcccacaaatgaaaagaacaaaccccaaaattttcccgaaacaaattcaagtgcaaagagcatatgcagatgaaaaggtttcagagggctctttgggttttccagttggcttgtcctacggacaaggtcggctctaataccaacttgtcacgcccagaaatacacgaaccagaatttctaagctgaatgtgcattaaacccctgtccaggaccagccagggtacacacacgacaattgttgacatacagattcacgtcttacaaaacaatataaaagattacaaatgcagcgggaaagataaaagcgaactaagcctgaagacttgactcctgcagcgggtgattccattccacaggcatccttgacggcagtgacgaatccaacttcttcgagacatctccaactgagaaggacatcaactctggagtgggggaaaagagagcaagactgagtactactcactgtactcagcaagtcataccggaaaaggaggtatgatgtaggatatatccaagggaggcaaaaaggttcttttgcataaagctagcatttaaaaagcagtagttgaaagcagtaaaacggttgcagtaattaatcaatattaacaaatcaatgtccaacgctacaccacgttgcaacaggcccaagcaaccacctgaactacaccagttcaaaagctaactagggatgagactaatcacggtgaatctggtcgaccgcccataactgcgggcacggctattcgaatagttttactctgatcagaggtgtacaattgtacccacaagacacagccccacgacacgtttccgtgcgccgacatgccaccacggcataccgaaaagaggccatgacaggacccttcgcataaccccctctaatcgatcgcaccacacctcaggattcgcccccgtccccagcaggcaatgggcagcccccctctcatgccgcggtgaatccggaagccaatcaaccagacaccccggccgacccaactccatcacgcccaccctcgcctgggtacatcggctagaggaaagctacactacaagcccagccgttgcccacgctggcttgtggtaagtacgataagttcttccagggaatctcgcgaaccggtccttaatcgccatgggcaggggtagcaaaaccatgcacccacggcccaccatgtagtgtattttaattaactaacaccattgcggtggctctattccaaagctatgccattaatcaaagtctatgcattaatgtgtttccccctttgtgtactagttgaactaagcatggctaagcatttcctaaaccaacatctagtcattttaaaactcaagttatcaatggcataaggtaaacaatatatggctgagtagtaggacccatcccacatgatattgtaaaataatgcaacatttgatagaaatgcgggacatttgtaaattaggtacaacatgatcaattataatgcatgacttgccttgctctcgcattgatgagaccacagcaacgtcttcacggaaccgcggatcgacgaaacggccgaaatctacgcgacaaacaaagcacacaagaaaaacatgctataagtctactgaaacaggaaacaaaaccatttttactatattctattcatttttatgaatttactgaatggacttaatcggagctcggatgaattagatatgaattttagaagattatctgtgtttttactataaaagaaaaacccttaatcaatttattgtgcaataactcatcccagggctgacgtcatcaaggagggggcggcgccgacatgcgggacccatgggtcagaggcacaagggagagggagggggtactggcaggcggggcccaccgggcggcggttcatgggggaggaggtggcaccggccaggctcggctcggcttcaagtcggccgcccgatgatggcgatgcggtggtggcgggtggttgccggcgacggcaaccggcgcgagaagcggcggtgggtggtgcgaaaagcagcggtggcgccgaaggcgacgccacgcatgcggaggacagcggcgcacacaggagagagggaaagagggaggagaaggagttttcaccggcgggcacggcggccggcgcgaaggatgaaggcggcggcgacgacccgacgagcggaggggcagacgggcggcggttgcacctacggaggaaaatagagaggagttagtggttgggaggaagcccacggcggctagcgtggccggccagagataggaagggcagcgaaactcattggcgcacggagagagaggcgttccggcggcgggattggatggggatgcggcggccggggtagctttggcggcggcgaagctaaccgcggcggcagcttgattctgcggcggctctagcggcgacgagcggtggccggagaagtggagatggcggcgatggatgggtgcacggtgcgggagcggtggagagctcgggagcggcctgcgagtgagggaaacgagagatggcgttgcggggaagctttatagggcctcgggagaggcggttgtggccaggaatgggctctatttggccggcgacgacatggggaaggtggggagagaaagagggagagagacggaattcaaattgaatcctgcctctatgcgggcacgcgcgcgcgggctggaaggcggtgaagggggcgggcgacgtgggcggcgacttgggggggcgtgtgggcacggatgcggaggaagtggcagcgtgggcggcggttgctgccggctggaggaggaagacggggtcgacaggtgggccccacctgtcggtgacccggagagaggagggagggagacgtgggccggcccagcaaggaggagggtggcgcgggaggagtgggccgatggcgcaaaggaggaaaagaggaaaaagaaaagaggggaaaagaaaaaaagattttcctgggatttaagtattgcatttttcttattttaattgtgtaaaattatttccaaggctctgaaaattccactaaaaattctgttagcatattttgacatgtagaatccaagaaaattccacatgtcgattccgattattatttgcatttattaatttagggattcacctctaggttaaattaaatcatttctgcggacgatttattttatgaattttaaagcaaagaggggaactttagggcgtgacagtagacaaacctgtcgggtgggctccttaaggtgtgctgtgctggcatgcctacgtgtctttccacgtagtcaaaagtggcaaatagttaagaaactcccctctcttcgatgacaattttgttgggatgaatacataaagtggtatttggaaagtggtattttgtaagagtggcaaattgtttaattcgtaggagaatgaatgaattgagaaatggatcagttatggtgtggtaaaagggaataaacaggtgagacatgattgatgttagtgaaaacttaccgtatcctcagggttaaaggatgcggggtgggagaggcgcagtggacctaacaataatagcgtgtatgtagctcatagttctaattatttaaacttattctcgattataatacacaatggaattatgcatgtgtagtttattttgtttgtttgaatgtattatatttttctctagtaccaattatgtataagagggatattatttccgatagttgatccaaagtttatcaattcttcatcttctatagaaaaataaaaagatggcttgactaagctggatcaatgagagcaacgtattttgcttagtttcacccagacaacatatcaactgtcctcttgtaatatgtatgtcggcttggatcggaggcaaccagcctaaagatgggacacagttgttacaactaacaacattgtagtctagaatatggtatagtaatacagtaacatgaagctcttaaatatttctcgatatttagaacatggaacaaataatgttgttatagtataccaaccttacatgagtatagagaaagtatgtggacttccaacatggaaggacatatacatataagaggcacattatttattctgtaagtaacacaacatggagttcttgctccttgcatctcaagtattacttgctcattgccttcattcctttcatgtcaagttaatgacaaatgaagttgcctatgttagcaaagccacaaacacgaagtatcgtttggatggagaaaccattagggataacaccaccactgaacttgaaggaatcacataggcaactggcggcatcagtgctagatagactggtgatcggtggacaacaatcctgcttaaccaaactcggggagatgagcagagttgacggatcaagttttgcgcacacgttgagcgctaataccttttcttttgggcactgaccacctctggatggaggtggcggctgtgatatcggtggttgtgatggagttgctggaggtggaggtggcatggtttgtgttggtggcggcggaacactgtgcggtggtggcacccgcggcggtgtacgtgatggtgttggagctggagcgggcattggagttggttcctcgctaacaggagttggcggtggaaccctttgtggtggtggtgcatgtggaggtgcacgtgatggtgtcggagtaaggttaataggtgttggtgctggagcgggtgccggtgttggttgttcattaaccggaggtggtgatggaatcctttgtggtggtggtgcgcgtggaggtgcacgtgatggtgtcggagtaacagtaacaggggttggtgctggagcgggtgccggtgttggttcttcactaaccggagatggcggtggaaccctttgtggtggtggtgcacggggaggtgcacgtgatggtgtcggagtaaggttaacaggtgtaggtgcaggagagggttccgcagttggttcttcgttaaccggaggtggtggtggaaccctttgtggtgccggtgcacgtgatggtgttggtgtcacattggtcggtgttggtgcttggccgggtgccgatgttggctcttcgctaaccgaaggtggcggtggaaccctttgcggtggtgatgcacgaggaggtgcacgtgatggtgttggagaaacatttataggggttggcgctggagcaggtgccggtgttggttcttcactaaccggagatggcggtggaaccctttgcggtggtggcgcacgcggaggtgcgcctggtggggttggttctggtggtggtgtggcacttactggtggtggcggtggtattgtttgtggtggtggtggtagcggcggcgggggtgcacgtggcgggttccttctgggaggtgttgcaggttgctgggccttggcaaaagaagagagcgtgagaatcacgacggcgaacaggatggcattggggactgccatggctactcgccgtggtgctcggctctttcctgcctttgaactgatgaagtatatgaagctatttataggctaccgctagccgctttgcaatgttggtggtggcttggtacagcttatggtcacaactggattggaattttgcctcacacaactcggagacttgtagcaattgctaattaatcgtagcacgtgtacacaaagcgtactgaccaattagatagcatcaatcatgcttaccttcaactatcgaacagtgagctcaaggacattttgggtcactctcgaatttattcaacatttatgggcaacatggcaggaaatgcttagatgctggaggagggaatttgtcctattggtcctatggctcccttagctgtgcatatgtacatataaatcgttcctagcagggacacagctccaaagcaaataaaatcgacgcctgttctctcacctattctccattgcatatgcatggacctgatacaaactttgttctaatttgatttacaagaaacagttcaaatcttgtaagaacctaaaatcaataggtgttccgaaagaggtggaggcatatctttacccaggtggaactccattaagttgtttgctgggtataaatctgcatgcaaatcaatataaaagatataatatttttttgaccattaattacaaagacacatctattgttagtagtgatactgctaggttgagaaccactagataaaacatttactctcccgtttcagattacttaccgttctaagttaacaagtgaagtgaattatatagtgtgaacatgtttctcatggtgattctaaaagtataaatctaacgatgtttaaagataaagatataagtttatagaatttgatggtgaaagattaaacttgtttgatatcaatgacaactaatttagaatggagggagtagtgtcttactcctttcgtccaaccattaatatatataagcatttaaattctgtaaaaatataagcatttatacactactacatgttatgttaatcacctctcatttaaatttcttctgatcttttgtctaatcatcctttcactcccaaccatatatgttattataggggggcactaacaatatttctccgcaacctaaacttttggtaaattactaaaaaaaagctttggaaaacaactgaaaatgcattatatgttggatggaaggaccttattgagggatgcaaagaatcattccataaagagattttgcgccactaaaataaaatgcacaccttatatatcattcactctagggctagttttggtataggccatatatagttgccgagaatctggtccatatcatttcgttgacacgctctaagggtcattagatactatatccatggcttaatttttggtgagtcacttctatccatgtttcttggctagtagggagtcaaatcatagacgtttccgttgcacgtcaccacacagttagccactggctcctctgacgggtggggaaaatatgtataaaaagtccatttcacaatataagttattctataacttttcacatttagattaatgttaataaatctagacatatatatctatttagattcattaacatcaatatgaatgtggaaaatgttagaatgacttacattgtgaaacggagaaagtatgaaggactgactccaattctatagaaaaatttattaggtagtgttgacttttttcataaccaacacaaaatcacccaacgatgatttacggtgtaaccaatggagtcgacaaaatcgatagataaaaccagctagctgagccaattttgaatttaatttactttcgcgtaatcaaacaactattttatgagcaaattaacaaagaagataaatattgtacttttctaacgaaagaacaactagcgtctgagcaacctccgcgctttagtggataagcatgacccttttttagtgcaaaacggcaaaaaattaaccaaattttagaattgctataagtcagccatgcaaacaaaataaaaattaacataaaaataaaagtaaagaacagaaaaattatagattgataaattgtttggggtcccttcccaataggtcatcaatggtatatataccagctgggccttaatatttgggaaatctagtcagttccacacaaaatatatctaacttcaaccgaaaacgaaataaactgatcgttatctctaactcatcaactcctatgcctaagataatcacatactcccttcatcaaaaaaaaaaaatctaggagggtatgtgacccctccttatacacatcaaaaaaaaaatctaggagggtatgtgacccctccttatacaacgaatctaagacaatcctctctgtctagattcattgtactaggaggggacacatcctttcttaggttaggaggggtcatatcctatcttaggttaccttttttttttatggagggagtacaccatttgtaattcagccaagcaacgcaggataaggtaactatacggactcccacaaaacgcgacttatttcgaaaacgcttcgtatcttatgtccgatatggacgaaactctggacggtgggacccatagccgaaacctttccccaactttatcctcattcttcggttcttcctcatccccaaccacactagcgaagttaactctcgcggcgaagggcagtgggacctgatccaggacggtgcggaggctgctgagtcggcggcacgcgccggaggcaaagagggagagtcaggtgacgagcggggtgccgaggaggacgaggccaacgagcaccatccacagctacttgcgcatgcgccgggtggaacaccaccgcccaccacaccagcacggccgcgcccaccactcccgttgccaccacgcgcgccgccatggccaggcacgaccacgtcaaccacatcctctcccccgctgccgccgctgctcgctgctgtcctcctcctcctctcgcctccacgtccaccttgttgactggctccctctcgtggtgcgccattgcgagcacactgctggtgaatatactattttctggaggggggacctaaggaaggagtcgccggcagccatgtaggtggcggcggccgacggagaagcacgaagcgaagagggaggagggctctgaggtcggcaatgaaggtgaagaggcttgtggcaacgtcgaactagctaacgaggattgttgcacactacatgtttttttgttacatatagtgtgttcgtgatgttggaattcgttttttatgtttcttaaatcagtactagatgttgcatttggtttctttgatgttccacatattgggttttactgagtgttacatttaattgaaacatcttcaataaagcggtgaaacattcttctgtgaaagatgaaacatcgagaaacaattaatgttgaaacattttttttcgagctatgaaacattacagcatttatttaacatacagtgtaacatcgtttggagatttcatgttgaaacattttttttgagcgatggaacattgcaacattcatttaacatacactgcaatatcatccgaagatttgcaaatatctggacgaccgatgcgtagcactatccgaataatttttgtacacagttccatgcatgtagcgtgttcgtcctcctgcacagcgggtcccacgtgaagaaaatgtggagccaaggaaaagatcacgcacagtccaacaaaagccatcctgcatcctgcatccagcaaatttggatggctgcatttcatctgcttcctttgcatgcatataatcaactcaagcacagttatatcagctgcatcggtacatatccaatataagccaaatgcttcagtagctagcaccaaaaaccaatacatccactactaaaaaatatttttttcctaacgctatgatttatttttctaggtggactataaaatcactgttgttaaaatagctaaaggtaccatgaaagtagtcccacctgcgaaaatcgattttttttagtcagaccacttaagagatctgcctacaaaatacaagaccttaagatgtctacatgcgacaaggttatactatataaaaatcatcacctatatctagccccatttccaccaagtcctctaacctctccttccctctctctcaccaaaaccggtctatcctcccacctctccttccctctcccacctcacactccacctccgaacaggcggcgcacgtggccccctcccctcccctccctttccctcccaaatccgacagtaagaggctagggcggcgatggcgtggaagcagcggggaggaggcactcacctctccccgctcctaaatccggctggagtaggggagagcggcagcggcggcgtggaagcagcgtggaggcagcgctcccctcccttacctccctcctcactcctacatccaaccggaggagggcgagcggcggcggcggcgcttccctcccctcgctcccttcctccctctccgtgctagattcggccagaggagggcgagcggtggtgtagaggcggtgacggtggcagctccactccctccctctctattcctagatccggctagacgagggggagcgatagcaacgttggcaacgctaccctccccttgctccctccctccctctcagatctggcacacggtgttggctctcccctcccctcccacccagattaggccggggggtgggtggggggggggagggcggtggcggtggctggcggctccccaccctctccctcccaaattatttttgtgttcgcttaaaatatttaagcaagcggatggatctagcgcctgcgaagatggagaagccgcctaccaaaatcatttttgcagactgaaggccacctgtgaaaatgacgtgttttcataggccttgaagtacaggcggggtgaatgtctgcctggaaaatttcatattgacctcttgttaaaatatgtattctagtagggattactccacatatttaaatggctcctaaaccaaccactcaacaaatttcctaaatcctaaagttagagctcactaaatcctaaaacttattatgcaaagatactccatcatcatccactaacaattaataaatttaaacatcatacaagcattttatattatctataattttataatttattaaattttatagcttttcaaattcaagcacgttaagtcatcatttcacataattcacataatatttcaatatgtctttccatcttttttatagtatcttatatagtccaacttaactcctaatttagtaaatgtgctctctctctctctcttctctcattaagccagatcacataaatatttgtgtccttaaatgattatacatggtccaaattctccgttcttttattctcttattaaggcccttcttttattctttagtcagcttaggattatgataatctagattattagaagtaagctgaaacaaacagatagcttattatgatatattattataatctataagctagat

SEQ ID NO: 75711 - DNA, 14871 bp, Oryza sativa
ggagcaaaccacttttttcagcctcgtctccatgagtagccgcctgtagcggtgtctcatcaccccttccctgatacgcttgtccacgggaagccgccaccacagacaaccccaacagcaataaggtaggcatttctggttatgtacatggatattcctctctctaggctcatattattttttatgaaataaaattgaatcaattatattcgtattcaaaagtagttatgattatgcttttataacataagacataagtgatatcctaatagaataattgtcggtcaaactcttaccctgacaaaacaaaatatgccatctatttttctatagtggaatttattttggcctttacttcaacaagctatagccaattagtaaagagattgaataacgaacgactacgagttgcaaaatcatagtttgattaaaaacaagaaaactactttaaaataccatctcaaaggcagggattttttttatctatggttggtgagaatatgcataaccattatttcttcacaatggtttacatgtagcatgtagttgtctttctcaaattcaaaaacaaaatctctgaaatcagcaaccggtcattgtgttgatcgaattgtgcacacatcactgccggcagctgacgtcgaaccaaagtaaaagataacatcggagaatacttagctataaacaatgattcacccaatcttctcatcaccatatccatcaaagccaatccgacgaaaacttagccacctagaatgccaaaccacatagagtctctaatatgacgtatctaagaaggtcatgacatgtaggatgtcgtcatcactatttcgtccatctggaactaggtttttaccggtggcgaatctaggaatttttttaagcccaggcaaacctaatgatgagtaaaaagtacacttaaatccatataactatgtagactatttagtatacgcatatgtaaaattttcaattgtcgagttctaaattaaggagaagaaaaccaatgtacgaaattatattgatgaaatgatggtcatgcattgttgatggattagattatagtcttgtattatcttaaaatgaaaaatatgatgatgaatgttacagttaagctgatccacttatctgacttatatttgaactagtaaataaattaagaacgtaattacctactacgcaactgcatgcaggtgaatgtctgaaccctgtgactaagcaagataactatgtactgcttagggcattttcaatggtagagacgagtatggtctcttaaacaatacaagattactaagagaccatgtctttacaatagttgagacgacaaaggctctaatcattaactcaaaaaatattccttttattaatattctttctatttttttaccctcatgcaaccatatttccatattatagtgattaagagtcgttgttaagccgttgtcatgcataacaacgatgttttgtctctcccctttctctttcttccatgtcaacaagtattcctaattagcaacgctaagagaccactattgacaaccattatacatgcccttattgcactatatatagtgcactgaatgcagcaaaatgatggtaacaagtactactgatcacttgattcatgcagcgaagcccaggcaactgcccatgctagcctggcattggctctgccgctagtttttacagagagcttatccgacacgaagtgaggaaatggaagtcaacaacatcatcttctttaggaaggagtgtggcacccacaggtgtcacagatgtcgatactcctagcgttgatgacccggtcctaggtctacggtaatctaattaagctcgaccttctatgtcgtggctggtgacaggaggaaaggggcgaggcacatgcgccaacaacatcttgtcctaccatcttcattgattcgaagaggctaacaatagcgatggtatatagggtggaggcctccttcagcccagatggttactctagtagtgtctcaagaagacgtacttgttgtggaggccaaatctggctagaccttgccactgccttcctcgagagccatcgtcgcattctcgtctagggcaaaaaaataggtaggaagtatattatatataaaaagtttaatgcttgtgtcggtgggacacatgcatgcacgacaactagataccccataaattaaatgccgctcgaatttatcaattttatggctggactattattttgcaaaaaaaaaaaaggattttgggaccatataattgtcaatatccaaatccacatgagaaagtgtagtttaaacttgaataaaatctgaaatccagatgtctaccttgttacttttgtgaccgacggtaattttcaaacttgaattaataacctgaaatgcaacaggtcaaagtgtgtaatattacaaaataatgcaagtcaaactaatcggtccacatgattaagaattgaacatcgtgaaattaatgaacacgcagatgcagctacgagtgactgcaaaagcgaaaaatttgacttccgttgtgaactctgaactcttcttccgttgtgaacaaattttgagtatttgtttgtaattgtacgtctttgtctttgaatttttcaatacaatggaacaagacaaacttttatgggtgaaacagttcgagtgaccaacatttcattgtagtcggtggaaaaaaaaggctcggtgactcgttttttttaaaaaaaaaaagttctgaatgatcttttttaaagtggaaattatttaattttgaatgaaaattgttttcactgcggctcgttaataagaaaaatctcaaatgacagagaagaatataataaactatataaaagttcgaaaaaagctcaataaaaatatggccaaacttttttttcccaatccagtgcactgtacaatgtgtacatacgtatatttcattgtataattaattagtccaatcaattgatgcagcttcgccgattaagctttaatttgtatcattcggaaaaataaaactgtagatgtggtggtgaagtagtggtgcgtgatttcatccatcagggtttaaattctaattcttacgaatattacgcatatatatgtgcaagtaattttttaacagaaatttagtaagattaaaaatgtacagctactaataaacttttacctctttgagtatgtgttaggacattttcgtaggtgtgtgagcatggggttgcgtatgtagtgatggtgtgtgcgtacatctaccatgtaaatagttcgaataaaaaaagtaggttaaactgttaactgacactccgcccgattggcaacaaccaatcaggcaaaagaaacaagtaaacaacacacgaacataagggagctagcaaagcgtcgctgaccgcgatcgagacacgatcgatcagggggtaaccgaactgatgaagtgatgatcaggaggcgaggaagaggtagcttagctgctataggtacctggctggaagaagcctaccgcgaacctgccacccttggacaccagcctccgcccgcctgaaagcggccggccgacggccaaggtatcggtggcggcggcgcgcgacggagccagagccaccccttggtgcggccacagcagcaggcagctgctgatgatcagcgccagctgaaggagcggagagcagcggcaggaggacgaccaccaccacggtcgtcgtcgtcgtccaccccgagccgccattgctccaccaaacacaaacctccactagctagctagctacgacagatattagctttgcgaggaggagcgacagatattaattaatataaaaaggaatcgaatcgatcgatgggtatgggtaagttgacgtttgccagcgtcggccggctatccggggtgtgaattttctacacgttaggtgcaagcttattggtacccattattttcgtcttatctaaatattcgtcgtaaaaattacaccctttcttttggtcagtcagccttttgatatctgtctttttaggctcgtccacccaatcccctctgcccttccactccagggttcaatcccatttgccatttgaagttgaatcccatccccttcatcttgtggagtttttaaaaaggagtgcaaataaaatccaaaatttgaaaatgagtaaaattctaaaaactacctaggaacatcccgaaaattctgaaaaaaaataaaggactgaaaattactgtaaaattcagttggtaataagtaaaatagttacaatgatcataaaacatgacaaactaatgatctactagaaaacatgataaacttttaaacgagcaattagtgcatgctgtccacaacatttgactactcaatttaacttcacaacctttgatccatcatcatgacaatcagggttgacatcaaacactaagtacatacacattgttctataaaaaaagccaaaggatcacagaaatttgattcgtccaaaagttaagaaattcctctcatttcatctccacatgattactccatgaatgcctgaggaaaaaagtaataacgattgaagtgcgatgatgcaagaatgatcttataaagtcatgttcatgcgtagttgaatgtatgactatgctacacttcattgtttccgatatgaatttttgacttccgaccaatatcggtagattcctttccgacggtcccgtttccaatataccgatattatctatatggttaccgtttatggtataccgttctgattccgttttcgagaaaaaaatgaaaatgaaaatggtagagggtttttcctaccgttttcatcctaatcctcctggtatcttggtagttgtacaaggagcggaactccagggttttcgattactctctcttcggtttcagttgctttggactccatcctacagaaaggtcgtccgtggtcgttggcggtgccgctgtttttcgaggcctgttgggaattgtttttcgagtcctgttgggaatatagtgtggttcctccgtcaccgatctccttcaatattggagcagcatttctttttcgctattttaaccatagcagtcttttttttcttctaatatattaacgtgtgatccttttgcgcgttcacgaaaaaaaacccataaatccataatagaatagctaacgaccagcccaaacgagtctgaattctgaattatgaacagatcatcaaagatcacacgccgagtaatctcatatttcgagtgtttcacttgccgaattttcatttcttgggttcttcctgggtctcatatattgaatcatattatcatattggagtatattttaaacatgcgaatatgtgatgtcgtttacttccattagttccaacaatctccgagctcatcacatattccacaatatgcatatatatcaagctgagccattcctggtggcgaagatcctgtgcgagacgacgacgccgagcgcgaacgcggcgacggcggcggcgatcgcgctcccccgatcccacctggcccgctccttctccatctccatctgcatctccgcctctaccctcgcgtcctccatcgtcgccatcaccacctccgccgcgccgcccgcggggcgcttcggcacggtgaggcacagcgtggcgccgtcgaagcgggcggcgatccggtccacatcggccgccggcggcagctggaactcgcggtggaggcggacgtgccccgcgggccgctgcccgcgcaccgtgacgcgccccgcgccgtccacctgcacgcggaactcctccttcctgaacccggcgaggtcgaggcgggcgacgtagcccgcggcgccgtcgtgccacttcacctccggctgcaggtcgacgtcgcggggctccacctccgccgccgccgctcccttcgccgatctcgatcccttgggcacgcacgtcgacatggtggatcgatatgctaagctatagcctcgcgggcgatctggaccaaggaggagctatggatggtgagatggagctccaaggagggagccatatatacttacgtgattgtgtgttgaattggttattcgaagcgttttcttcaaggtgacacaactctcgatcgatcgatcgcaccaagaaaattggtgtttattggcgtcgagggttgggtttgggtagggatcttggttttgtctcgttttccaagcctacaagctacgcacagtactcttctacttacatttacttgctttcggcatggatgcatatacatggcatcaggcatctgctggttacctaggactacgattgccacctacgagaaatgtccaattcctctcatctgaagaaaacgtgagcgggattccttttataaatacatgattttagtaatacaggaaccgatatatgaaaaatataggaatagaattgacgtagtatatatgaatcccacgaaaatcaaagtcacatatgtttaaaagataatgtgtataggtggctcacaagaaaataacatatgaattttgatggattttatgttgcttttgactactcaaaggaaaaaaaataaaaagttgtttgagctcaaatcctatatatattccccaatggaatggattctaaaagaattggcatatgctctaatattttgttccaaacaaaacatgtgtataggaaaatctctaaaattcttatgaatttcctccaatccaaaagagcgggttggagctacagtacttccatcggcagatcaattgatcaagtcatcaagcatgtggcaccatcttgatgttcaattatggttggtcattaaattcttcctccatatttaaatataagatactgatggctttatatggacaaattcaaaacttgaacaaccgatagctctcaaagatttattttgaaaacataaaaaacaattatggatagatttttctttataaatactattataattttgttagttagtagtcaaagttgaaaagaaactggaatgtcaaataatgttatatatttaaatatggaggtagtataagctattagttgctagggaaacccaactgcgtacatagcaattataagctagttccattggcagaatgttattgagaaacacgagacgatgtgcattttatataaactagcaatgtgctcataagtgcaatgggataaactaattaatatttttttttaggaatatgcaaaagaattgtgcatctttatacaaagacaccatggccgcgaaagggtatacttagtaaaataagaaaaacacaccacgctgcgtgccaacaccactaccatagcctgaggaagagacctatgtgccaagacggctgccccaacataactgattgtcgttgggcctacaatgcagctatgggtgaaagaacctctaaaatgatgcctccaaggaggttatgacactgaaaacaccgtcatcgcttgtcaaaggatacttggatgtggttttcacttaaaggatcccaataaaaaagatgagggaggcacctcgagaaatgcctttaagagggttgtggcacccaaaggcattaccgtcgccggcctaggaataccatgctagatttcccatagaatctgcctacacccctgttgttgagacctcatcgaccaccaatcttgccaacacatcatcaccaccacaacgtcgctctctacttgacttctgtcctactgccagcacaaccacaaccatccatgcctacacactggcacgaccatgaccatgaccatgacaatgaccaccgaccgttgcacgatggcgaccatattggccttcctcctatgccatcacctcaccaagaaggagcgaggtgactgccaacacccaccacttcacgtcggcaatctcggatttcctctcctgtcatcgcatataccgtctcaccatagagttccccacgatcagatctaaaccggccataaaagggaggagctacaaggagatgaaaacgcactagcaacagaggacgacccgtcgttgccacccgtgatggtgatgttctgcggctcgatccaagtttgaggccccgaatccggcggctgctccaccaaccagtgcttgcatcactgccttctgcatggtcaacctcacgagtgcatgcgctctatccgtcggctgcttgctgcatgggccaacatgctgctaccagcctccgccttcatcaatgcgtactagacctctgcccggtaggccccacactccttgccaactacagaccctcgccgttgcaaccccgcctctagccagtaacacgaatagcctctgaccacacccactacatcctcagcaccaagtagatttagagtttgttgtcataggaggcaatctttaggttccaggggcacactgtgcaaccatggagaaggcctcgctgtcaccggtgacctaccgagcggccgtcggcgacgatgacgaggggaagatagggtttctggagggttgggaaagatgcagcgtgattcacttagtgagtcgctggagcggctcatgagacctttttagaagaaaagtttcataatctcaaacctaattaatatttatgactaatattaaataattgattcagtttcgacatatctttgtatgattgcatatcagggagcaatttcaacatctatgactcgtaaacatgaccatcttcgcaccagagagtttctttttaaatgtttgtgttagggagcttaattcgatgcgcatgcatgtggagccatggagccgagcagagtaaagataaatcaccaattaacaaaagagcatggaggtgaagatagacccgagcatatctttcttttctcaatgaaagcctcaagaatatctcaaatcaatcttaagaaaaaaaaataattcaattatctgcttatgcacaacccactgaattttgcgtaggaatcttttgcacatgtgcagatgcgtatcacaataataatcatgataggaaagcgatcttgtgcagaataagaactcgatctgatgaaaagcacacatggacatgaatcggacatcatatcaagaaatttgcgaaaatgcttagtgacgtaagtccgggcgactccaaaatattggacacactcgtccttatccagaacacttagctacctcctccaccacacgttcccacatctcttcattttatttttaccctccctcttgctctatctctcctgaaagacttcatcccaatggccatacggtggcagaggaggcactgggcctcgcttcgttaaaaacacgatgatgacgacaacggcggtgcagggtacatgacaacagcagaggcagtgtgtcagggggcatagggcgacacaggatatgatgaagacgttggaccttgccgccattggcggccgccgggggagggggcagggggcagggcacgacgacacgggatggggaaaaggtgttggatctagctactgacaaggaccgaatgctgatgcagctggccttagtcggaggacgcccgtcttgcgccactgctcgcctgcgtcttccctgtgtcgtcgcctcccccgccgcatcggtggttctggtggctgaagtagaagaagacggaggtgggttcattttcttagagcttttagagattttgcaccccgattgtttttcttgttgcactttattttatcaaggtgtttcattatattttgatttggtgttgcatatattgattctttgtgttgtgattggtatgtttcatgttgtattttgtcacaccccgatccggcaccgccgtacaatggctcctgacaggagcgtgtcgtaggaaaacggcgcgaaccacttcctacgaaaccgcgatcacagtaccagtcccaggacatagtgctggtacccacggtgacaaatatgattcattgcaatccttaaaataaatagaggacttatttaccttaacttaggttgcagctcagacagcccgagaatacaaccgacgacgcggacgaggaaacaccaacaacagcagcagtgaaaccaacggactaacacccaacaccacaggcgacggctgggaaccaagacaaaaccctaatcttcacttcacttcatcttcaacttcagggcagaggaactatatatatttatatagagcaagggtgagtactttcgtactcagcaagtcacgggaataggtgtttaatacaagcttggaagagaggcaaggttgttttgcaaatcttttgtttgaaatcattttgaaatcactaagtgatttatttcttttcaagtttaggccaaaaagagacttgcgtctcgattcgacttaagagatgcttttcaacaactcaaatggtaatgtaccgacctcccaggtcagatcattacttcttggctcccagagtcatttcacttgattaagcggctcccggagcctttttcattttctcggactcccagagtccagctgcccagcagcaaagcaatccgtttctactcgagaagcctagtctatgatgcccacagacatcccgaatcacacagattcgtttctgaccactcaggtcatccatctgccacatagactgattctggttacgattcccattccacaacaacttttcacaaagcacaggcaaacaaatctacgcaacgggaaccacctcacatccgcccatgaccgtgggcacggctgttcgaacagatagttaacctctacagaggggtacactttacccacaagatacgaacttattccgaacacccgtcggtgtcggagtttcgcaacaaagcctttcctaagccggcccagggttacctcatgccacatagaaggatcaaatcctcacataaatataggctattttagttttcacaaatcaaactccaaccacctcgatcggtaattcagcaagcttctcttccttgcttaccaggaacccggtttggctccaaccgaccccgccccggcgttccccaactattggcatgcaaggtttccctaaaccgactaattacttagccagggtggcccataccaccttgtggttgcactttgttatgcttgatgagtttcccacaggaatcggtcctcatatgcaaatacgggacaacgccacgtaggcacggcacccgcatcgcgagttttcacaaactattttattttcaaacacaccgacaccacatgtcgggttttcaaggcttctcaaacccatttcccaaattttcgacaatcaacgatgtatgtgggatatttagtatacgcgctcagagagcacgaataccgaagtaccacaaggatggagcaacaggaaatcagggtagtacagcctacaggaattagtgcgactactgggtaggtccgtcgatttggcacgcaaaccgaggcctagcaaattaagtgtgtgattctaataatgcaagttacaaacaaaataataatgattttccaattataggagcaattgatcaaagggtgacttgccttgcttaaggtcttcacgaagcttcacgaatcttcgagaaaacccgcgatcgacgaaaatccggtaaccgcaactatacgcaaacaattaaaaacctacacaaaacccaaaataaagatcatatttagactaaataatagtgccattaaatagatctcaattttacggaattattgaaagttgaacggagtcaatcggatgaacggatctagagatatgaatttttgaagcttaattggaatttctggaatatgagaaatgatttgttggaatttttggaacaaagaaatgatctattgaatttatggaaaagaatatacccaagaataccctttaattactcattgacatgtggggccaactggcggggaagatggacttttgtgtatgtgagttgatttggtggagggagaaaatacagactttttaggccgagcgtgaggcgcggcccaaaggagattggcccattagggctcgggtggggagagagaggcggaggctgactgggcggctgacggggcaggcgcggacttggtcaagcccacgtggactgccacgcaagcgcgagagagagggaggccaggctcgcccggatcggacggctcacggcggccgaggggcgccggcgaacggcggcgaaccggagtgaggcgcggacactggaagcaagagggagtcgaggcgattccatccaccggctcggatgagggagaggcggcgcgacggcggccggcgacggcggccgtgcggcggcgggatgggtggcacggcgcgggcgcggccggcgaggcgggcggccgcggaggcgcaccggggagtttcgccggggctcaaggagggtggcagcgcgaggggttgaggagagaagggccgacggcggaactgcggttgcgcacggcggcggcggaaacacggccgcggcgggctaccgcgagcgtgggtgcggcgagaaggaaaagtggggagcggccaatgggaagggggcgcgaggaactccgggagtgtgacggcgagctggttagagagagagagagaggccaacgacggcgcgtggcgcgcgcggcatcgagggtggcaggatgatagcgagaagagagataaagagggtggtgacagcattgcgcgcggtaaggggaaggggcgggggctcaccggcggccacgaatcgaccttggcggcggcggtccgctgatgggaaggaggcggcggcgcacgactgggttccagggaacggcgttcgcgccggtggtctcggttcggggacaccgcgtcggccgagcggcggagtctagcggcgaatttgacaccgaggcggcacggtgccgaggcgagcgcgccggggaagggagtgcgggagtgcgggggtggtaggatttggggacggcggtggagcggcaagaaccgaacgagaagggcgctcgaactgggttttataggcggtggtaaagtcggtttggggggaaggggggggggaaccgacctagacggtcaaggagcgggagatggcggtcgagcgtggtcgcgggcccggcaaaggaggcgatggtggatggaagggaaaaagccaaaagcggaagggggaaaggagctttgctcccttccggtttttgggccaccttagggaggagacagcgcgtgggagagagaggcgctgcctccgcattttggacgcacgcgagctgtggcgcagaggtgggtgcggcggcagagtgggcgcgggcggctgcgcggcgcaggcgggccagggcgaacggcgaccgagggcggtcggccaccacgcgggagcgcgcgcgcggagcaagggcgcggcggaattcaaaggcggaggcaggaatcggtgccggtgagtgaaacggggagaggaagagcgagagagagagagctcggctcggggatggctcacgcgcacgcgcgtgcggcgaacgtgcggagcgagggaggggaaggctgagagagagaacgggccgggccgagagagagagatgggccgagggaagaaaaccggtccacaaaaaggaagagggaggagataggcagagtggaggggatccggcccatccaaaattagaaggaggcaaaatagacttctacagagaaattgaattggagagaattggagtttaggtttgaattcaaatttgatatttggacttaggaacatagggtggagtcaaggaactggttcaaggaagactcggatattttggaatcgagacaagtatttggcgaggattcaaaggaggcgattgaatttcggagacttgaattggaattggaatcttgaggtggacgattttgatagcgacgagagggaacaacgatggagattgaattgagatccacggcacgacttagactctcactcaaagaacgaaattttcgcatataggattttctagaattagttttttttaacgtctcacgaaaagcggagcgttacatatttggttgagacactttcattcacgggataaaacatttttccccgtctgatgaaacattttaaacttttttttattgaatagtgaaacattttataataatacattgcaacattatccgatatgatgttttgtaaaacatcggacgtatgattgtggcactctctagaaattggatgacgatttaatcagtgcgaagtcgtttttatccaagactttttcatggttgctgtttgatcggaatcgggcggacgcaggacacaatacctcaccgtgcgacacactgatcagtggacgacggaccaaaacccctgacagaaaacactattgcgaagaaacaaataagagcacaagcctactgtcccgcacctaagaaacacacacacacacactcatgtggattacaggagttatttttcatgcatgtactcagtactcccactaatcccagcaaatcaatctctgagctcacatacacaacatcattcatcaagcccatcaattaaccattcctggtgtagagtaagatcccgtgcgacacgacgacgccgagcgcgaacgccgccgcggcggcggcggcggcggcgaccacgctcccgctgtcccacctggccgcccgctccttcttcttctccgtctccgtctccgtctccgccacctccatcgtcgtcgccatcaccacccccgtcgccgccgcggccgccgcggggcgcttcttgggcacggtgaggaacagcgtggtgccgacgaagcgggcggcgacgcggtccgagtcggccgtcgggggaagctggatcacgcggcggaggcggacgtgcggccccgccgccgcgggccgctgcccgagcaccgtcacgcggccggtggcgccgttcacccgcacgtcgacctcatccttggtgaacccggcgatgtcgaggcggacgacgtagccggcggcggcgccgtcgagccacacctgctctcgcaggtcgccgccgatctggatcccttgggcacgcacgccaacatgatcgagctatggttggatgggttgagaacttggatggtgaga

SEQ ID NO: 75712 - DNA, 3869 bp, Oryza sativa
acaaacacaatagcctaggagatttgcttagctccagtgcatgtctaagggtttatgagatgcgggcgtgcctatcagtttgatcatgcaactgacaagatatagaaatagtagattaatgagccgatcggctggcaagccgatgaagtaagtccagccgatgccgatactagacgatagtgaaaggattttgagctatcggctatatgattgatgtagaatctgacacttgatgtaaatagagacaatcgactgatgatgatataatagaataagcaatgatccgaaggttaaagcatacatcggctggaggaccgacgtcatgaaatccaaacgattagataaacagtaaaatctttgttgcgactggctaaatccaatttgtatgtaatccttataagtcgatgcaacatccatataacttattggctgaaacccgatgaaacccttattggcaatcaaaaagcaggctagggattatggttctaaacatgacttagtagatcaaacttaactgatgcagcactaagtaagaaaatatacatctagacatgacttagtaaatcaagccctttgactgattttcagggtggtagataccttagctaatctaatctggtaaagcgatttagccgataccggcattaaccctaaagcgaatctcagccaatataagtaaatcgaactatcaaactagattaactaagatatatgatagataggtgcttatatggacaagatcagagtgttgaagccccagccccactgatgcaaacagccgtgacaagtataaaactcgttgaaaaagtagaaaagtaaaaagggtggcgatgcaccgaatttgtattgattgtggagatggtttacaatgaccctgggtggtgtacatatttatacccatgggtagatactggtccttattggacatgaaagaaactttcctaaagataaaaagaaaacataaagtccttatcggatactaaacacacttccctaaaggaaaaaggaaactaccagactattcctaattaatagataaattgccatgccgcatcctccttgaacttggtaacttctagacaaacttcttttagtagattaattttctaaaccgaatatagcaagaatctgactattggcgacttgataattctcatcggccgattccaggactccgttgacgagactgactctaggctgatgatgacttcggagcttaccaaatttcactgttaatagatcggcttcaaaatgttggttaaattagcaagatgtctagccggcgctttcagttgggccctttgttcttcaattgtccacggcaaatcggcaaacttttgcttttctgctatcatatcttgctgagtttgttccagctgagctaggaggtcatcttctttttgttcaagttcttgaatcttctgttgggttgatcttggaccagcaagcagttcatcaagtttggctttgtcttcaaggatttgttgtcgaatggcttcaacaattgtggatgttgtggttgtgatgttgcagtgttgtgatttggataatgacgtctaaacctaaaatccaccctataagtatatatattatgtaacctctgatctcaggagcgccaggactcccctcgctgctggctcgaggtagggttggtgtgcttgggtgcaatggaggttcgtagtccttctagcaggagtcgcaatgcgagagtgactgaaaagccgggctgtgacaaagcccatgtgttgggtgcgttacggagtgcgagattgaaagcatattccactgcagtgtgagtaaactaatctattcgaatagtcgtgctagcagttaatgagcaccgggaattgtagtattcttgactagactcatagatctttaatattgcttagattaggaaaggacgtgtgtgagatcttgcccgatgggtggagagatcattatgattttggaaatatggacaatttggatgcgagggtaacacgtaccaagcgagacttgggccacattggtaagccctcgatgtttaatgataattcaacacaactttgtttttattcaaaactgctaggtcatacgtttatgcaaccagaccaagccaacaatgtgcccctataattattatatgcgttaccatagtggtgacgtgctgagtatggttggtactcacccttgcaaattttacactcttttagacttagtcgatgtggagataccacatgagaacattcccgaggagggagaacccgaggagatgccttatgaactgatccccagtcgatacctgtggagtatagttggaccgtcgcagcttcgctttcgctaccatatcacgtcctttagttttcatattgtatcggactagacttggtctatttgggacccactcgggcttcccatgtaataatacgtatcgtaagactatgtgatgcagactatgttgtaccagattgttaacgaccaaatttggtaatatcagtatcggagataaagatgggatcgaagcggaatcgaagatgaggattgttgcagaaacagagtaaggatcggctggagtccggatcggctacgactgagatcggctcagcctgagttggactggttaagtgatacagccgattccagcaatacgacccgtgtacgacattgggttgagttgatgtgcttcaagataattgccacacaaggatagagtcctgggaaggcaattgtatctattaattaggatattttatgtaaattccttagagataaatatgggcaaaagtctgccgcaaagacttatggtatcttagagtttgttagagataagagtcgtgtccaatatggacatatcttgtaattctcgagtataaatagaccccgagccctatgtaatggttaacacacatgttcaatacaatttcggcgcatcaccaccttttttgttttagttttatttcgacgagttcttgctatcgggttgagctgcatcggtttcgatcttcaacaagaggtaaaacttgttatggcggcttgtgttctctcgagattagtgcttccatctttatgatactctaactttgtttatgtaatccatcaagttatcatatatcttgcataatgttcgacaatatcgtcatctaacttacaatcagctaacatctgctaccagaagacagccgattaggttaaataacgacgttggcttagactatatgagatatccaccaccctatgaaacatccagcggcttgatcgtctagatattgttcttcttttcatacttaatgttgaatcagttgagtttgatctattaagtcgtgcttagaatttcaatctctagcctgcttactggttgccgattagggtagtgtcggagtttcagccgatcttatctgatctaattgctctcgctctatatgctcaaataatatgctagatctgcccttcatgttaagatcttgtggcatttaagtatattagatctctgtttatgtcgcgaccgggaaaattgccttttcccgaacgctagtgtattaatccccgtcccaggaaaagccggggtacaccacacaaacatgatataaaagacacatctttattacatcgatagtatttacattattacaaaggcgctccaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcaacaggccacaccggagatgcataattaatgcaagggaggtgcaacggaataataatatagggattaagttttgcagta

SEQ ID NO: 75713 - DNA, 4892 bp, Oryza sativa
tgtgaaataaattaaaacagttggaaacgaggtcacaaattttgtaattttgaataactggtttcaaaagaaagttataaaatcaacatactaaatttattttattgcagcaagattaaataaaacagtattgtaaaacttttgctggtaaatgagccattagtacagtaatagatgtacagtactaataacactggaataaattttgaatgagaaccattaaaagagattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctagcagcggaaaataaataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttaataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccttcaaaaccatgtgctcacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatatctaatatctagttgaaccaatataaataaagctcaactagtcaaattaatataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcaaaaagaagcaaaatcaccaaaacagcacataaacaagaatgaacagtacatgtggatatttttaatgtgtagatctcaattttagaaaaatttagagacttgaaccaactaaatcggagctaagatgaattagttatgaatttttaaagattaaaccggattaaaacacttaaatcggtttaaaattgaattatgacgcaataatgaattatttttgaaaaggaaaaggggatttattgcgtcagcggctagggtttgggtggaccgggcgcatgggcggcggttcacgcgaacggacggccgagattgatccgatccaaatcggacggccgagattgatcgggtccacggcggttcacggcggacggccttgatgacgccagcaatgacgtcaccgacggcggcggcggctcggcgaggcagacgactcgagcggcgcacgctcaccggcgaacggcggcgctacggcacgaacggaggacaccaacgggtagcggacggcacggcgaactcaccgacgaccaaagcgacggcggacgaccaacggacggcgacggcgacgaggttgaaacggcggcggtcttcggcttgacgacggcgacgatgctccggtggtctccgacggcagcgaaagagcggacgaggacggcgacgacttggcgacgacgacggcgaccttcccgagcgacggcgacggctggaacgacggcggcgcacggctggagcggcggcggcgaaggcaaagctagggcacacggcgctagggctactccggcgacgagaggcgaaggcgagggtggcggcgagaagagaagagcacggggatccttttaaaggggctcggaggcggcggcggaggcccacggcgacggcaacggcgaaggaaactcgcggcttggagagaggaaagccgatccgattcgaactcgaatccatcgatttccaaaccgatttagccgaagtttccaaaggagaaaaggtagaggagatcccgaagatcatttcccctctatcaattcagccggaaacggaaaggagcggccggattggaaagcggcggcgacggcagctcggcggcgcgaaactagggtttcggcccgaggaggacgacgggcctgacaggtgggatgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcggcctacggctccatcttcacaggcgctcaactggggtataagccaggactccacctaagacatcttctccaaagcttctcttactgaagaggggaaggattgagcaagaatgagtacaaccacagtactcagcaagccacaccggagatgcataattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccacattttagtgttgagcaaattttaagaattagaacactgacttgggtacattgctcggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccataactggcatgcacccaaaccccaccgaaaacaggttttaggggttttgaaagagaaagagaggtgtatgtccaattccaccataatccaaccattccatggtgtccaaaagatatgagaactcccaaagtctaaaattataaaaccacctaatgttgcctaattaaattgcgaagcatctacctaaatttaaactagtggaaccataaatagagtgtccactagatggggttttgtttaatctagggtgaacaaggtaataataataacaataacaataataatatggtcgtaacaaaggtaaataggcatggctaaataaaacagtgataacgcgggaatttaaataaagcgataatgcaataatttaaatcaacataattttacaaactgggattcaatatgctcaaggatgatgtgacttgccttgctcgctttcccaaacaccggcttcaacttccacgaagagcggatcttccgaagctgcagcgtctacacgaccgacggaaaagaaaaggcttttactctaataaactccaaataacagcataaacaaagcacaaaaatgggttctttacttcttaaggaaaaattagagacttgaacggtccaattccgagttcaaacggccaagatatggccatttgaagtttatatgctctttaaatggatatttgcgaatttcttcatttaattttcaattaaaaaaatcggattattgcgtcagccgaggggcgggcgcccggaccgggtccacgggaagaggggccc

SEQ ID NO: 75714 - DNA, 649 bp, Oryza sativa
cataggctggcggtggatgcataggaggatgactactggactgttgtttggttggcaagcaagcatttggtctgtcatgtgttatgttcctcaacgatgtcaatttcaaagttttaatgcacaaattcaaacttaagtgactgaactgtcgtgttcctttcggaggttttaaacttgtcatcacttttaaaccccaatgtcaagttgatcgtttccgtgtgcagaccactgaccatttcagcgatgtgtgatcgcgagacacttgactttgctgctgctgccaatgattttgtgaagagtggtgaacgaatagtgcctttttcgaactttagctttcaaaacagaggatgttatacgtacatgaaaattcgtagtctactccgcttgacctatttggcctgatcgtagatgtctacttaaagaatttcggaataacttaagtcattaccgtttggaataaaatgtatttcgggcccccaatttgtttggaataaaatgcaattcttgccaagttgcattaaaaatacgtatacacaacttgcaaaatttacatgtagtacatattaatactagaataatttaaggtttacttgcagagacccgttaattgagcttagcacacttcgggccttattttttcgcttattgc

SEQ ID NO: 75715 - DNA, 581 bp, Oryza sativa
tgatgaggcggggggacacggaggtggagtaaagtaataatacgttttttaaagggtttctttgcaaatttccgcggacattttccgggtccacgagccaaaccggatattctgatctcaataccgacccatgtttttggtgggccttaggaaagcctgtctctagcgagcccaactttagtgggcctaaatacggttagggaggatgtgcggcccatgaaggctcggcccattatactgcaactaggccaatacgtagccattcagagtttcggacctgtggctatcgcggaagggagcggcggcgaacccagctcggtgagtcgtcgtcggcggcggcgatgacggcgccggctaggaccacgtgacgcggatcagctcggaggcagcgacgacccatctctgatctccctcacgttcagaggcgcgaccaagcgtcgagggggagcgctcgacggcgaggtacccgtgtgcagatccccttcaactctaggtcgcaacgaagcctcgacagtgttcccaaattttcttgatttttctgtcacctgctagtttgtggatctgcttgatttgtttgtcgc

SEQ ID NO: 75716 - DNA, 11907 bp, Oryza sativa
agatttaacgtggaaaaccctcccaaaacagagagaaaaaaccacgggctccagccagcaaaatatcttcgctatatctggggtgaggttacaacgctacacggcggcttacaagaagtatatatatggtggaaccctaaaggggatgacgatccgtttcgtgggggctccgccccgcacccccgagcgtccccaggtgcacggcccttcgctctactacggtagaagctgtcctttattaagtgtaaatgaatttgaatcacaactcaacatgtttgtgtgttgaatttgtttattcgaagtgttttcttttaaggtgacacaactctcgatcgatggtaagaagaaaaataggtgtttaattgacgtcgaggtttgggttagggtagggatcttggtttcgtctcgtcttccaagcctacaagctgcgtagagtagtaattacccgcgactatacgaggttagcagaggtacgttgccacctatgagaaatgtgcaagtcctctcatccgaagaaaactaagtgagtgagagtgtgagaccaacaaaatattctaagactcgatgtgtggtcatgtcgtttgggccatttactccctctgttttatattataagtcgttttgatacgttgtgcaagtcctctcatccgaagaaaaaaaccaagcgagtttaaccaactaaatattctaagactcggtgtgtggtcatgtcgtttggaccatcaatattttgtactccctttgtttccctttgcttcgtattataattcgttttgactttttccctaatcaaactttattgagtttgaccaagtttgtataaaaaaaatataaacattaattaaaacaacagattagttttattaaatctacatttagtatattttgataataagtttattttgtgttaaaaaatctattatgtttttttataaacttggtcaaacttatttaagtttgactaggaaaaaatcaaaatgactttcaatatttcgtacttttttttttacaagaagggctaagccgtagagatgtggtaaaagagttatgggtttatgaccattgaccccagtagtacactcactgaaatttacatcctagtgcccacaataatacacaagtgggtacgttttaaatagaatttcactgaatttactaaagaactttcatcacttgattcgaatttatgtgtggtgaactcactcctttctaatgttccactgtagatttgacagaatggaatgtagaaattgtacatatattgggttcttttaaattttcattgcctataataaaattggttgatatggcaagggtttgtttgaatttacatttgttgggtttcatttttcatcatctataagggaaagagtttcatatacctcccttcagtggcaaacacaggactaaattttaggaggtgccgatgaaataaagcatactaatataactagattaaatatgaggacttttacggtacattctacttaaagtatatactatcagtatatttgatctaacggtgtaaattcatctgatcttccttccaattattttacggtataaattgaatagaatatatttgtcttttaatctatttgcgtgagggttaattttgtaaattcgcgtttctaacttaatcaaatccgggcttttgcgcccagtcaaagcgaattttttttgaagcggcgcgcatgggcgaccgccgtcgctggctgcctttgcgagcacgccgcgccgcgcggccgtcgacaaccacaatcggggccgccgccatcgggaatcgattcgatttccctccccctttcttcacccaaaacctattagtttttccaaaaatccccaaatcgtcaggttgcgggaagcaagcgccgacgggctgcggaggtttgcgggaggcggaaggcgacgagcagtttgtcctcaacgggttcaccgccgcgaatctcagcttcgatgacatggcgacggtgaccccgaacgggctgctcatgttgaccaacggcacgaaccagctcaagggccacgccttcttcccggtgccgcttcagttccacagggcgcccaacagcacggcgatgcagtccttctccacggccttcgtcatcggcatcatcggcgcgttcgaggaccagggcagcggcaacctggcggcggcaggtggcagcagcagggcggcataattagcataactaatgtaattagcatggttacataccaatataactaatgtatgaacaattctgtgactactatccattcaactcccacgtttcaatcttccagagaaggccttgaaagaagaatgttcagactccaaaaccattaacatcgtttccaactttagacgatatattagagaatccaatttaatagcacaattttttggagcaatgcagtatagagttgggctgaaataaacagctgttacaagctcaaattacaaagcaaaaaaaaaaacaaccgaaggaattaatattcatccaatggaaataaatctctattttaaatgactagacaacccttttcagatttttaacaaataccaaatctaccctatcatatactggtagtatatatttacagtacaatgtatcgtaaaagttctcttaaatataagataaatctaaaaatcatacataaatatattgtaagttcctattaaaaaccttgaaaaactatctatcttttgatcatctagtttttttcctctatctagcaacaagtagtaacatgtgtgaactattggatctacatctgctttggccagctgatgggggcttgagcccacattgcctccctgctaggatcttccctttgaaaccgaaatctaatcctctaaaatttgtaataccatttatattatcccctaaagtgtttcggacatttgtatcgatgcttgtttgtaagctcaatagtacaaaagaaagataagtggaaattttaactcatgcatattatgtagtacaagtatacatgcatttcgatcgatacacacgtgagaatgatactgggtgaattgattaattaattagttgttccgggagaatagtttggtggagacgaagacgccgagtgcgaacgcggcgacggccgtggcgaccacctccttgttcttcccgatggcctccgccagcttcatcccttcctccgccgcgcgctccttccaccacgcggccgtcttctccggctccggcgccggcgccggcgcgggcctcgaggcggcctgctgcgccgccagcctcgccctcgccgcctcgatcctcctgtccgcctcccgggacagcctcgccttgtgttcggccctggccttctcctcctcatcatgacgctctcgcgccgccggctgcggcggcgccgccgcgggggctgtagccttgggcggctcctctttcttctctctagccgacagctgggtcctccgctcggactgatcactgtcagtcttcggcggcggcggcggcggcttgccggcgacgtcgtgttcgtcagccttcttggtctccttctcctcctcctgattggccttgggcggcagggcggcggcggcggcggttgtcgccggcttcttgggcacggtgaggacgagcacgctggcctccagcctgccggtgatcgcgtcgaggttgcacgtcggcggcagctggaacaccttgttcagccggaggccgccgtgctggccgcggacggtcagccggccggcggggtccacgtgcacctgtaactcctccttcttgaactcttcaaaaacaaaaaataatcaaccgagaaatcaagaaattaacagtaaaaaccaaccaagccaacgtatagatcaccatttcacctcaccattacacatgcatgttggaagaactaattaaaacagttagtaattacctgggacgttgacgcggaggagatagtgggcgccggcgtcgagccactcgtagaccggctcgaagtcgccgtcgcgctgctgctgctgctgctccgccatggcgcctagcttagcaagtgctagctagctacctttccttgcaattccaatcgaaatctcctacccggtgagatgcagctagctctgggtaattaatctgagacagatcttgagatgagatgaacaagcgatgctcgatgctgctcagctgctgccggtgatcgatcgatcgaggcagggcacgcataaatatttgcgatcacgacgcaccctggcttgtggtgcgaggtcaggtttaagattattccaagctttttcttgaggatcacatataaatttcggtcaggtttaagatgattccaagcttttcttgaggatcacagataaatttatcatcaagaattggggaaaggatagatttcgcgcggcgacgtgtccggggcgccggtgcctttcggctcgcggcacggtaccgaggttacgtcttcttcgtcgtcgtcgtctctccaaagctagctatagttaattttctttcgcgagaagctttagctagctaattaattagctatcttccagttttggatcgatcgaatgtactgtagcgatcaggtagtttatatgccacatgttcatggctagctacttcgccggttgatggatcgcgtgtgccttcgcgtgatcactctatacttgatagtgtaatggcgatggatatatggtttcaactctaatgtctcgtgtttaattctctaacatgctcacaactttttgtaattatttgataaccaagttcctctttgattgtctttttttatgactgatcactgtttatttctgaagtaaactgaaactttcagtccatatgcccgtgtttttttttcttaatcaaactggataggctgaaaagcggatatgtaggcttgatccaagcccagttgcccactgaatacatagtccggctgtgtttagttcacattgaagtttgtaagtttggttgaaatttgtacgatatgatagaaaaattgtgtgtgtatgaaaggtttgatgtaatggaaagttggaagtttgaaaaagaactttggaactaaacagggcctccatcctgtccagagtccagcagactcatccttggcccaatccaggtccagcctagctgcgatcacttcgagtaaccaaacttgtgatgaaatgctgaaagtcacgtttggaacgtcgcccacgttagccttgccaaaatattaacaagacaaagttttgggacaaaattccttatacgtccctccactttgcgttctaaatcatgctctatatgtctctgatttttttcatttttatatcccatctatgctcgtccctttagttgaccgatcggcttcttctaaaacaactatgttacctttctcatacatacttatgtgctacctacttaaaaaaacatggatctcagtgttaaaaaatatagtaaaatcaaacgggacaaaaaaatatatatatttgtcacaattttaaaaaaaaattaaaaaatttcatgaaattcatacaaaattttcaccaaaatttgaaaccccaagttttatttggatttgattttcaataagaatgttatggatttcatcaaatttgatttaaatttcatttaaaaaaatgtaagttctagttttcaaatttgtagtcaaataattctaccatcttttttatatgaatacttttcacattgagaattatatttcttagagtgcataagtacgaaagaggcaacatagtcattttggaaatatgtaatggtaagtcatctaatgaaatgggtgtataagggatcaaaatcaaaactcaatggcgtataagggatcgggcaaaattcaaggacataaaagggacggatagaaaactgaggcacataagaaattttcttggtttggtgttgccaaatttgtggttagaacttagaagttttgcaattaatcaaatagatctattgggaatatttttgtgttgtttgttagggcaacaacccaaatatgcccaaagtgtcctattgttttgcattcttttttctccaatttgtttatcaagtggtttgctacgaattacaatgttgtaaatgcgtatgatccttcatctgctgttcttcgctcacagtttgtcatatttgaacttggaaggtttgcatgtcttctttttttatggtcaaaaaagaacagatgaaaaactatgcatggccgtcaatggcttgggattggatgaggactaacaacaggcaatagtccagggcttcttggcttcatgatttctctaataagctattgcatattgtgagccttgtctctgttcatgatgtctctaatgttatccatggttgagacttattaaccattaacaaatgtatgtagctgcctggctgcttgtggcagtaaagtcatttcttcaccttattaactgtcactgcttcctcagttgctatcagttatgagttatacttcatctgaattacgtgggaactaatcaacttgtaattggaatcttggcaaattgttctccttgtcattgacattaatgtttcatactttcatataggggattttcccgtgcaatttttacacggactagttaaattggatttgcatttggaatacaactcttaggtcctatttccatagataaattctctaaattctcatatgtgcaattatattttgcatacagtaaaatatttaaaatagggttggatttaatatacaactctttcttatatttatattatatatatatcataaatataatttattttgtatacaactatttatattaatctacatcgttataatttgatccaaccacattctaatggttagattttgtctcttcacttaatgataatttctaggtctctataacgagaacatggtgtgtccttttcgagctatctttataatatactaattgatagatagatttatttctttcagataaaaatcagaggcgacatgtcagaaatttgtcgttctagtagtacaaagaacaagtacatggaggacctagcagcttgcatgcacagggtcttggcatctcgtcagcccgaaatgatcgtccatgtctggttgtgtgcatggatgaatttcttagagccgaccataggtccatagtcgcaattggctcatgtttttatatcccactacattctggtgttttgcaatccttaatggcatcaaggacacactaggtttgtaagttagttcgtcaggaaacaaaataattagtgcctcctgatgacatagttagtctgtttctggataatcatggagaaggatatagtagtatacagatcaagttgtctttactccttagggaaaaatatcttggcatctatttaagcagatgtgtgctcaattcttctgcacagccttaagccattccagttccagtgttagtactattccgatagaggttagctctggattcattcatgtcacatagcctactttgcctttcttcttcttcttgtgcttgtgtcaccataatctagctcacttagtcacttgagcatgctaccatcatgttatttgccctgtacaattgatcacatttttttcttcaggggattgtgttttaaatcatcttgtagcttgaaattgagaactaaatgttttatagtctagcaggtaatgagttgttcagtcagcgaatcaatgtctactactctatttggttggtggattgccaaaaaaaaagtgaggttagaatgatatgcaggtaaaattagccaaaaagtaagtctatgacatgtgggccacaagaataaaaaagagaggggagaccggtttgtgatagtgaactaaacatttttctgtagaaatttgccaggatttaggttggcactgttagtcacgtgatgatgtgccatctctggctaatagtatcttgattttttttctgaaatgtttggttctagtaattcaagcctgttattaaacactaaccgatgcagttctaggcaaaattaaaactgcacaacagaacaagttgttcttcacgcagaatgtcacaaacctcatttttcagtagtttttttttaattggtggttctagaggttttgaggttcgtataggagtaccccatccttttaaatttgatgaaaattttgatgaaataaatgtaaatttaatattatgaaatttcaaagtatgaggtaggaccatctaacgaaaatttcttccgccactggttttttttcaaagtcttttatatcagtctccctgccctgaaccacgattacagaagagaaaaataaggaaaggaaagagaaggcatgggcaacctgttgtgctgcgtggaggtggaggagtcgacggtggcgatgcgggagcggtttggtaagttcgacggcgtcatggagcctggctgccacttcgtgccctggtttcttggcctccaggcccgcggccccctctccctccgcctccgtcagctcgagatccgctgcccgaccaagaccaaggtcacttcacctcaaatcactaaaaaaattacactttcctacgcaccagagtttaaatcctgatgtctacaagacgacacatataactgtgtgtattattagttgagttagagaccgtaagttattacttttattgtgaaaaatgaagtcacctactcatctcgtgttttttccctctttctgcaggacaatgtgtatgtaactattgttacgtgtgttcagtaccgtgctctagccgacaaagcgagccatgcgttctacacgctcatcaacaccaggtcacagatccaggctcacgtcttcgatggtaattactttcttaattgttactatggtgattttcgtttatagtaaagatgaaaataaaataaaattatggtggataaagacaaagttaagacacgaaaaataaaaaaattaacatatgattaattaagttttaattattacaaactaaaaaatgaagttatctaatattttaaagcaacgtgtgtatatataaagttttcacatcagttataccgttttaccgtttagcagtgttaaaattgagaaaaaaatctatatcttactcggaaaagacagttaagcatgtactaaaaagataataactgtgaggcatgcagtgctgaggacgagcataccgaagctggcgctggaggaggtgttcgacaagaagaaggagatcgcggaggcgctggaggaggaggtggcggaggccatggcgccgtacggctacgaggtgatgcgcgcgctcgtcgtggacgtggagcccgaggaggccgtgaggcgcgccatgggcgagagccgcgccgcggccgacagggcggtggcggagcgggcggcgcgcgccgggcgcgccgaggccgacgccgaggccgcgcgcctcgccggcgtcggcgccgcgcgccaccgccaggccgtcgtcgacgggctcagggcctgcgtcgtcgcgttctgcgccgccgtcccgggcgccacgcccagggaggtcatggacatggtgctcgtcgcgcagtacttggacaccgtgagggagatcgccgccgcgtccgcgtccgggtgctcggcggcggcggcggtgccgttcctcccgcacggccccgccgcggcgcgcgacgccgtggcgcagatacgcgacgggctgctccaggccgtgcagcctcctgccgccgccgccgccgcaagcgtcgccgccgttggccttccattgccattgccagtcgccagcgtttgcgaaggtatcacagaagagcagtagttgagttgagttgggttgccttactgtgtcagtgtgtaataatgccaatggttactgcaaatctagctactatatatgctgtgtcttggatgtgttgtgtacaagtgatctggatcaagaaaagtgtcatgcagtgcttctcttgttctttttgcaattgaattgcttctgcaaggatgccagaacttaatgatacacattgagcatgtgtggagcacacgaactaagcagaaacatccctatttccctttggagagactaagcaaaatccatgttccaggttttactgaatcttcctttcatttccatcaactccccaagcatgggaacaagatttatatcatgcataacagtatataccacattaagctctccaagatgtcaattacgacactacgtaagcatacaacgaaaggatttacataccagaattcagatggaaatccaaccgtatgatggaaaaccagatcaacgaattcaacaaagatgtggaacacagagatatctccatcatatttgacagtattcagcaataggtctcaaatcacccaaaattattaacaacaggcgccgaggataaaaatatatagccaatgctaatgtttgcctagggtaatggtggggaaagaactcaagatcaaaatgaagccacaatggtagctgtggccatgttttttccatgttattccaatccacaagaactgaagaaaaattcctaggatgcaaaacatactcaatgcttgagcaccaaggacaagccaactttcgtgctcttctcaattgccttggtgtcaacctcaccagagatggtgattagcgatttgggacgccattcatgctggacgagcgcgctggccatgccatagttgttgaagcgagccttcactgtcgtgtgagggtccaatgagtgctgggacccaaagatcagtgtgctctcattccttgagaagctgtgggacagctcagctcctacggcagtgttcgaatggtgctttaccaggtggtagtaggatgcaatcaaggtatcaccatgattgttcctggacaggaattgtaaggtcagttaccaaactaaataaactgatacaggagtaatgaccacaacaaccagtaaacaagaaatgttattctggaattggcttctcagtcagacttggaagtaacatgcagtgctaatatatgataaccatgcatagaatcaatacttacagatgcagagaagcaataaggtctgaattggttagactcaatgcagcattgtacttggtgaaattgctagtcgcagtgtcgaatgcaacatcaacaccaactgagagctctttgcttccaaagacaccagaaaggttaaccataggattggaattcaggccaacacttgcattgatgccagcatattcatgaaggtactggagttcaagctgttaaggcagccaaaaaataatattaattgcaatgcctgtcatattggatgttttaaaaaaaaagaaatggagggctgcccaaaaataccttccctgacctctggtctggaactaccaaactaagaattgatttcaaccctggagttccaaactcatcaaccgtgactgttgttaaaagctgaaagatacaaaaaatcatcaactcatgattatgcaggaaaaactacagtattaccatgaacattatgcgtgtgcaggaaaaagagaactgaatgcttacatcggactctgagtttgctttgacatcaacagtcaatttcttgttcttaagctgggtttggagctcaccaaagacagactcatttttccttgttcctgcagctgtgatagtctgcagtacaaacaaaaatcattaacatagaaagcacaaatcaaatgcgcagacatgctgaaccgcaattgtactgaattgctgataacatatcaatctcctcggtaaacaattcataaccacagaccatatgtgctattgttgcatggaaggtgccaattgcacttaataatagatttcacagtcgcaatgtgacggcaataaatctatgatcttatcccccaagagacattttacagtgcttggaaggttttgaaggtacctccacttttaaaagaaatatcaggtgttgttcacttaaaagtggaggtgcccctatgtattatagactagtagtgcgcaagcatctataaagtggacatctcatcccatcaacatacatcatctgatcttaaatatgcacgtatgtagatcctaaa

SEQ ID NO: 75717 - DNA, 24318 bp, Oryza sativa
ttcctgcagccccatccttataaacatgtgccaaactgcgcggtaggttggaagtacagatatagtgacagctgacagacagagacaaaacaaagttagaacatctaaaataaagtgcagacacacctttcattagagatttagagtattgaacttcttttcccgatctgtcagccaccatcacattctgctgattcagataacaccgtttttcagttaacaaaccgtcatgtaatcttgaattaacaaaaaatgataaccttggtaatacctaatggacacaaatagatggcaacacatttatgatgtgggtgttaacaataatatataatttttcagtctgaacaatgtcttagtggacaaaactgaaatgaagcaagaagtggagaagtaagagcaagaagtggaggaatgtaatgcctgactacataagtttaagtggcctatcacaagcattaaataaattacactttcatgtaaaaccatatgtttagttgtttaaaattgtgaaacagcttcatagttagtttcataatgggccataactttgatccaaattaagacacaaccaagaacacatatagtgaaatcagaaaaggacagtccgatttggttgcagtacctctccgccaattttgctagccgagataatggacatgaaggtgctacagctccatcattccttcttttatataaaagcagtacaaatgaggcatgccacaaatcatcttttattaacatttctgaggattatacagaaataaaattcatagacaatttttagataagtaaataattgtcattatcgaaagcatcaatatatgggatatggaagtatgcatggcattgcgtgcgtaacaatcacatatttatgcagacattttgatagaataaaacataactttctttttttttaggaatacataactttcattcttcaggggcaagcaaataggcagggtccctcaatcaggaaataaataaataaataaactctaactgtgaattgggggaaaagaatcacaagcttttctaacaataaaaaaaactcttaactgtgaattgggggaaagaatcacaagcttttctaacatcagcttctaatttgtattccaaatcacaaaaatgaagggaagtatctgtcctagaagaaaagcaagaataaaacaactaaccctaaccacccccaaaccctaggtaaatgcaagaataacaaaaggtatatggtttatgtttgcaacttcaccctctcttcttccctccatgttggtatcctcggtgaacctttgaaaataaaacctgcaaaggtgaaaaccaaccaatcaattttagccaaaaaaaagaaagaaaaaaacaggaaggagtagagcaaggcgccgacaccgttttatcttttcaatctctttagtttttcacttttttgttgtcacggagatgccaacactgtcttctccttccattgccaatagagccacaacacaacaatcattgaagccattccaagaatgggcagatacagagccaagtttcagtttcactccacaaaaaacagacaatatacatgtgaatcaagatataccgtggatgagtcgacgtgtggggatggcggatctgtgggtacaggctagggacaccctccatttggaaccggccctcactctcatcgcatgttcttcttccctgcggaggcgatggacaacacaaaatagatgaggataaacaaagacgacgacctgaaggagagaggggactgacctgaggtgacgaccagcaagcggccaaaagctccactggatttgtaccgccttctaggtttggagcctgcgacaaaagcgaggttgagcgaagaacggatcggtgacaaggggcgagctcgagagctggcaacgtacggctctcctcttctcgctacagcacccgccttccttgacgtcggttctggcaacggagggcagagcagcggccgttggcgaaggcagcgaaggacgcagcggcggcgctcggtgatggcggcagtagtggaggacggtgctacggcagtgctcggcaacagcagcagcagcggagcgaggcggaggcggcagcgacggcgctcggcgacggcgacagcggtggcggaggcagagacggctgcactcggtgacggtaacagcgcgaggggggaggcggaggcgcccaaagacggcgacgtgatggcggcggcggaggaggtggaggcggcgcgagggggagaggcggaggtggccggcgacggggacggctggaagcggaggtggcagcgcgatgggtcggcggcgacagcgctcggcagcggcggcgggggtcgaggcggtggcacgagggggagccgagacggtggcgcgggggggagccgagacggtggcgcgaggtggcagcgcgggagagggagcgggcagagggagagggagcgggcggcggcgggcatggtagaggttaggcaccggcggagggggaagcacaggcagggtggaggtcaggcggtggcgaagaagcgcgggtgggtggagagcaagcgccggcggagaggcgcagacgccggcgaagaggagcgaacggggtggagtgcgcggccgacggtttgttcaggagaaggattaggagtcgacgacggggtgcaagcgctaatccatgtgttaatccaactcacgatgtggatcgttggatgagaggatccaacggttaagaaacttctagctatacattttttggtggatgaaggaaaaaagcaatcaagcaaatagttatatgcctcatccatacattattcaatcacccaaaattctagcatcattgcacaaaacaacaagcttatgcaattttgtagatttagctagtcggctaggtactcttccaatgattatacctaatggatgcattactaattgacccagaagacaaatgttcagacgctgatgcaagtaaggtaaataacatttctctaactcaagtcataacttcatttaagccaatgtaacatataagcaattgaagcatatcacatattttcaatcaaaaacaattataggaattcagcaatttgctacctcttcacttaggaaggaaaacattacttgctcatttaaaagcagaatagctattcaaaaggcatcacagcaaaagcaaaagcttaacccaccatttgattgcattcttcaacaactattgtcaacaattgtgttagcttatatagattgattattgcttttgctatacagatatattaggctaaaaaatgtactaataaccactaattagaaaaaaaatgttggtacttgttattggtatgaaaaattataggttagggattacattttttcacattgtataagcatggaaaggaataaaaaaaataatgatgctttgctttttttcagcagaagaagatagtctgacaaatatcttaaacaaaattatgttaacggtaaagggaaaagtgtgaatcattgacaactttcttaatagaccaggcattgtaaagcaaacaataagatgcaagtaggtgaatacgggatcccaagattaaatgtcctttcaaaagaatttacatgggttaagtggcagaataattcatttcttaccattgaacccagtgaaatggacaggctagcaagacaaagaaggaatatagcttctgagaagtaattgaatggaaataagcatcacagacaatagagaagttttattgactattgtaacatcctgaaaattcccaacaataaaaatcactaaaatttcgaactttttaaaacttttgcatcatgctggttgttatgattgctattgcttgccaaaccgtaaatgatcacaaagaaagtaaagaaaagatctacatttaagcaatagatataatttatgagaatatgttatttattattaaccctacaaatattagtgcacaagaaagcaagccaaatcaagtataagtcaaatattaatttctattataaatcatggatcaaatattaaatatttgaaccatgctgatggcttgatgccatgattagctaaaagaaatagtaaaatcgaatctaattgatttgaatccaatctcacatgaaatataagaacacatgaaatgatgatcaccactataatgatcgtgtttataaataagtaattcaccagcatatatagattgatacttagaacattttaccgagttcctcatgacatgaacatcagtcatataaaataatagccatataaataaattaagctatatatatatatatataagaatatgtgagtgtataattgaacaattagattaatgttgtaccgagtctcaatctatatttatagaatgaatagacccacgtaaaatgcattgttatacaaataagttcattcaatgtgctattgtaataataatggccacaataggatattttaattaattttagagccctcaaagcctccaaaattatctaggttaattttagaattagacctcatttaaataatgcaatagaaaaatatatatatatatatataaaagaaataaaatatgggtaatattaaaatttggtacactttcatctaaattaaaacatatattaggtaaactccatttgtatgaaatctagaatttatgggacaagttttaataggaaataggccccaaaattggataaatagaaaaaagtcactgttcattagcccctaggtgttcgatttggttcctagccatcctagctctcttcctcctctgccataccgcgcctagccgtcctcgcgccccgcgccgccacgggctgtcaccgtcgccgtcgcctcgctccgccgctgtcgccgcgcgccgtcgcgccgtctctcaccccgcgccgccatcgccgtcgcgttccgtcgccgctcccgcgccgcgcgctgtcgccgtccatcgccgcgcccctgtcccgtcgggcccgcgcccctgccccgccgcgcgcctatcacgccgccgtcgcgtcgcccgtcgcgttgccaacgccgcgcgccgcgagccatcgccgtcagcctcgcgccccgagccgccgtgcgcccgtcgctgccgccacacgccgctcgcctgtcgccgtcccgcccgtcgcgtcgccgctccgagccccgcgccgtcgcgtcgccgcgcgtcaccgtcgcctcactctccgcgcgccgcgccgtcccatcgccatcagaccgaccacccctccccgcgcctatataaacccctctccggctgcccattgcttcccacactaccctcaccacctcccctccctttcccctctctttcccatccccggcgtcgccgcctctttggaagccaccaagccgccgctgagccgacgcgccccgccgccgcgctgcgcctcgtcgtcgcgtcgtgctccgacgtcgaccccgccgccgcgtctccgtcgaccccgccgccggtcaggtgagcctcccctttccccaccgcttgtcgtcgcgccgcgccgcccgccggttctagccgagccgtgagagagagagagaggagaaaacagagaagagagagagaaaagagaatggaggagagaggttagagtgagccccacgtgattagtaaatagtaatcctccccttgatctttattagttaagtcccttacatgtggggtccctatgattaaaatctatgaaaattcacttatatatatatgtatgttgtgtccatggcaggccggtcccacgggtcagtcaatgtaaattatggaataaaaataaatgaattaggaacagtactgtttcgcaattattcaaatttgaatctttacactagcataacttattcattttaactccgatttgaatgaaacttgatcctaaattcatctaaattcataagctttccaatggtatataattcattatttaataaaatatatttataattattaaacaattaatatcaagatgatgcatagtagtcaacttaaaaatgtgctaataaatagatttgataatgtacaatagagtagatgtaataatataggcctttaacatgttttgtcactgtagcaaccacataaattaattataatcattgtttcaaattaattaaagcataggaaatgctagtgccatttattaatacatgaccacatataattatacccataacgtccaaactatatataaataatgtttagcctcatattttgtgactaaaatatgaacacatgttgatgagtctttaacttgtttatgagaaataataccagagcttgtatgattaaaccaccaatatgaaattaattaacgatatttccaatacagtagtatatgtttaggttggaaatcgacccttaagttgtataggcagtaactcactcataaatccacttaaaatcacatgtactatatagcttaaagtaaatagcagctattcaaataaataattcaatattaagatattgtgcactaatattgtgcactcacatatactatacaatccattatagctatacgttgtaatattaaatcgcttgattgcatattttaaaattaaggaggatatatgacaaacatgtatagtggataaatactaattataaatcttggcctcgtataactatagttcaattgtaaattaggattattcattgtaaaattatgtgatgggataatctgtaaccataatatgattaacctaaacaactctaacatacaaagcatggataattattaaccttttataatttattgtgacaagtaaaatatgttcataattaaagtaaagcctccatcaattaaataataatacaaatgattcattatttgattgatcctaaatccatctaacaacagaacctctggtatgtaaccgtgctatttagatagatgcatatatagccataatccttccatagccatttgatagactaaaccaccgattagccaaatatatatgtatcccataaatgctatgttggttaactcctaaatagaccacgatgacaatagaaagattaagaaactttagcctttagcatgattgggatccgttagcaaacacgaatggtatattttgttgtgcatatttgattgttgtttgaatattggtttttctcgcgtattatagaccttgtgtatcggttagtcgtgaggcaacatctgcaacttccaggaggtgaaggttgatcaagattatatcaataataaggattatcctgagcaggcaagtcatcactattccttgaacatgttgatcccaattacgaaattattttatttataaataagattgcatgcaatgatgaacatactatttgtgaatatgccatgccttgattattgtttacccttattcccttgtaaccatgattacgtatgagtccctagccaactatgacaaatgcttagaaatgctactctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggagaatttaggtggtatccggaaaaggctagcaccgtccccggtcaattaaggaccgagccatgaagttaagcatgaaacgacccccgtacaaccgcacttctcgtatgggtatagacctagtggaatagatagctgagcggaggcagtatccatgcatagtggtttcttgatgtgtgaggtaggggctctacggtggggcagccattggtagaaccgcgaggcgggtgtctacagtggtgtcgccatcggtaggactgccatgtgagaatttaaacatagttataacttaatgcatgtgtgagtctttccttcccgggtgcgccagaactcctctcactgctagaaaccgtgtacgcgtagagtgcatgaggatgtaaagttcatggagcgggtactgccaatgcgaggttatcgaaatgctttgctgtgacgcgtctcatgtgttgggatgaggctcatgtgttgggcagtcgcggagtgtgggtaaagtatacatccactgcagtgtgagcaaaccaaatctattcgaatagctgtgctcgcgatgattgagcaccgggacgtgtattacacttggttagactctaaattcttaacttgtgtgggatgagatattgcatgatgatttttatgctgttggagccacttcctgagagacgggaaggtggacgtcctcagaaaaccatgacgactcaatggcgggaagctatccttgggatcacaatggatggtggacagaaccgtcgttgtttaatgtgaacactggtattaaaatttgatcagtctatgctaggtcttaggcttgtgaaaagatttgcaaaacttgctttgtgcaaaggaacctgaagccattccttgaaataccctctatcatatgcatcgttgctgtggtggcttgctgagtacagttggtactcactcttgctatttatatatcttttaggagagtgttgaagagaagtccttgttagtacgcttgcgtacctgacaagatgatcggagtgcagtcttgttctaggtctcgttcccaagtcggctgcctgtggcatgtcaaccgggcccttatattattttgtcttccgctgttgttctctgatagttgttggcctacatagccctaatgtaagtatttaactcttttagcctgaattcattcgtgatatgttgtgatccaactatgtatgtgtgtaccaactactgattcatggattggtacggataaacacagaagatttccgatttccaaaatcgggggtctacaactatttttgcagtaacagaatattttcatatcaggaaccttgtgccactattctctgtagtaaagaactgaaatctaaaggtatagtacaacaagatgtaaacttagctcaatctatctccctatacacactaaaagtgttgttttctcattttagattaaaaatgacatgccattttatttcttcaaaccacactgattactttcctaagtgggaaagatatcatgcttaccttagcagggtgattggagatatgacattggtacgcatctaagcaagagctccttttgtgacaatcaagaaaaagcttccacatctaagagattttcatttattgtactccctccatcccaaaaatcatttggttacagggagctattgctcttttatgtttggtatataatgttagagatgcatgtggccattattgctatgcttaatggactattataaatagagataacaaagcttagatagatgcctaagatttcaattcgatctaatcccactacgccagatcctcacacctgtgacggcatatctgtgacgggcttaagtgttggtcaatgatgagggtcacctttgacgggttctgcgggatgccgtcatcggtgagccatccggcgacgacccgtcacaagtaactagtcacctgtgacggtccaaaaatagaacccgtcaaaagtgaggtaaagtcacctctgacgggccaaaaatatttagcccgtcacagataactagtcacctgtgacggtccaaaaatagaacccgtcaaaggtgagctaaagtaacctgtgacaggtcaaattttgtgtgcccgtcaaagatcacaaaaaaaaaattcactctcctcacccttatcctcttcttctccctactgctgagtccatccttatcctcttcttctttctccctcccttctctttctctccttccgggcgcctcccccacagcagcgagagatcgagcgatgagagttgggcaacgaggcagccgcaggccgctcgtcgccgccggatggcgccctccctcctcgcagccgcagccccagatggcgccctccctcctcgacgccgcctcgcccttcctcctctacggcgccgccgccgccggtggcagcagcaggctgctcgccgccgccaccaccggtcaccgtgccgcctcctctctccgcgtcagcgccctcaagtactgccggatctacaagccctaccaccggatctagaagccccggagctccggtcgctgcctccttcaccctccgccccaggtcgccggtcgcctcatctccaccatctcgagctcctgggcatcagatccggtctctatgtggttggggaccaccggatctggtcacccccatgctccggccaccgccttcttcgtctactccgccgccatcgtctcttcgtctactccgccaccgagctcgggtcgccgtcgcctccatccacgtagtgctgaccgccgtttcttcgtcttctccgcgcccaagctgatggcaggtggaggcccattgttctgttcatgatggacgattatgcttgccttccttgtgttgttcatgttgctactgtgattgatgattctgcttcttgttgcgattgtgattcctgtgatttgtaattgggacaaatgtaatggagacgagaagaattgcgatgatttttttgatttgtgaatgccagatgtgatttgtgattgtccaaatgaatttgatggtaacctaggaggatggtgtttttttttcttttttccccacttttcacaccagtgacggctcctaattttgaccagtgacatgttaaaatatatacccgtcaaagatggcttttacctgtgacgggttttggttgagaccggtcagagatgactctcaccagtgacgggttttagttgggagccgtttgaggtgactcttacctctgacgggtcttcacccgtcataggtgaatcgaagtcatcagtgaccactaatctctgaccagggctaaacccgtcaaaggtgagggtttaggcccgttagaggtgacttgatccggtgtagtgtccataggaattctcatgcgttgtcaacaaaggtagttaaataggccatatatgcaagtcgcttaaccgaattatccaactactataattacagataagttatgaaaaaaccataggattcaaatcctccgtatttcctatattccaaaagagataggaaatgaaaactctactttaatcagaatgaatttgcctaccaatagaattgaaatgaactcatagtatgtagaattgaaatggttgggtagtcttacattgatacttatatagaaaaaatgcactaagtctattcctctataaaactaaactaatgtagacaattctctatatacagaaggcatgggtagattgcatgttcatttgctcctgaaactgttgacagttactttcgctacttacatgtactatgaaaggcagtttattatttatgcaagatatatgagttctaaaacaaatctatcgtactactccatgaattttatccatctaagagttttatccttgacgacaccgagaatgcataggtgttctgtatacaagattagaacttccttgataacaacaagaacatgtgagtagattgaacaatatgtcgctaggctgctagcaagggagccagtctaatgcctttatttttacacaaaccattaaaacttgcatcagtctaatacctaatttactttgtctgaaaagattattataacaaaataataatacaaatccatcacccaataaatttatgtatgcaaaactatgtgttacacattttcaaaaaaagggacgaaaattaagattcatcacaatcctaaattaactataacacatgttttcacaactgaacttatcacactttaaaaaatgtgagcctagttcagaatttagaacctcaagctgcagttagaaatatagagaaaatgtttagactaaaaagtgctactccctccatcccaaaatataagaacttttagccctcaagatttgtcccacaatataacaatttctccaccaacattctcttcccaaccaatcacatccctccactattctcttgttgcactgatcttcctgacggattgccttgtctaccagcttctcaaagttagcataatccctagagatcagctggttggtcagttcatcattaaggccagaaagaaacttctccttccgcttggcatcagtacgcacatccttcagagcatagcgcgcgaggcggttgaactcatgcaggtattctgtcattgtcctgctgccttggttaagtgctcggaactccctcttcttctgtgccactatcccgtcaggaacctgagctttcctaaagctacaacagaattccgcccaagtgacttctgttccgactagacgggtaaccaagtagttatcccaccaagaagaagcatgaccctatagctagtgagtggcaaaggcaaccttctcttggtcattgcactacagaaggttgagctttttctcaatggcatgaagccagtcatttgcctccattgggtcggtggtgcttgagaaagtaggtggcctgatgctacaaaactactgtggcttgtattgaggaggaccacactgttggttctgctcaactgcgtctgctattgcatctattgatgcacctgctgcatcatcatagtcatcatctgcgtctggttggccagcacttgagcgatagttggattctccagtggtggaggtgggccgttgcctggcacaccattgacatgagcagtctgttcctcactattgctgccatctcctgctacacgactgccagtcctagtgttgaccatctgaaggggtaacaggcaagaaggggatataaaaaaagaaaaacaaactgcttagaaactaagctttgttacattataattaaactgcaattgttcttatctgacttaaaacacttaaaagacagcaaccaagtccttattaagatagccataccatatgcacatggtatcgacaaccaactaaccctcaagcgaacaggcctaaacacggaaactaacaagcaaacgaactgcgcaaagagctaaacaaaagggtaacgagctaagcaaagaggtaaactaaagggtaacgagcttaatgctcggagcggctcttgcggttggtggagtcgtagccagtcttttgctcgtctcccagctcctctaagcgactcctggagtccatcaggttggtgttgccattggctgcctctgaactagagttgttgttgccactgggtgtagaaggtaaccatctactgctgccactagctacgcctcggaaagctgaggctagagcgaaggtgagaactggcgctggagtggaggctgaagctggtgcaagagcgggtgcgggtgcaggagctgcaactggcgaagatgaaggagctggagctggagctggagctggtgctggtgctgggactactggaggtggtggaggtgggtgcaccagtagaatgcaaactggagctgtgtgttaactgcagaatttagagataaactcaaagtcaaagaacaaatcgaggaagatttggagggagatggaattattcccaaatttcgggtgcgcatcgactggaaccatatcgggtagaaacggagtcgaactaggttgagcccatatagggtgacatgagccgatacgggtatggctgagcttgcaccaggcctagattggattacaagacattgccgtgcgaggaaagagtccattataagcaattatttctattaattaggtatattaatgtgggtttcttaaagatttggcaagagtctgccataaggacttgtttgtattttttttgtaatttaggaaagctttgagtcatgtccataatggacaagtttttactatgggtataaatatgtgcccataaccatgtaaaagacaacaatcgttcaatacaatcttggcgctttgccagcttttcttttagttcttttcgacgagttctttgctttgggttagggcatcgatttcgatctactgacaagaggtaatgcttgtctcagagatttgtattattaaggttattatgtcgctttagatattttaatcttactaatataatcattgtttatcatatatatcttagttaatctatgtcaatagttcattttatatgtatcggctagttcttttctagggttttgccggtatcggttaagttgtttttgttaaatagattaactaaggtatcctgaaaatcagccaatgacttgattgtctagatatattgcttcttttcatacttaatgctgcatcagttaagtttgatctattaatatgtgatttgaatatctagctcagcatgctttttgattgccaataagggtagaatcggggtctcagccgatcttacctaatatagatgttttaatatgtttagttaatctaatcatgctttacatgttatatctatcctttatatatatgtatcacttaagataaatatactggggcaactgtgttcttacccctactttgtattctaattgtgattttaccctttttttagggtttgcatttttgccattacttttttcaaacgaagcttcagtttacccatattctgttaacatcaggtaactgtgtcaattcactcataaaaagacatgtatacccttgaacatttgtccaacttcttttagaattttgatagcattttcacacaattggcacggttgcagaacatcagcacaaagattcatcacaaattcgtcgcaagtcacaaatactatgagatggggaaaataaaaggaaaatcaagcagcaaacgacatggcattgtttgtatttgtggacgagctgcttgtcgtgtgtcgctattgccggcttgccgcaccatgctgctcgctgctcgcttgcccgtgcgttgtgcaggagctgcctcgccacagccttcgccgccgccttcccgtggcgctgcgccagattcactgccttcctgtacgctgcgccatcccgctgccaagcttccctgctcgctggcttgctggtcgacagagccgccgctcctctccgctgcgcgctggctgcggggccgctggccgccgcgcctccctgtgcgtgcacccgcggggccgccacgctgctccaccctgcgcgcgctgttggtatttcttaacgtcattactaaaaatataattcccagcaatggcgcagaaatactcctggtatattacggttacagagttcatccgcaagcgcacggatataccattgtagcatctcacccaagagtattccaagggtatcgtatttattttattccgtgggaagatcatgtagagagaactcaactaataagttatatattatttatgataatcatattctaagcaagggttaagataatccaagagtagagtgacacacaagcattactactcattctcataataaatcatctaagctaagtggaaagaaaagagagaaaatctattcctatacttctaatatacatagtatacatacattctagttaactgatatactagctaataccccctatccgatgccctcctggtacttcgagaagccactcctaactgccgagttccttacgacagcccatcatgaccatacaaccggggctaaatacggaggaataccctccccagggaattaacataggattatatatcggcgcggaggaatacccgtactgagctgtcaccatcagtggtccacctctcatccgcaatatataaccccaaataatgatatcccataatctaaacactatgcctaaactaccatatactactctaatatcattgtcatgacatagagcaattgcataagcaaacattatacccgcaccaaagcatctcccagataagctagccgtatattcaatataacatgaacataatgtaaattaggtactcatatactcagaaagtatttcaataccataaatatatttagaagagtattctaataaaagtacaaagcttacaaaagaggaaaggaaagctactagagccatacccgagctcttccgaaggcttccggactcctgatttctactctattcctattccactagctagatactactaaactaaacttgagagaaatgagagagctattgcttgaggagtgtgagtgaagtgagaaggtgaagtccttttataactgaactatgacggttgtgacggttggaatggtcggtaatacgtaccctccaaccgtcattggggtttcatctcaaccgtccagccaaaacctggattcaacgaaggcgagggaggttcggccaccgaacctggggccggcccaatccagcccaatttcggttggcggccttctccgttattcttctccgcagacttgtgaattttggcccaattcatcgtgtcaattctgagttcttggcccattcatacacaagtctggttctcgacatcgtctaattgatttatcgtctgagttgatgttgattctcctccactttagtgtctatctaagtattgttctatcggctatgatataaacacatctaatctctaaagatggtcaatctgatttatatacaatccatattgtctctataagtttgatctataccttttgtctatgattcaaaaaagattgacttcgagattagatgattgtttgcctctacagccgatacatcatacttagggtttacttgtattattttaacatcacacctaacagtcgatcctgtttaattgcatcggctagtttaaagacaatacgtcatcaactttctagccgatcggctatcgtttgtggttctaactgtccgctcaatggcgagctcccacactaggttcacttggaggttcacgacattcctaccgttctacccaacatggtggtgaaaacaataggaggcaccttcaagcatgcttgtcagagggccgcttacatgatgatggccaggataagggagctgcacgaccataacctccacaacactgcttaccactaccaccctggtcatggcagttttgctgacgtcagcaccttcaagtcaccgtctgaggagaacgacacagttgacgaaaaatccgcgcttggccaatggttccggaactgtgttggcgcgaaataagtcgacgaacacaacgacctgggagattttcttagctccaatgtaggtctaaaggttgatgagatgcgggcaggcctttgctcctgcaagtgacaagatatacaaataaaaaatcaatgagccgattggccgacaagccgatggagtaattccaaccgattccgataccagccgatagcgatagggttttgagctattggctatatgcttgatgtagagtctgaaacttgatgtaaataatgatataaagacaatcggctgatgatgataaataaaatataatccagtagaaaccaatcggctaacaatgatatgatagaataagcaacgattcgaaggttaaagcatgaatcggttgaaggtccgatgtcataaaatcaacgagattagataaatagtgaaacatgtgttgcgattggctaaatccaaatgcgacatctagatacctcaacggctgaaaccccgatgaaaccctaattggcaataaaaaagcagggtaaaatatagggtctaaacacgacttagtagatcaaatttaactgatgcagcactaagtatgaaaagaaacataatatctagacaatcaagcccttgactgatttttagggtggtagataccttagttaatctaatctagcaagataatttagccgatatcaacattaaccctaaacggatctcagctgatatgatcaaataaagatgcttaactagattaactaagatatatgataaataggtaggaaaatatatcaactaaaccagagcaatccaagaggttgaatgtggtgatgcaaccttgaacgaccgccaatgtagccaatataattggcaggggctggcggaacgtaggacttacccctttgccggagatcgaaaaccgatgcaaccccgcatctggtgccaagttccgccgcgataagtaaaaacctcggtaaagagggtggagatgcgctgagagtagttgtattgatctgtgaatagtttacaatgaccccaggtgtacatatttatacccatgggtagatactagtccttctcggacaagaaagaaactttcctaaagataaaaggaaaacataaagtccttattggacactaaacacagtttcctaaagataaaactaaactaacagactcttcctaattaatagataaactgccatgccgcatcctccttgaactcggtcacttctggataagtttcttttaatagattaatttccttaaccgaatatagtaagaatccgactattggcgacttgataattcctatcggccgattctaggactctaaagccgataatgactctagaccgatcatgactttggagcttagcaaatttcactgttaatagacaccacctttggacgcatgtgctttgtgatgaagagtttatacaaggtcagtgctgataccaacttgttacgcctagaaattcatgaaccaaaatccccaagcagaatgttcattggaacccctgtccaggaccggccagggtacacaaacgacaaaattgatacacatatccacgtcttacaaacataataaagttttacatatggaatgaaattaaaagcaagctaaactagattacttgacgctcgcaacgtgacgactccactctcactctatatgcatccttgacggcaacgacgagcctacttctccgagtaaccttcatctgaaaagtactctgcctctgaggtagggaagatagagcaagactgaatactacctaatgtactcagcaagtcataccaagaggaggtatgatgcaaggtaattccaaaggaggctaggggttatttgcataaagtgcttaaaagcagaagttgaaagtaggaaaactactaaagtaaattaagcaatattaatcatctatgtcaaacgctacacaacattacaacaggcccaaccaaccacctgaactaaaccagttccatttaagtcgaattattaagggtgagactaatcacggtgagtctggttgatctcccataaccgcgggcacaattatccgaatagttttactctgattagaggtgtacaactatacccacaagacacagccccacgacacgtttccgtgcgctgacatgccaccatgatataccagaaagagactgtgacaggacccatcgcataaccctccttaaccaatcatacccacttcaggttttgccaccacctttataaccatggcgggctacccatcctgtgcctaggtgaatccggaagccgcaaaagccatcacatggcccatccaaactccatcacgctcacccttccggcggtacgtcagctagggaaaagctacactacaagcccagccattgaccgcactggcttgtggtaagcacggtaattcttccagcgtaatccacgaaccggtccttaattgccatgtccccgctaggccctccgacgtggccaacttgtagaaactaggacgccgccacaagaggatgagaatctagagcgtgcttgcgccgattgctcgagtgatttcgacaaggggatacctaaacgatgtctccaacgagagaagcgatggaaaaccgccgccgccatccatcaaggtctcaaaagagctaagactaggctttcgcccggcaaccacccttgagcggtgagacggcatgacaacgcccttaggagggggaatgacactcgagcgccatcgttgtcagtccggcaaaggccgggctaggatttcaaaagctgctcaccacctacgagtccatggctgacgcaccaatgctccaccaccacccaacctctaccgacatgtgggacccctccactggcgctcccgccggccagccgtcgtgcgccgtagaccgcgccacacccaccagcagctcctcctcataccgtggtcgcctcctccaccaccaacagtgcctcatcgtgccacatcggtctcctccaccgccggatgcgcctcatcgtgccaagccgacctcctgccaccggccgcgcctcaggcgccaaactggcctccaccgctaccggccgcacctcctcacgttgtgcctttctgcgccgagccggccttcgacccctcctccaattgctgcgcgccagccagatgcagccgtctgccacgcccctggctagccatccgagaccgccgtgcctcctcccgccacagccgcagccacggtcgccacagcaaccacagccacagccgccgcagccccagtcctccgcctcctgggctccgccaccgccgttgtcgctccaccaccaaccgcgccgtcatcgccaccccatcgccgtgaagaaggccgccgcgagcatgccgttctccaccttcgtagcttctacggatccgacagcctccgacgcccgccaccgacgtccactcaccggcccgctcgcaccggcgacccgcctcgagccgccggcctgccacagcctgccgccgggcacagcagcactgcctttgtgcctgctacgaccacccgtgcctccgctgcctactgccgccaactccgcaccaccgaggccgccaactccatccacaacctccactcagctgacgctgccaactccacgccgccgaccccgccaactcgacgacccggctctccgctgcccggagcaacagatccgaccatagggggaccggatccgtgcattccagcgccggatctggaagctgccatcggatcttcctcggtgttggcgccttgccctgagctccatcttgctggcaccccgactgccttgaccgcaagcgagggagagagagcccgccgccgctgtccttgcagccacctggctttgccggcagcggcgagacgggggaggggaggagaggggtggaggtggcgcggcttgtttcgccagccgcgccacccccggggcacagcgaccgggcgtcttgaactactgaaaaaagatcatgatcatagccaccatggtactttcctcatagtgagctagttgatctaagcatggctaagcatcatattagatcccaatttatcaaaggcatgtggtaaacaacatatggctgagtaataggaaccatccacatgacaatgtaaaataatgcaatttaaatagaaagcaagatgtttgcaatataggtataatatgttcaatgagggatgcatgacttgccttgctcctgtgctgctagaacctctgcaaccacttcataatagaagagagcgtcgaaactaccggaatctaagcgacaaacaaagcacataagcaaaacaggctataagactactgaaacaggaaacaaaccacttttaatggattctaggcatttttatgaatttactgagacttgaatggacttaaacggagctcggatgaattagatatgaaatttagaagattcactatgtttttactataaacagaacaatccttaatcaattactgcgtattaaagccggatgttgatgtcagcaaggggagaggcggcaccgacacgcgggtcccacccatcagtgacacaatgcccggtccactgtggaacgggaccaccgcgacagtccattgccggtccacggggataggggctcggctcgggacgagccggctaggtgatggcggcacgggagcgagcggcaagtggcggcggcgcccaccggagagcagcgatgtggcaaggagagagaggaggaaaagaggagggcctcaccgacgatgacagcgaccgacgcggagcggacgacaacgaaggcggcaaggggtgaacgggctccggagcaaccttgggaaggagatgagaggggttagagggagagaaagagagagagagagaggccacggcggcaagcattgccagccgtagacggcaggcatgcagagctcaccggcgaaccgagggaggacggttccggcggtggaagacgacaggggaacgacggctgaggtagctctcgacctcgcgaacccgatggaggcgacagcgcggcttggcgcagtagctagcgacggctggagacgacagcggcgggagtgatggtgtgggcgcgatttagggcacgggagcaagcggcgaaagagggaaactgaggaggggagcacatgtatcatttatatagcggtggggagctcggatgtggcaagtagggggcagattttgtgacggacgtgggagagagagagagacgacggctggattcgaaaatcgaatcccgccgattttgaggagaaccacgtgcggcgagagtggtggaggtggttccgggtagtggggtgcatcaggtgcgcggagagagcggagtggggcgcctccctgacttgttattttgagatgtaaaccttagatataaattttgtacgtttcaacccttggaaagtggggtgtgtgatatagaggggcacgggggccttcgggactctaagcagagtagctcctgaccgcgaacccctgccctgccacgcggttattttaaataatagctaaacaatgttttctttatgtgacgagaatataacctcgggtccccaaggaaatgggtacctagttctcatttcaccaacagtggttaatgtgcaaaatgggcctagcgttagcaggaatcatattgtatctgatggctgatatttgagatgaggaacgatcaaacggctatagcatttttgagtaaattccctgtatatcattggaaactcactcaatcctgctcatatccctaatatttatctgatcccttctataccattaaaattttaacttgatccttctatgattatactgttatattttctttcatttcactgttaagtttgtttgcaaatatcatttatcccttgacgatgtaggtttgaatataaacttaaaaaacgattgaaaattaaatttaaaattttgtttgaatgcttagtatgtgcattttataaaactaatgagactaaataattagtgcaggaaatgttaacataaaatttgaaaataaaaatgtaataaattgaaatttttatttaatattttaataggataatgactttttattgcgaacgtcataaaaaatgaggagcatccgtaaaaaagaattgtgagcattattagacccatcttgaatactcctcatttgtagaactttttaataaataaaataaatacatattgtttttctttcattaactaaaaaaaattgtgataaataatgtgtcgcataataaactcataactataataagtcttatgtaataaacttttacatttcaataatataattcataaattttaatgtttattcatgtgtaataattatttttttataaaaattagacggtcaactaataataaactgacgggaggggcatggaataaatcaaaatcaaattttgggacttcaaaagaaattttctcttttttttttatgatgggactatacgtaattgcagatacaaattatagggttcaggtacaaatccgatcctattatagggttcaggtacaaatccgatcctatcaagtgcgtgcgtgcgagggattgtggcttgataggatcgtccggacctgacgggagaaggcgtgggttcgtgcgacgggacctcgattcgtccatccagcttccactacccctccgcgcgctgcctagatctttcctctctctcgcaccctcttattggcggaggaggaggagggatggtgcgggaggttgcggagagctgtgtcgacggggtggtgatggagatggtggcggcctactgcggccgcttctacgccgccaagccggagctcgccgcccgccgcatcgaggccatcggcttccaggtcggccaccagctcacggagaggtaaacgaatctctctctctctcttgctggatggatctgctgctgcgcccctcccccgatctttccggcgagtccgccgacgagggcctcagatcttctcagtcggcagtcgctatcggttcttgctgactccgataaattttgaaatgttgcttttagtcgccctaaataagggcttattaatcagatttcgcaacaatatcgagccttagacttgatcgcgaagcacttcttgtctttgggagcaggagtgcagggccttgcctacaatcaaaatttgggttaattggatccgctattataaatttcacggtttagaaaaataccattactatttggtaccattgccattgcaatttcataagtattatcactacagaccttttcataacattttttgttttttaagaccaaattaccccctcttcttccttcttccttcccctctctcctctcttccagccgacgaactcgtatgagttcagcagctcatgccgcaggctgcagcgctggaagagccgccgcgcaggacactgctgccgatggagctgaaggagagtggcatagagttgtgag

SEQ ID NO: 75718 - DNA, 2436 bp, Oryza sativa
ggggtgcaggtggtgagggtgaacttgtggtgcgtcccgtagtccctgtaaagcagatctgcggcgtcggcagcggcgggggccatcaacaacaaacgtcacgtcagcgaggtcgagcacgagaggtgaacaacaaccatggcgagaagaaacgagagtgaagggagaggtgaggcctgggggcgcagggggcgccgtacctctggtcttcttgccgatgtcggtgtagagccctggcgccatggatgccgacggcgtcgacggcgagagggaggggatcgatatcgcggcggcggcggcgaaggcggttaaaacggagtcgcgcttcgctggctctctctcgctgcagatctcgtggcgtcctcctcttcgccctggacctggactcgctttttcttttcttttctctctaaaaataaagaaatgagctttttcttttttttctttcttttttttctttggctgggcgtgggcgcgggtgaggtgagagggagaggggatgatccgtgtcgtcgcgtcgtgcttcgtgcggactgcggagcaaacggcgggtcaggctgtcagtggggcccgcatcattcgacgccgccgtggtgggcatctgcgtctttattctaagcacgtgcgtcgggaagggtggttgcgggcgaccgtgggcttggttgggcctggcgaaccgtacagcgatctgatccctaggcgggctgcagggataagttcattttgactcccttaaaagtgacccgaatctaatccgtagccctgaacgacaaaccagatatcttgactcttaaacgttaatatcagtgtaatttgattctctcggtggttttggagagccgttccgctgacgtggcatccatatggcagtgttgacttagtatgccgttgacatggcgcacaggtggcattaaaattgaaaacatacacgtgagacccgttcgtcattcacacaaaagaaaaatatatgggaccactgacatgtggggcccacatatcaatctatcccttcttcctcctccctctctctcccccttcggcaagcgggggccgccagcgacggcggcaggtgggggccggagtggcggcagcgacatgggacctacccgtttgcccgcctgacgcatgcgaagccggcaccttcgcctccgccgaccaaatccaccgacaagcccacctgctacgtacgttgccgccttatcatcttcctccggttggctcatcccctcctgtgagccaccggcgacagagacagcagtgtggtgttggcctagatgtgagccgccgatgacgccattgtcgattggggtggggtaggattggggatctgtggggagaaatggaggggtggtgagagagagagagggagggcagcggcgggacagagcttggcgagggagctctataggcgtcgaggccggctgtgatgggaacggcggtgacatcctgacgcgggcaggctggcgcacctactgctcgccaaggcggcgtcgacccctccgccaacgttgccgcctccggctcctcttccatcgaccatgcaaaagtggaacgaaacggcgggcgaggaggatgttgcgccctactccaggctctccttcctcctcctcctcccaactcaccagccacgaagcttgccgcccatggcctcctcagcgccgcttcctatcatcattatgctggcgccgtagcaggatggtgcagctccgcctcgattgccccctcgcatgagcgccagcgccgagtccgtggctgccttcaccgcccgcggctacggtggcacgcccctgccgaggagagagggagagagggaggaagaaggagtcaaagagagaggctgacatgtgggtcccacatgttagttgggcccttttttttaatgacaaatgggtccccataaatttttgcacttctaatgacatataagagttatgtcaacaccacgtcggatgaagatcaagttaacaccgccacgtagtcgccacgtcaacgaaaccacctaggaaatcaaattgcaccggttttaacagtttaggggtcaaaattttggttttgcggttgagggtcaggtcactttgaagggacctaagtgaacttattcctgggctgtatctgtgtggaaggatgctatatcctatggcccatttagttatattgggccttgtttttcggtcgcgcagaaatgcagaaagaatcactcggtggacttaggccggcctttgccacaccacacaaacatataaaaaattcgaaatttttcatttttaattttttttaaatatttacagaaataatctatcgtcgcaaaaatttaaaaaatagaccctgccgccctagtggagggcggcaagctgacgtggctagacgacggctcgacggcgccgtgtgcgtattttgcgctttggtcctgggcggcaaggggcgtaatgcaatttg

SEQ ID NO: 75719 - DNA, 19383 bp, Oryza sativa
  unsure (1)..(19383): unsure at all n locations
tctttcacgctctggtgatatggcccttccgcgggctggctttttttgcatggaggccccttgccgccctggcagtgggtggcaagggtgttaatacaaaaaaatcaactttttcaatcggccatcaccacccgtcgagctgtcgtctgccacgtcagcttgccgtcctccactagggcggcagggtctattcttgtaaatttttccaacgatagattatttctgtaaaaattttaaaagaaaattttaaaaatgaaaaaaaatctaaaaaattcatcccctcgttcaaaacttttttggagggattttggatgcttttctaaagagaactactacaccacgggattccgttttaacaggagatcaattatgacgcggacatcacctcccttgcttctagcgcttcgtcattccaatctctcatttccaaccatgtcattaaacaatatactcgtacagggctactagacgtgtgatgcatatatgcctcgtaagtattaggtaccatatatgattcatctatgtacttcacacgatacttaggtaatagacatacatggtacctaaattctaggcatggtacatatgagtaccaggtctgatatctatcggatttggtactcaggtaactggtctggtatctatatgtattaggtatgatatttagatactgggtctgatactcaagtatcggatttgacacatataggtatcgggtttgatatctttatgtatcgggtctgatacttagataccggatctgatactcatgtatcggatttgacacatataggtattgggtttgatatctatttgtattgggtctgatacttagataccggatctgatactcaggtactggatctggtacatataggtatcaaacctgatatctatatgtatcgggtctaatatttacatatcgggtctgatactcaggtactggatctgggtacatataggtaccatgtctaatatctatatgtatcggatttaatatttagatatcgggtctgatactcccatatcggatctgatatttataggtatcgaataaaaagaaaaaaatagtgtgtattacacgattattataattatgctaatgcaattttttctgttccatatcaaatcttaaaagcatcacaaccaaaaaataaaattaaaaacaaagcaagataaaaaaagggaaaacaaaaaattaaaaaaaaggtcacatgaacggtccaggtatagatgaattgtagttaggccaacatattcacatgcccaaacggtccacatgggccggagacctgtttgtcaaaaatcctcgtgcaggaaaggaaaaacacatgcatagtgcgcgtgaaaatcatgtgcgcattgtctttctgatggaaataacgtttaccattagtgacttaagtcatcccgtttccacggaatagtgttctctagattttctcttttctaaaggatatttaacccttttttttgtgaaattccagtataaatttctgtgttcaagaagaacccttaatcgactaaacaaaaggtcctttgtaaatcaccatatagcttccccccctcgttcaaaaatttcttggatgatttttggacgttttataaacgaaatttaacttttttttctgaaattcccgcctaaatttctccatttcaaaataacccttaattaaacaataggtcctttgtaaatcatcctttagcttttcctaagggacaaagaaaaagaaaaaacgaagtgtcgggagaacacaaatgatacacgaactagaacgtccaatacatacccacagaaatcagagagtattaataggattgcaacaagcaaagcacacacaaaaattgcaggtacaaaagaacatggcggcggcgcgcgctgccggttttaggaacctactataatgccttgagggtggctgctcctcctccggcggcggcggtggcctggaggaggccgtcgcggacctgcgcggccatgtcgcggacggcgctggggccgtgggggatgaagacggtggaggacctggaggtggcgccgatgtcgcggatggtgtcgaagtactgggtgacgagcaccatgtccatgacgtccttctcgttggggacgaagcgcttgaggccctcgacgatggcctggcgctgccgggccacgccgacgccggcgaggtacttggcctcggcctccccctcggcgcgcttcacctgctggatcttgtcggcctcggcgcgctccgccgccgccacgcgcagccgcgccgccgcgttgatgtcgttcatggcgcgccgcaccacctcgtcggggacgatgtccacgatcagcgtctgcacgatctcgtacccgtacatggtcatcgccctcgccagctcctcctccaccgcccgcgccacctccttcttctgcccgaacacctcgtccaggttcatgttcggcacgctcgccctgatcactgcgtcaaagaattccacaccttcacgctccgaaacatttctactaccagcagaaagcaccgtacaaaatattattttaaaaaataataatctattattaatatagaccatagtattataagttttatcagtattatctctacttgatagtcgtaaaaaaaacatgtcgaaatttcttttctcgaaggaatccaacacttagacagtatgaagttccattgaatatagcagggaaaaattgtaaaattataacctcgaaaacactagtcaccgacccacacatctgaggaaaggctagcaccgaatcgatcaccggccaccgctaaaccaacgaggaactatagatgtaccccggcctgtcgaaattattatggttgtgggggtgtgattacgtaccgtcgaagacgtaggactggatctgggcgtgggcgttggtgaggcagtagaaggcgtcgtaggccctgtcggcgagggcgcggtactggacggaggcgacgacggtgacgaagacgttgtccctggtcttggtctcgcagcggacgtcgagctgctggacgcggagggagaggtagccggcgacgcggcggccgacgcaccacggcacgaagtggcacccgggccccagcaccgcgtcgtacctcccccacgcctcctccaccgccaccgttgactgccccacgcacgcgcagcacagcgcctgcgccgcctccgccgagtagctgctgccccccgccgccgtcgccggagacgacgacgacgtcgacgacgtcaccccgcccatcttaatttggtccccttgttcctgatcttgcaaagctagcttagattatgtactttcggagtgtgtttatgggcatgcaagaagagaagagcagagtttgactgcgaagaagtgacatcgctgccacgctttagtgacaaaacaaaaaagcaaagcaaagggagtattagtgccaatgatgtacaccagaccaagtaacctcctgattaagtcttgctccaattggcaaagactagcatcgggtgtgaactctgaacagatgaaacgtaatcacaataattaattgacgagctggttagaataacaaacacattgacacacaacatatgaggtatccattgaccggatagggcaataggcacctcggtttcaactgtcaaagttggactagtactaatgggacaaaatacaagggggttggaaggcgcagcacacaagcgagcgcacggcagcatggcagtggcagcgtagtcaaaaatcttcggccatatcagctccaatccgggcccgaaccaaacggggacggggacgcaccagctgggtcgccatcgattcggaggtctctgcatcggcgaccgcggctcacagatcgagtagtgagtgactggtgcaatcgccgtccggccttgaccgcgtttagtttctctgctgtgtgacggtcatttatattgatcgcactatcgcagtgtttatgtacacgtctgcaaagttttctaccatgcgaagtgatttgatgtcaaactaccatgcgaagtgtttgagggggttgtcactatgatctgatgtcaaaccagagggataagatgagcgcgaaagggatatctctttttggccgaggatacaccgattactcactccgcctcaaaaataaatttatttttcgctcatctcacatatatcaatacaaaaataaaaatactaaaatactcaaactttatcaaatcccaatgcaactattgttcactttaactactctcaatttcattgttgctttaattttacaaacttctatgcaataattattctaaaaataaacatattttgagacaaaagggacttaaaaataaacttattatacgagacgatgggagtagtttattattgagtgactatcagcggcagagtatctactgttaggctgactctggccttgactactatacttcctttgtttcccagagactccatttgtcggtatttggttataacgtttgactcttcgtcttatttaaaaaatttcaatgatcagtgtttttattgttattatacgataaagcatgaataatattttatacgtgactaaattttttggattttttcataagtttttcaaataagatggacgatcaaacgtgggatacataaagcgaaaaataagtttttttaggacggagggaatactagcaaaaacatttgtgatgtattgccggagatcgggaaacacttcttcctcacccaggctcaatggcactgctggctccgtcactgaatatcgacccgaaaacttgcatgtacaaagggaaaaaaaaagcaaagttttcggattgcgatggtgattcagggttgctgctctatggattttggtagacccaatgggctgcattttccatgacagtgcttgggttttcagtccaggcttcaggcggtccgatgacatttttctttgtttcttccttctctcccctacctattgaaaaccgcagcgtctcatcactgagctgcatttgcggtccaagatttgtggtagctggttaccgctctggcgaactccagattgtcgtatcaactgatctttagtgccatgccacgaacaaaaaccttccaccacaaaatcggacagcgtgcaaatgatcctagaacggatcgctgtactataccgtaccactaccatatgcatgtccccctcggccaaaaaaattaccctacaaatctaaacgcatgtgttcaggttcatatttgctacatattaggacggagggagtagttaggaattttttttttggacaaagtagtactacctccataaaaaaaaactcaacctcgtactacgaatctaaggttaggttgtgtttagttcagcgcaaaatttggattttggttgaaattggagatgatgtgactgaaaagttgtgggtgtacgacagattgatgtgatggaaaaggactgaagtttggatccaaactttagaactaaacacagcctaaacatactctatatccagattcgttgtattaggatgtatcacatcctaatactaggttgccttttttttttttgacagagagtatgtacgtagtggtgtaccgtacgtccgtaccagaagccatacggcaccagtctacggcacgcacaaagctgcagcctgcaggcaccagcttgtaactcacttacaacgacgcagtacaacaagaagcagtaacaatcaatccatcacagacaagagagtgagtagagagttaccagccggtaaaaaggatgggtaaaatgatcaggggagtaatggcacgtgcgagcatcttagattaccaaactcgcatcgtcgcatgcatgcatatgatcatgatctatctgtcaaaggaaggaggggtgcgtcgcgtaccacggcctacctgaaagcggagcttagctctgtcaccccatcaatggcacatgcgccttaactgacctgcctgcccttcctcccttcctcaccatctccataatccagcaagcatcatggaatgatgatggcgacgacgaagacgacggtctttgatgacgaccaatttgcctcccctttttttttgccattctccacatggcgattaattacaaggcgaaggcgaccgacaggtgatgacagtgcgagtaagagcccaaacccagcattctccgggaaggggcaaacctaaccacctcagtctgagcatttgttcagaagaaaagcaaaagaaaaacccggtttgatccaccccctctcccaagtcaagggtaagctagaattggaaatgtagaagcttaagcgacaagatgaaagtttgcacattgtacacgtttgcgcgcagttctagtcgttctggaaacccggtttcctccacgacacagggtgctcccaggtgccatggtaggttggttgggtgcaccaccaatgcacccaggttggataggaagtccagtcttgcactgatcattgttgaatggatggcagaatgagcaccaaggactctctcattgcagtttgccgttgttgggccttggggactgccggtacggggaggcgtgcgggccataggagaggctcctcattggctgctgcccgttgcgcgcgaaggtgccctgtgccttcatgctttggctgccaattgggttgccgaggcttgcggcacgctcctgctgcatggattggaagaagtatgaggagctggccatgtctttgaggttcaggaggggcttgaggacttcgaccacttgactcatgagaggcctggccttgggatcccggttaaggcaggcacaggccagctgagctgtcttctgagcgcctcttatggagaagttcccctccagacgggggtctacaagcctatagaatcgccgtctttctccaagataaggacgcgcccattcaaccaggttgtgttcaccgtttggcctattcttgtccattgaccttctgcctgacatcatctccagtagcaccactccaaagctgtacacgtcactctttgatgtcaagtgacctgagaaagaaatgaactgatgaagtggtggaacactgcaatataccaagtgaatgtggtgcagtttaattctcaaacaagtgaataaatagcaaattatgtacagtactgtgatatatgagtacattcattcagcttagatcagtcaatggaagttcaaagctcatcaaatcaaaatgggcaacataattttgagccagtgcaattatgattcttttggactgcctcagagagagagattcagataaacagctattgcaccaccacagcagcacatggagtgccttaaatatcagtaatcacagaaaattaagatggtgtgccatgatagcacccagatcattgtgaatgtgaccaaaaaaggtgcaggctataataaaacactccatgcacacatccttgtacacagatttcatctatgtcaagtcactgaaagtttctactgaagggctatctaggaaatttgtcaaaggaaatataatgtgccatgaaagattttactacatgtgcaagtttggatagaggttcagcagcatgatgcaatatttcaaaattactcaagcaagccaactaacaaagtaatgatcaactcacctgtcatgacatactccggagctgcatatccataagttcccatgactcgagtagatacatgtgttttatcaccctcagggccatctttagctagtccaaaatcagagagttttgcattgtagtcctgaaaatgaatatttaagaaatatgagaatgttacaatctaaatgaacatttctaatatgttttgattctcaaacatggttgcataccgcgtctaaaagaatatttgaagttttgaaatcccgatagataactggcctttcagcttcttcatgaagaaaagcaaggcccttagcagcaccaagtgctattctcattctgatggcccatgggagaggtaaagaccctgtttaatacaattatccaagacaaatatcagataaatacaagacacttcagaatagagttatactgaaatgaaacagttgggccaaatttaacgcaacacagcaataacagtgcataaactacattgtctaaaggaggagaacaaagagttgcacccaaggtatttagtcggtaataataaaacaccaaaaatacatcatttggaattggaaacatgtaacatagcaccacctaacacccttattgactgccagaaatcgtaatgaacagttagtaaggtgtcagccatttcttaatgaactcttaaatgccaaactgtcagacattcaagtatacagtacaacagaattgctacaaaatatgaataaaataaataatcaactacatcactagagcagagtacaatatagaaaagtgcatataaaaatgcaggtactacaagaaaaactgctaccgtgaacaatgaaagaactccaaactgttggcaacaaatgggaagaaaaaaatgactgacagtaggacgcaaagattcttactcctaaaaagatggttctccaagcttccacgaggcataaattcatacactagcaacctttggtcatcttcgatgcagtaaccaaccaatttcactaggtgtggatgttgaaggtttccaagaaaatcaacttctgcctgaaaatgaaataacgctagtttaattgatgatgcattagaagacagttgaataatattttgtggtctgtatgctgaagcaattcaaaacataccacccactctttatggccctgcagcccatcatggttaagtgtcttgacagcaaccgttaatcctgtgccaggttttacgggagcagttccgttctcctcaatccaacctttaaagacacagccaaaacctccttcaccaaggagactctcaggccggaagtttcttgtggcacacttaagttcattaaatgtaaacctacggagttggaaagctagtttaagttcctctccgactatggacgaaggtgagatgcttccagtgttactggatgttgtggaaccagaggccattggttgaactgaatggtctcgacaaccatcattcgctgatttgctttctgcacatgaaacataatccttgttaggggaataactaaaaagcttatatcattaacataatatcctaaaataactcaacaggaaaaggacttggttcttagcagaagatgacaacctgagacggttgcagcagaaatatttagcaagttctagagggtttgttgggatgtattttatgctatgtcccacactgtatgatttgttcagagtttttttttccctttctacgtttcaaacggttgggtcgaagattatctatatgaagattaaagattaaaaagaaagaaaaggcttctttcccaacaaaagcaggtaagtcagcattacatcaagaatagaccagttttttttcttccaaattttggttcccaaacaatgtaatgtaagaaaaggcactaccagaacaaattaatacattcgtggacagaggagtagaaaatgaccactccttttactccaacagagctggacatgaatgccatattcagccaaagctccaactatccatgtggcctgctagagtgttaagtgcaaactggagcgaccaagtatattaagtcaagttagcatttccctattgagcgtttcacttcactcatacacacacgtttgtcggtattcagcgcatgcattatctaattatagccaaatatgcaaacctccatgcaacccacacaccaataaaatataagcatctacaaacacaaactgaaaagaattgaaagtactgaatctaatctgctcgcctcccgccaaccacaggtgttctactcatctcacagcaaccaaaccgtcactacatatcttccccatactacaacggcttcatccagaggacatccactacagaatcccctggcactagcaagccacaaagccctacaaccaggagcacaaagcacgagcaactcgaacaccaatggcagcactccaaagccacagaccctgcagactcgtacacaacagcacagcaggacagcacacagctcccatcatcaatctcattaatctaatacccgtacgtgaatgaagcggaggccatcccgtcccgtcccattcccatcctatgccagtatgccacacacaccccacacacacacaccaaccactctatccaactcacgctcttgaattcgtaccacccaccaaagccctctcctctcctctctcggatcacaccaacacacatccatttttttcatcatagaatgctcccatcacaatcaaacattacttctaaaagtaaaaaaggataaaaacagaaaatactactagaaaacaaagcttccgccagcagccatggcgccatctcatctcatgcggcgctagcgtacaattctctcgcgcccgtgcacgcgtggcgccgccaccccgagcgaccgacgcaaaagcatgcgccgaaaacgaagagcggaacacgagggaagcaagcaagtagtacaagcgagtgcgggagaggatggaagagattaccgccgccgacgcgagcgctgccgccgccgccgccgccgctggtggtggtggaggagtcgaccttggagcgcgacgacatgcagccgccgccgagccggcgcgggatgcggatccagcaccccatcgcgggcgccgcgtcctcctcctcctgctgcagcaccatctcccccgcccccttccccttccccttcctcctccgcctcccctcctcctcccgccgcttcccctccttccccatcacccccacccgcgcgcacacacgcaccttcaccgccgccgcccacccgcgcaacccccgaggtcccccgctcgtcagcgccgcggaggaagccgccgccgcgcgctccccccggcggcgagcgcgcagggtggcatcggcgacgccgcgcggcgggtggtggtggaagggaagtcgaggaggagagtgaagaggaggggtggtggtggtgtcggggcagcgcgggcaggggaaaggcgaaggctgagggcgaggatgcgggcagagcgggcagggcggccagaaagccaagcggagtgggaatttggcaaagaccgagggagaggagaggagagccccctgcccctgcaccttcttatggccgccgtccgcatccgtccgtctatagaacccccgtttttgcattttactccctacaagatttctaatatatccttcaagattgtagcattatcctttctctcatagaggcttcaacctgctgcctcttcttcgcatcaacgtggtcgctttcggcatggtaaagagtacaggaactagggtttagagtttagtgctgaggatccttaaattcacgatattgtaatatgtccagaaaaatgcatgagaggtgatacgtactaattaaacgcgggaagatgtaataagggatgacgtaataacgtatcccaaatacgcgcgggaggttgtagcaattaaaagcggaaaaataaaagttaacggtattggatgatggagttttaagtcgggtttaatgtttgatgtgttctaaatacacgatactataatatgtccaaaatagtcttgagagtcaatatcgattaaatgcggggagagataataagggacgaagtgatgacgtgttccaaatactctcaaaagattgtactagttaaaggcggaaaataaattataacggtatcactactatgttgtttacaaatgccttttttttggggtgcgggtggaggggtgcttatagctatccaatggatctatgtgtaaatactagaaaattttgtctccaaccgatattcctcgcaaagcatgtttatccatagaaagaaggtgatgaaactctgcagggtttaaactgataatcttggcaagcattaacttttataaatactcattattcacataaaagacaataataaatacagtatcaatatgtggtgtatccaagcaaatcatttatcaataaatccaatcaattattactcaaaatgtgtgcgcatatgtgctttaattttgagttttagataaagtaactcgttatttcactgaaccgtcgcttgattgcaaacccgctaagtatatgcaattcgagtttatgacttcgagtctggttggtgtacatcgtttctgacgaagatatcataacttataatccttatgtatattggtacgtggatctttacaagcataatatacaaccaaacacgtttatgtgatgatattattttcaaaaccacggaatcaaaagtgtaaatgaatagagtttgaggcagtacaaaacagggggtggaagtctgattaacgaatgcgtaaaatatacattcaaatatttgaaaaccaaacatgccaaaaactagcacggttagattccaagttttataccaagaacagaaaataaaaatgggataaaacatactattagaagcgactacaatccttatttttttcaaaagacaaacctgtaactatgctatatgcatttgaaacggattaaccaaaaccagctcgaaatttttcttttggtaacgtaggcagaactatgttcatattgagaacggataagctacagcctttcaagataagcatgtctgaaggctcgttgctcggttgtccacagtagttttgacttttgtcttttgatgttaaccgtgacatgcacagtttcagttcaaaggaacaaataaactaaaaaaaattacaaggttctatctgcaaatcgacaccaacacacgcacattttgacgatattcacgaatccaccatccatttcaaatccaacagccccctctactcggacgccgtccgttgaggcgttgatgcctatctcccgcaaacaaaaagaaaaaaaatactccaaaaaaaaaagaagaagagaacacgagagaaagagagcgcccattattctggaaacatagcgataacgaacccctgcgactgccatcaatgacaagtgggcccacccaaaggtggtcccggtgtgccagttacggcgctcgcgtgcccctctccccaccgggcccagtggcagctggggggtggtgcagatattagtaacaaaagaattttggtaggatgataaaagaataataaaatattaaaataccttgcatgtattggtcctttttgtgaaaagaagcacttggactttagagcagagagcagcaggggttggctggcttgctatgctggcaacgttggcaggatctcgatccgtattctattatgctatgatactatcttactatgaaacaatatcaatcattttattctaattttcatagtatcccgatcttactatttatttacacatgatcttacgaaatcttagctagtatcatgattctacgatcctacaaaatattatttaaaataaggtggattgaaaataatgtgaataaatattcttaagttttacataaaaaccaattaaatttatcaaaatcaatttatatgcgttaatttatacaacatattatatattttatattaaaaatatataccttctaaaatatgatagtatcgtgatcttataatattataaatcagaaaacgttcctagtatctcaagactgattacctttgttggctttgggtgtgggtttggtttgagttagacacgggtagttaaggcacaaatcatttcttcatgcattcacccaaaaagaaggctacttagtacttaccggttcttgaaacagccttaaaaagaggttagtaatgattcgaacccaggaaaataaggctcattttggtatgagaaatagtaccggtactcgagacttaatgcgtgacgatgatttaatttgaccagtgcataaataagtatgtgaattgaagtgccgttatattgtcattgtctataaataccaagacaaactgactttttagaaggttttagaagggagaagacagggatacgacaccataacacaaaagtagacacaaaagtatatgatgttttgggatctaggagtagaatttagatgaaacgttgacctattacaccctctagctactataaccaccatacgtgcacagaaacattgtgagcttaccctctcccatgtgtagaggtggatatcgaccaccatgactctcctttacagctttgatatgatcttgtcaactcttccaagtttcaaagggcttatttgcatttagaggtactccacaagaaaaaaaaattaactcatcttgcatgtaacaaaaaccaagaaatctagcgctgcaaatctcttcatttaagttttgatctatgaaaattataaattaatatgtccatctcatttaaaaaatatagaaaataaaaaatacataatttttagatggagggagtatatgacaaagacaagctagcagtaggattggggaaaatggacggttaggattagctcaaacacatccccatcctcaccaagcctcgtccatcacctaaatcctgaagattccataatagtaaaaagattgttaactaactgaaatcccgtgtgttatttcggacatgcgtagttgtaggtaataattaggaagaaacgctttttaaaacaaataagcatgaataataataataataataataataataataataataataataataataataataataataataataataataataataataataataatagcatacagtataaatggttgagattaagcatgtaagagatctaacggctcaccttattgcttcacgtacgttaagggcatctgacagagtatttgcatatggtttgctaactacatgagtttgacgctatgaaattttacaaagaggaggaggaagaagaagaagctactcagaaagaaccaaaccggccttacctagaataactgtcctgcccactaaattaattaaccaacatgtctgaacacggtcaagaatgtctaaactgccagtgaagttgttcttaaacaaacatgagctagcgactgtgattaactaatcatatatagtacacgttttgcccctaaacaactgctagttgcagagtgttagaccggtcaacgaatagttttctcctattagccagtataattattttttccccaataatctgtgtgccgtagggtaggactaggaaggcctcgattgtcaatggccggtaagaaagttaggtatccaccgaataataatgcactgggatggagtggagtggacttcatcacacagggaatctcttgctccggaaattatatgcatgcagggttatgaacatggcagcgacagtagcttcatcttcatgggacccaagtttgacaaattagtgaagcttcgaggataaaaaaaagtagtaatgtgcggaagaatttgtaagttttagaatcggtcgtgacggtggtggtggcggcggtggtaatgacggttgtcagcagctacaaaatctctaccattaggcttccagcagggaacttattttctctagtttttggtaagaatgattacacttaccctttgttaccgaagttttactttataccatatgtactctatctaatgttttcatattggactaaatatttttaccatttttcactttggactcacctaacacttttgtataaccacatccaacatctcctccgcaaacatgtgagctacacataagtagaaaagatcattggcatgaggacgctgatgtactcgtaaagatggtgatccaaagagtataaagggtgaaaattcctagttcaaggtgaaatgattggatagaaggcgattcaaaatgaaactttgataataaaatgtgataaactgcaattcaccctattaggaattattcccaacgttttagaatgttgttttggttttgtccaaagttaaaccactttaaattaactagatttatttataggaaaacataacaacatcaaattaatttcgttaaatccacaactgaatattaattatatttatttagtattaaaaatgctaatatgtttcccgtaaacttgacaaaaggtgatgaaatttgacttaggaaaaaaaacaccttacgttcttaagcagacagagagagtagggagatgtttgggattctggaaatggaggatgatttgctgtgaggatatagttgttcctaatgtgctgtttcttgaaaaaaagttgccgttccaaatcaagacacactttacgctgggcttgggctgtttttaccatcccgacctgtgcaagcttgggccgagcccgtttccagcccaactcagacaggcccagctttgctttgcgattcgcgctctgacgtgcgcgggatcggtcggtcaaccgcgaccgacctactccgaaaggcacacgtgacacgcctttgccgcctttgcgatctcaaagccaaagccgagggcacacgccgcctttgcgatcgactcgcgcgtctcctctcctccttccagggctcaggcgaggggggtacggtggtggtgggctcgccggagagatggccgagcgcaaggtgatcaacaagcactacccggacgacttcgacccgtccaagatcccgcggcggcggcagcacaagaagcagatggtggtgcggatgatgctgccgatgaccgtgcgctgcgccgcctgcggcgagtacatcgggagggggaccaagttcaactcccgcaaggaggacgtcgccggcgagaggtacctcggcgccgtccaggtgttccgcttctacatccgctgctcccgctgctccgccgagatcgtgttccggaccgaccccgcgagcgccggctacgcgctcgagtccggcgccacccgcccctcctacgagccgtggcccgcggcggcggcggaggcggggcgggaggaacgcggcggcggcgacgccatgacggcgctcgagggccggtgccgcgacgccaggcgcgagatgggcgtggacgccgcgctggaggagatgcggtcgctcaagtcgaggcgcgccggggtcacgccggagcagctgctggagtcgctgcgccgtcgcggggaggcgctggccgagctggaggaggacgacgagaagctcatcagctccatcgcgttcggcaacgcgaaagagcgcagcctcagacggatcgacgacggcgacgacgaagacgacgaggaggatttcttcgattcgtgcctggccagagcagccatggccaccaccagccaccaagcaaagaagaggccgccgccaccgccgcgagatgcggttaaatcgttggtcgtttcgaagaagagaaggccagagagcatggatcaagctgcatggccgccgtcgtcggggaagaccaccgcgagcaacggtgctcttcaggtgctttgctgtaactatgacgacgaggagtagtaggagagctaagctaatgtgtggtgatggaatttgacaatgattctttcccttatggcttgtttagttggcaaaaaaaaaaattgtccctacatatcacatcgaatatatggacacatatttaaagtattaaacgtagtccaataacaaaagaaattatagattccgccatttactgtagcaccacattgtcaaatcatggcacaattaggcttaaaagatttgtctcacaatttcctgacgaactgtttaattggttttttcatgtctatatttaatactccatgcatatgtccaaacattcgatgtaacaacgtgaaaaattttgtttgggaactaaacaaacccttaattaagccattttagttagacgctgatatgatgtagtacgttttaattaattatcgcctgaaagtagtgcgctcagtatacgtactttgtaattgtcacgtataaagatattgattgtggatttcagtagttgagagatgaaagaactattcatagagaggcattaattgatttcactgttttaattgaacatatactgattttgttactcctgcttgaatgtcctaaagaaggagagtatactcctggatccttttcaaggcttcagctatgtaaaatggcaaacaagccgcagtaccttttttttggcagaaatttatcataaataagcaaagaattaaaaaaaaaggtctatataaagtttgggactattaccgtggcgcatttcttcccaagcgacacaaattttcaacctttgattagaacgggtgtggcaactagaaaacttatatgacagcatgttttctccactactataaaaacactcacgtcttctacctttcccagtccccaccatcgtacttacttcctcctccaagtaaaaaatccaccattccttgaaaaaactatcccttctaaaaacgagaaaaacaaaatccaccaacaattaataaaaaaaaatcagatacggggtatataagactagcataaaaccattcatatgtattcccccaatacaatttgtaagcacgggcgtagcactacatagaaaaagggtcaaaaatttaaaaatatgtgttctggcagtgtaaattatatgtcgtccatattgtaactttttaatcatagtacatctcaaattacaaaacttaaattgcaattttacaagctcacacgaaaaaggcaaaatcacaatacaagccgtgcatgcctctacttttttttttcgtttttgtgaacaacgtgttcttgtggataaatgaaggatcaaaatctaatcgatccattcaggataaaacgtatcaaaagcaaccgataaaaaaataaatatttggaaaaaaacaataaataaaaccgtaaaatctacggctcaacaacaaacctccgatatgtgccgtttatgtggtgacagttgtaggagccttccagtctgtcaagcggtgtgcatatcaatggaggccaaaggattcagtcgtcgtggttttgccgcaaaactctatcgatctgattccctactgttgttttatctcatcagaaagtttgcttccttagagtggttactctctaccttgttagagatggtttattggcttaagttgtatccttgtacgatgtactagggtatatccctaaattctgtctcgttgaataaagttgttcatgttatcttaaaaaaaaaatcagtctggtcgttcggtcggagtcggactcgagtcctcggcccggtccaaatacaaaaagagcgcacgccccactcgacacgttgccccacctcaacgtgaccgactcgacccccacccaagacacgccggcggctacgcccccgaactccccatcgcctcgcccgcggattctcctcctcctcctcctnctnctctttcctcgccgccggggacgcgccgncggctaccttttgacgctccgacggtggtgccctttttctgtgggacccgggatcctagctcccctcctcccccgatgattcccggtcgcctgggcggctctcctcccgtcctagggttccggcgaggtcccccgcggctgcgccggcgagatgggtgagcgcaaggtgctgaacaagtactaccctcc

SEQ ID NO: 75720 - DNA, 1080 bp, Oryza sativa
tgtttgcaactcatctaacctattcagaacgtacctctggtagaagtttgattttggcatgcgctcaataccataatatctcattattatatcttcatcacttggggatatgcagaagacaaagtcatcattcagtaattgctctgcaacaccaagaggttggcagatactttcttgaagtggataaatccgagaaaccataagaactgggagaccctccatcaaataccctaaaaatgggtaactttttgcatagatttatgctcatatcagaaaggtggggtcctaagtaccattttgcatcaagaacaaactgatatagttcatttttttcagcaggagtgatgcgctgaaacaaagcttgcaaatcaacaccctccaatgaggcaaccccaaagattgaatggagtactccagatgcatcaccatcatacacataattagacaaatgctggcacgtactcaaatactttgtgtctagtatcttgcaacctaatttggtcaggagttccttcatcaaattagacagtgagcctgtattaattaattttgagactgtagatgctctataaaggtgccctgaggtagaaggtaatataggccaatcactaaacaaatcaaggtcatatgaacaatccccaatgtattgccagaaaagtttaaaccaggctgctgtaggagatgatccacccgattctggatcccagggaacttggtttcggcatttccatccaggaggaaatagccagggaaagaactgaagaaatattcggccttcaataagtgaaatgttaacctgagaactactggctatctgatacaacttgtctagtattacagggggaatgcttcggtcaattattctatcgctaacagcagaaagaagctcatactctatgctatcacagacataatattgattctcctgtgaaataccagaaaaaatcccaaactgtttatttgctaatggaatcaatgggaggccattcatgcatttgccgatattaccactgtccagatcagcaaggcaatattccaataatattagcttctgagatttttctaatgtaccaagatttt

SEQ ID NO: 75721 - DNA, 646 bp, Oryza sativa
cactgaggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgccatgtgccccaggccaccaccttctctccccacagggctccccgctgctgctgtggcccctcccaggctattctccacatggtagccaaagtgaacttctatgaacttctacaaacagatcatgcaactcctcccccagaaacccccaagccttctcttcccactctgtgaaatggccaaagcctttaccacatggatgaagtcctctaagacctgggcctcgccgacttcactgacctcaccttgcaccactcccattgcctggaagcccctcaaagacacagagcacactcccttccgtgggatttgcacttgaagttccctctgcctggaacttgcctgtcttcctcctttgcttccttcaggtctctgctcacatgtcatgctattatcaaggacgtccctgacaccctgtatgacagcactgtcctgcagaaccatctatgatatggaaatgcgtcataacctgagcttccaata

SEQ ID NO: 75722 - DNA, 16658 bp, Oryza sativa
ctgcagtcgtcgcgccaccgcgccgccgctgtcgtgccgccgcgccgtcgccccgaagccgctgcgccttgcgccgccgtcaccgtcgtcgccgccaccgccgccgccggtgagccatctcccctccttcacctcgcgcccaccgccgtcgccacccggggaagcaaagagccgagagagagagagggaaaccgagggagggaaaggataaggaaggaggagagaaaccgggagggagagagagaaggaaaaaaaaagaaaaaaaaagaaaagagaggccggcagataagagaaaaaggagagaaaaagaaagagagggagagaaaagagagaaaaagaaaaagaggagagaaaaagagggaaaatagaaaagaagaaaaggagaaaatagaaggggaatcgggggagaaattaagaggatttaggaaataaaaaaatggtcggggttaatcatagattatttttggaaattcctcgagcgtaatagtatttcggtcgaaattccgagttaattataaaaatatgtttattgaacagattagattaaaattggtagtaatttagatataattagtagctaaacaattagatgaattcttatagattattatagattatttttggtaatctctataagtcatcggttcacggtagaaattcggatttaattactaggaatcttatccgtgtattatatttaatcatttagtcatagactaaattaaattgtataatatttctaggatttcgtccgatatttagctcgtaatagaaatttctaacctattatatggatataatgctcggggagagtaaattaaaaacttatgacaacgaaataattatacccgcaaaatagtttaaatcgaaattgggtttgccgtagttcgcagatagtaaagttaataaaaaggaatcgactttcgcattcgactttcatttggattcatttggatttttatttgaattctaaccgaattcaaatcaattcttgcacgtaactatagagcccgagggagttgcggatccaagcgaaggccaagacccgcaagactttgagcaaggcaagtcatcactattccttgaacatgttgatcctaattgcgaaattgttttgtttacaaataaagttgcatgcaatgatgaacatcctacttgtgattatgccatgccttggttattgtttacccttaaatctttgtaaccatgtttacgtatgagtccctagtcaactatgacaaatgcttagaaatgctattctagaatcatgcatactcatatttgtcaaatgctatatgcttgggcaattatctttgggaaggtaattgagatgcggcatgtggagacatgagcgccacattgccatgatattgaggacatgatttgtgaaaggagaaataaactaaataactgttttcgactggggcggacggaggatttgggtggtatctggaaaaggctagtaccgtccccggtcaattaaggaccgagccatgaagttaagcatgaaacgaccctcgtacaaccgcacttctcatatgggtatagacctagcggagtagatagccgagcggaggcagtatccctgcatagatggttcacccctgagtgaggcaggtgcgctacggtgggacagccattgaggtagggccgagaggcatgccctacatcggtgtcgccattggtaggactgccatgagtgtgtgtgagagagaacttaacttgagccataatttaatgtgtgtgagacttctctttcccgggagcgccagaactcctctcactgctagaaacatggacgcctagagtgcatgaggatttaagttcatggagcgggtactgccaatgcgaggttatcaaaaggctttgccgtggcgcgtctcatgtgttgggacgaggctcatgtgttgggcagtcgcggagtgcgggtaaagtgtacatccactgcagtgtgagtaaaccaaatctatttgaatagccgtgttcgcggttattgagcaccgggacatgtattacacttggctagactctaaattctttaacttgtgtggaatgggatattgcatgatgatttttatgctgatggagccacttcctgagaggcgggaatgtggacgtcctcagaaaaccataacgactcaatgacgggaagctatcattgggatcacaatgggtggtggacagaaccgtcattgtttaatatgaacactggtattaaaaacttgatcactctatgctaggtcttaggcttgtgaaaagaattacaaaacttgctttgcgcaaaagaaccatagccatcctttgaattcctctgtcatgtgcatcattgctgtgatggcctgctgagtacggttggtactcacccttgcaaatataaaattaaccagaagcgggagatgaagcctcggaggatccctatgcctattaccaggagggagatgaagacgatggtgctcagtaggtcttagtacggtcgttgcctgtggcaatggcattccgctgccttatctatttctgcttttggatatattccggaccgctcggtccgatgatttaagactatgcctgcgggcttatgatgtaataattcgtattagacactcgtgtatgtgcacttggtacttcagctatgaattcgtgtgtaccagactacttgatccagggaaatagtactgtttacatgattgattcctgttataaaaacgggggtccacgtgtcaccatctcaccgaatggtggtgcggtcaaatccttgccacatgaacttttcttgcgtgtcctccttatccagctgcatggagccaccaaatggttaaatttgtaaataatagtccccccgtccttaaatatttaatgttgttgacttttttaaacatatttgatcattcatcttatttaaatttttttaatgaaatatgtaaaactctatgtaatacataaaaatatatttaataatgaatcaaatgataggaaaagaattaataattacttaagttttttatataagatgaacggtcaaacatgtttaaaatagtcaacggcgtcatatatttaagtacggatggagtatttctacatgtcaatcttactttagtttttagaaaaagttggatatttctaaatgtctccggtacacgtgtttggccattattttcttataagtactctacactgtactaccttattttcccactcagtaatactatttttctattaacggaaagaacttttgggctttgccccttcatactaatttaaatcttagtgattagaattggacttattttaagataaagatagtggagtagtatatattgtaaaaaagctaaattgcatccatgatacaggaatttgacttgtgggtgcgatttagcgatcaagtttatagaaaaattttgtaacatatgcagcccaaactagtttcattttatatgacattaaatatattttgataatatatttatttgggttgaaaatattgctatttttttataaatgtggtcaaatataaaaatgtttaactaataaaagttaaagcgacttataatatgaaatggaggttaggaggtaaatttagctatattttgaaatgggatgtagtcaaaattttcgaaagttggtattaggaagacaaacagagaagaaatggaaggagtgttgaaccatgtggtactattcacatgagagggattgccgacatggtcagcaaagtagtcacttctcataataagatctttaggagcacagtacgatccactactccgtaagcttcattttcatcggtcaatgccccttttgatttggaggaaaaacatagaaattttagaggatttcaattctataagaaaattttctatgaagctctttgaaacaaaggattgaatcatatccaatcttttgaaattcctatgtaatggacaatcctatagagattttggaggaaatttagcaagagcttcaacctcttgctaactttcctttgagtctatctctctcatcccattcctgtgtttttcctgtggttcaatcaaacggtcattcctgtgtttttcctacgttttgcaatcctctgttttacactcacattcctatcaaaatcctacgttttttctattcccacgttttctcaatcctgcgattcaaaggggccctaagagttgatagtgtacatctttaacaagtagcaactgtttatacaccggccacatgacgatttttttaagagcagtcaacacaagagaatctatcagtgtgaaaagttcataatatccacgcttattctccagtgtaaaaaacagtcattaattactccgatctgttcccatcatcccatgacggtgggagaaataaattatgaagataacatcattagctggacttacatcccaatcaaagtgttaggtctgttagtacatcgtaggctccggcgaactgaacgctaacaagatgtcaaagacgttttttttctaatgttgaatggagatgtcaaaagaccatttttttaatgttgaatggagacgtcaaagacgttgaccttgacaagcccaatatagaactcccaaactggagaaagtcatacccccagtggcacaagtagatcgatcgaaaaacatgtggatgagttgatctcttctacgaatggctgaagccggtcacctaccatgccagcgaaaaggcaaattttctacccctcaccgtcgtcgtctcgtggacgtaggtgttcagaaaaggatactactacatcaactcgcttgcaaatgttgtggtctcgtccatgcgttgctgtcaggtcggcccgtggtcctcatttgggcaagtcggctcggagacaacatagtaaattgcatctccgtcatgtgcagtatggatgtggcaattgccgatacttggaaaggttgatgtgaacctcatttctgaggctgcgtctctccccgcagaaatgagaggttcacttcctcttttgttgtactttctcagtttataaatatttcatataattaatttttttaataaacacattataaacataaatgttcataacacgcacgcatacacaccctacctctttaaacaccttcggaaaactaggttgatatatattgagattaacgaaatcaccacagctatctcatcgtcaatgggtacgtctaccacttaaagaaattagtcgtaaatacgagagcacctatatcaaggctaggatgtgaaccctagatgagttggttccaccaaatcaacctaactaatttgagctatactcacttcgcgatataattaattttgattataaaatttagttatttgttatatttaaaagcttaatttaaatataaaaaataagttatgcttgaagtacctttaacaataaacatgccatggtaaaagaatggtaattatatatataatttttgaaaaataagacaagtgatcaagcttaaacttcatagttaaaatcagttgcgtcaaatatttatgaccctattcttagggttttgtcttaactaatataatataggactaaaatgctcccgagaaaatatcacttacatgggaacatattctgcacacaagtcttctcgtgtacacaccctgcatacaactaaaaaatatcaaaaaaaatcttaaaaaataatagtactattacatatatatgtaaagtcccatattcaaaattattatatataaagagcaacaaaaaagataaaattatgacatatttacactctcaaaacagtcagaatttttttcttttttgttgtggctaaaatataacgaatttgaggttaaaactttacacataagtgtaacattattgaaagtacttctatattttttttttctgaaatttgctacttgatgtgtatagtgtgtatacgaaagttgtatgtataggatatgtttcccacttacatataatgaaccaaagactatgatgtaacttcctgttacgcatgaataaaaagaaccctcaataggcaaatgaggtcgggctctctcccccaactaatccatccactaaactgctcatactcactttcatcttctcctccccggcgtgtttaagcttgggttccctctaatggaggagagatcccttgccatgtccttactatacatgttggattttgttccaacaattatattgtttaaataagaatggacaatgtactttgtagtgacaacagagtgaggttgagagattaactatgcatgaacgcaaaacatgattgcatctataactataaaggggttgatagatgcagatatagttcaatgtagggcttcaatagcattaagcccatgggacatggaatttttttgtaagttgcccaaagtccaattaatggggtcccttgaaaaaaagtactatcaatcgggctgatggaaatgatggagtagtactttgttcagtcatgtgcacagctaaaatcacaaaatttgcttgtttgggcaacgtacgtcagaaacagtatgatcatcttgatgttacaaggccggattgcatgtgtgcaagcatgtactatataagataatgaaacaaccaagctagtaatagtaaagactgctattgaaatattgaagatatacacctggttttagtctaacacatctatgtcatatatacaaggagacacgttaatatcacacattaattgaacacctgcaaattttggagatgatcaataaaatgatcagtacacttcgactgtatatatcacggcaaaccctgcaatgaacttgagtcaggcttcatgaattcatcaggcttggcactggcagaagcattgctgttgctccagcgactaagctatggcaaaataatttattacctgaaattataaaaaaaagtgatataaatacaatacagatattttgttaattatacctgttgtaagctgatttagattaattgattaattcctgacatatgtggatatgcccgccgtgattgttgtacggaggattctagcatactcctcccattacataaaaccccaatctgaaatagtaattttaacaatttaacccttttaaaaaacttattttggtattgaatcgtgccaaaaactaaaaaaactaatttttggcatgcttcaatctttaaataagttttctaaaagaatcaaattgtcaaaattacataaaataaaatgtgatatttcctctatccaaaaaaagctactcctagtaaacaaatagaattctttatctagattcgttttactttttgaaccgagagagtattttataatataattaatctggacagatatggtagaaaatattatatcttattttaggttgttttttacgagaggggaagaagaagaagttggttagtacgtgcagaacacattcaaagggcctcctgtacaagaaagcttttgcagttgtgcaacgaaagatcgacgccttttgactcataaaggacataaagaacgatgaaggttgcaaccgcacggaacggaaataagctgatcagccgatcatttattactctagtactagtagtgttttttttttcttggaatacaaacaactcaattaaagagtctgtttagttcgcgaaaagaaaaattttaagtgtcatatcggatatttgatcggatgtcggaaaatgttttcggacacgaatgaaaaaattaatttcataacttgactggaaaccacgagatgaatcttttgagcctaattaatccgttattaatacatgtcggttaccgtagccatttattgctaatcatggactaattaggctcaaaagttttgtctcgggatttccgctataactgtataattatttttttaatctatatttaatgcttcatgcatgtgtctaaaattcgatgtaacgtttttggggaaaaaaattagaaactaaaccaggccaaaatctggatgaaaccatggttgagcagttcgcctggatttttttcttttttagatcaaagcctcaaaggcacaaaggccaggtggccctgcttttcttgaacgcagatatgtggtgcctgtctctgtcctgctcggggcgcttctctgtttcgaccggaaagttcaacgtgcctcacgggtcaccatagacttgtagccaaggccaagctgttccattcacaaaatttatcatcttcaatactctgtcatctgcctcgacagacgcaccacatcctgtgttcaggaattgatgtgctactgccatgcaaagtgccgcgttaaatttgccgaatcataaaagttgttgagattatagacatataatgatttaatctattccataaataaatcatgacattacagataaaaactagcatgaacgcatcattagatctacacatgtaaactacacagtataacatgaacagatcaaatatgcgcaacatattgaacacgtactgaggtgacgaaaagaccagctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcaaaggcagaggttccggagacctgctctcccgatcgctggtgcacgccggcgagcgggatggagtagtctacgagcgacggcgcagtacagagtaggaggcaaaccctagattgattttgcgtatatactgcgtgaagacggcgggtcggtttatatagagaagggtcgcttgatcagggcacccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgcctgccctgccctgccctgccaggccaggcgaggcgaggcgagcgagcgcgcgcgtgtgtttcccctcttctctccaccacacatgcttcaagtggctaggaggacatcctcccttttaaagaggtcccactctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatcttcgctaattaaagccaacagaactcattaaggcatagccaacctgccttgcagctcacgagagtacatgcatcttcacttggagagggtatatatattgatactctcctctagtttactaatggtttgttcttcctaggatctaattcacgggatctccgatcacatagactgggttaccaccatagtataactcacatgggtctcaaacccatctccttcgatgcattgtttatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccaaatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatatttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagttgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgagatacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcaaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacaaagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcagaatgtcaaaggcagaggttccggagacctgctctcccgatcgctggtgcacgccggcgagcgggatggagtagtctacgagcgacggcgcagtacagagtaggaggcaaaccctagattgattttgcgtatatactgcgtgaagacggcgggtcggtttatatagagaagggtcgcttgatcagggcgcccgcacgatctctactgcgcgtaaccgaaccggataagtcgcgcgtaacttatccggactccacgccatttgcacgcatcggatttttcggaacgtttccaaaacaaaaacgaatctgaatttgcagcaaaacaaaactgcaaaaggaggctgcatctgcgcaagggtgaggagccaatttttcggaccattcgacgcgtacgttgtgcacgcgcgccgcctgccctgccctgccaggccaggcaagcgagcgcgcgcgtgtgtttcccctcttctctccaccacacatgcttcaagtggctaggaggacatcctcccttttaaggaggtcccactctcctagaataagcaaggtggtactaaactccacatgcatgccatcccatgaggtgggcttttgtgattttccaaagaattaatcttcgagtgggctaaggcccattcattaattccaacaaaagtttgcagaggaaactgaatctgatcatgccctggagtggtcgttaaacagtcctgcagttggcctcacggtctcttcacttttgagtgcagggtgtgggagaggagaggaaaaaagaatggtcatgtgttgagcaccgtatggatcatgctgtcatgcctcactctgggttatggctgtgtttagttcctgaaaaaagttggaagtttggggaaagttggtagtttggaaaaaaaattgaaagtttatgcgtgtaggaaagtttttaatgtgatgtgatgttgtaacgctccgcttttcgcgaaacgttaaaaactaattcggcaaaatcctaaattgcgaaaattttcgttctttgtgtgcgagtctaagtcgtgccatggatctcaattcaatctccatcgttgttccctctcgtcgccatcaaaatcgcccacctcaagattccaattccgattcaagtctccaaatgaaattccgaaattcaaatcctatcttgaaatcctcgccaaatacatgtccccgttcccaaaaatatcaaaatctcattttgaatctcttccttgacttctcctcgagtctcccttgattcctccctaaaccctcgagttcgaatatcaaattttgaattcaaatccaaaccctaacctcaaccattcaaatcctctagaaaagtctagtttgcctcccaaaggttttgtaggccgattttgttcccccggccccaatttcccccctgcccatctccttcctcctctcgcacgttgctgtgcacgcacgtcagccgagccgagagagagagagagagagccctcgctctcttctctccctccctctctctgcctctctctctctctctttctctgacgccgctcccactcactgagccaccccgccgcctaaaatggaaggggcaaagccccctttccaccgccctatctccctttttccctttccggttcgacctctttctctctcgcccttgtccgcttgtgcttggaggcagagacgctgacctcggtgcgccagctcgccacccccaccttgaccgcgccaacccgcgctaatcctcccgctcccgcaatttgattctcgctgtccgatccaccgcctccaccgcgcccttgcatccacgccgcccacgaaccgcctttgccgctcgcctgccgagctttagcacgctcgctcccgcctcgaaccgacctcgcctccgctataaaacccaagccgagctcctcctcctctctttccctctcgttttcgcctgccgcgccttgtcgccctgctctgctcgcaccgtcgccgttcgtcgccaagcactggtgtcacgccccgagctagtcccgactggaattagcctgtgacgctccaaattaacctgttaatcgataccagtcccaggaaacagtgctggtatcacaggaagatagaatatcacagcaacagaggtctctttattatagagtaggagtacaatcatgttgggctgcggacagatcccgagctcacaactgcattagaaaagggaaacggaagccgggacttggaccaaacaacacaggcgcgacttgggaactaggccgaaaccctaaaactcatcgtaaccggcttgctcctggaagaactcctcatcagcaggatccgcttcatcttcatcagcaactagggggggggggaatatttatatagagcaagggtgagtacgggagtactcagcaagccatgggaaataagtgtttaatgcaggcttcaaggaaaggctggttgtttcgtaattgattttatttgaactcttttctaaaaacatctaggtgagtgcttctcaaacgacacggttgagacagtgcgttccgtccggtcggagtatgtgcaatgtatcaatctttagatcttaaaacaaagttggcaccccgtccacaagctttcaaacagtcaccccgggccaacaacttttaaatcggcaaccgggcctagctgt

SEQ ID NO: 75723 - DNA, 2681 bp, Oryza sativa
  unsure (1)..(2681): unsure at all n locations
ccaacggcttgtttgatgggccggttgacgggcccccggccccgctccacngacgctttctgaggccgggtcgccgagaggtgagccggcggcgggcgagtggagatgagcagaggcggagatggggaatcggttgcgacttgcgagctggctaggccgaggcgatacggcgtcgtggtcacgagctgagctcgcgccttcgcgcatgggtgcgtcacggaacaggcaagaagggaacgtacaccttaagatagtttcatactctgtgctgatagaaaataacgaacaccttaaaggcaaggtaacccgcacacaactatactctatgctcatccaaaggtggctttcgtaaaaaaaaaaagagatcatatgtgtacccttatgtgcataccctctaaaatatgctcccctaccataccacactgcatagtaagccaaagcacctgctaatatgtttgaactcacaacaatctatttatcattaataatctacctatttaatatcgaagaaacaagaatacttaaatattgtgtgcaaagataaatcaatagattattagtacttgtttggtgattaaatattgcaacacacagcacagcagtggaaggcagccaacctctagttgctctggtaataaggagctatcgtctcgagagattataacccactcccctctactgggcattctatcgaacactttaaggtcgtcccaatcctgacacaagttctctaagagtttttacattcatgcgaaaagacagtagtaggcttacctctttatgcgccatgggtgatgctcgacagacagggaaacaccgcccaggtgatgctccgaccaacaacggcgacgacgcagacctccgagagaccaccagacgttggattgggaagaagctaaagccaatgggcgtgtctgggccgagggtggtgagctggaggaacaggttctacgtggcggtcaactgggccaccacgctcgtgtgcggcagggacaacatcaggatcggctgatgatgatggtttttggtcgggatttggctggacgtgtgttcagttctctgaataatccacacattctggaagagagggattggaagattctctctcttactacttgtttttctgaactaaatttcatctatgtaagtgatgatttattaatggattaattagatctatatcattaaaattttattggttttgaaatatactgttactttttgcgtatttcaaacgatgccactgctatttgtttgtaatttcattggtgctactaagatacgtattttgtatgtattggacgaaaataccatcatctccttctctctttcccgttgcttctttacatggacatggtcatacgagaagtaggtgtcaaagtacaggcccatctttttctcccccaattcgtaacttcaattttacgatgatgaacagataagagattatctctgcgggctcatcaatcaattcatgtcgggtgaggcgatctctacggctcccgttattacatgcgtgtccctagcagcggtgcgggcagacacccccgtgcgcccgttattacactaaaaactactatgtaaggttgtactctatgagtagtaggtaatggagaaaattatcttaaactagactacggacaccatggggatacttttctgatgattatctgactgacatgtaaataacatttcttcaatgatgaaaacaattttccatactggttattcattccacgcttctagaagtacgatatttttcgtattggttaatggttattcgttccacacttctagaaagtacaataactctaaaaactccctgcatcagtatccgtatcagtctgtttgattggagggagttgttgatggaaaatgggagtattattttcgagagtataagtctgtagtttggttggaatacttgaaaattcgagagtgtttgggagaattaagggtccaattcccaccaatctcttacctagggaggtctgttaattcgtgagatttgaagggaattcaatgtgaaaccaaacaaaggatggagactatgccaaacatgccctacgagttttttttttctctctctcaatcatccagtttaatttgcccttaatcaaagcagggttttatgagctaatcacaccttaatcgacattgagcaattgtacaacggtgccacaaaaaaattcagtgacagaagaaccaaaccttaggttggttggtcggtcagtcagtcactgcagcggcttgaagacctgagagtgcggcgagacgacggcctcctgcaccatcctcctggggtcgccggggtcgcgcacccacttcacctcgctcatgttgggcgtctcgacgaacagcatcgtgaactcgcccaccttctcggcgcggccgcgccgcccggcccgcagcacgaggctgttgctcctgtggtaggagaagatgccgccggtcagccgcacgatgtcgcccggctcgaacgcgtcgcgctcggcgccccacaggaggaagtgcgccgccgccgtctcgtcggccacgagcgccaggcacgtctcctccctcgcgtcggcgcggccgtgcggcggcggcggcggcgccctgccgccttgtcgagcacgatgaacgtcgtgttcacgtgttggtggccgccggggcgaggtctttgagcttcaccgtgctgc

SEQ ID NO: 75724 - DNA, 588 bp, Oryza sativa
gtaatcttagcaaacgcatccatactgatgtccttcaatgtatctttcggtatatcctcaataattctctgttcgtcctggcttgcagatagtctatggtaagaaagcctggcatacacccatactgtttgacaacatagctctaaagcctttggtgcctaaaatagagaaaatggttttgaatttgtggttaaaactcaaaagcatgttcaagtaaatggatcaacatctcagaatggtacctcatccaaatgtccaatattgtaaagcgtcacaccgatgttaccaagtgaggacatgagaaatttgatctcatcaagttttatccatgtacttgaaatggcacatttgatgaaggacacgctcttctggactatgaaagcaagatacattaataggtgataaggatgcaattctaattagtaaacagcaggctatgtaaaggcaatactccactaatgtcctttggataggagaacaacaaacagatttacttgtaagtcaactgtttctatatgtaataaaatgatatcaatattaaaaaccaacaggctgaaacaaggcatactgtagttgcaaaagacatag

SEQ ID NO: 75725 - DNA, 11315 bp, Oryza sativa
aaaacttctcaaaaaagatccatcaaatgtgatataaatcatgacaataggtgagtctaaatcgcctaagctataactctcactatatcaaaataagcatataatcatgccgagagaatgacttacaaaaaccagtcatctcaataaaacccagacagcctttgcagcctaaaaagacttacaaaattagtataacacttttccgtcgagcacctttttatttgcatcgtagtaattccaaggaattatctaactgcgtcaaaaaggattttaacagcattgggttaaactgttgtgagcaaatgttgtcgaagcaaaatgcctaagtccctaaggatcacaactaaaccacgccgatagcaaaattgggctgaagtactgatttaggcccaggcccattagtactcccgataccctaataaaactaaaacctaagcgtcagttcgtcttccccgctgaaactcttgccactttccccattctctgctacagtgcaaaaccacaccgatggagctagggttcacagattcgctccaatccagccttcaaggctccacgaaaatctcccacacaaccaccgcatcaatctcccatccattcccagccatatttctaaccaaatcacatcatccaattcgcatccatggcggaagagagagagctttgagagccagtggacgccctccgacgtaacggaggaaaacctaaaggagatggtggcgcacggtgttcttccggccaaggagatcatcgggtggcgtccagcatacggcgaaatgtttccaacccacgacacacacgaggtggttgtattctcctatttcttttacggcgggttttctcttccaacctcaaacttcttccaaggaattctggatttctatggtattagtctgcatcacctaaaccccaattccatagtccacattgccaacttcatccacgcttgcgaagcttttctggggattaggctgcatttcgctctattccgccgcatcttctttctcaagccccagccaaacaagagcaaaccatgtgttgttgggggagccagttttcaactgagggggaccttgagccaaaaatacttctccatgccattcaagacctggaataaatgttggcatgcaaattggttctatgtacaaaaccccgagccagtgtttcctgggtactcttgtctgcctccggtatatcaagatacccggaattcgcttcccatgggggatgaggcagcccaagcacttgcactgatggattgcatgctgaggctcaaagagcagggtctgcaaggagaacagatcacccgacattttataaaaagccgactagggccaattaaagagagatcccgcacagcctttgaatttgacggcaagcatgaccccacccgtgaagatccagattcacttgagtttaaagtcatgaaggagagaatgtacaaaatcttctcgaatgctatcgtggtcagttattcgcacttgctgccagtagtgctatacaacgccttcaaccctcctccaccggtatgtcttatacaactcagcttttctcaaagcatacttttatcttctgtaaggtcaactgaaaactcggagtatcatgcacaggaattcgctttgatgaaatctgaccctccaattgctcaacgccattcaccccattggaagacaagccaggctagtggagggccaaaaatcaagcctgctaatcaacctgacacttcgaagttgactaatcaatctgactctcggaagaggaaattgatttcaagtgacgatgaaggtgatgatgcggaaaagacgggtaacaaaagggtgactggaaaacagtcaaagcaaaccaatccgaagaagaaaacgcccagtcgtcccatgccaaaaataaggaagtcatccaggtatgtatcatctagcaatttcttctgtttcgctagtcactcactattgaagcaaagctaatagcatgtctcaaatatgtagaaaaccatctgacatagatccctctggaaaagaccccacgtcaactgacacggagaccggtccttcagaagaaactggaccgactgccgaagaccgcctgggtaataatcaaccggcaaccgacaatgtagataccagcaacgagcccccgactggaaaccagtcggccgagactgaagtcagtgctgatcaggagcccccgactggaaaccagtcgggtatagaaccaaataaagatatcctagaagtagaagctcaagctaacaaccctcccaagacagacactggtgctagccctagaactaattctcctgttagggtgcaaggaactgctcgtcctcgaccggaaattatcacaggtaaacacatcctccgaacctgctttgatccaacaaactttcttcaattacttcacttattattcatgactatctaaggtccgatgatcggtgatgaagaagaggttctccggatacaatcggctgaagattctcgcccacccattttagtcaagtggtgggatgacgacatgcaaccacagggaattgtaataaataagcaaaaggaagatgaggaagtatgcctactgaaaaagacactcggccaagccactcgtcttgtaaatgtaagtctccatatatatagcctcaatcatcctgtcgatcaccttacttgaacaaagataaatttgtggtgcagagaatccatcttaggaatgaggcgaatactgcaacccttgaaaagttagttccccaccttggaacccttgaagccactagaaaccagctgcacgaagctaaagagcttgccaagaagactgagcatgatgtgagagaccggatcgccaagctccaagactccaactttgagctgagcggttcatcaaaaggtaaatatcatctttgtctgacttgtttcgtgttgctatccatgtgcatctgacaaatgaaaaacaatacagtgcaagcttctaagatatctgagctgaagaagcgaatccaagctctagagaaagacaaggccgaattggcaaaacagagggactcggctctgaaagatgtcgaaggtattggtagctgacacttcaaaaaccactctcatcttcatgcctagtcgttgatgtaaacctatttgtacaaatcgcaaaatcaaatcccaggctcaattcgatgtcttagttaacaaaatcaagaagcttgaaggagccagagataaagtcgccaatgccgctacgccactcgtccaggttcgagtttttcaataacaacggtccgagttcaattgatgttgtcgaaatcttcgacaaactgagaactgctccggacacctattttaagaatatcaaagaagctggatgcatgagagcgagcctggcgttggcaatgaccaagtccttgtacccgaagattgacatcgatgctgttgatggctttgcagacgggacaagcgaagaagccgcccttgacctcatcaatgatgcgaaaaaagctgctgacaagatagccactgatgtagttgagaggttccaggaaaacgacctcaggccaactgggtctgacaattctaatgatgaaaaaactgaaactgattaatgttgtattttgatgataatgatgatgatgatggaggcacaatttgtacaatactgataaatttatgctgtgctttatggtttgaacatagctccagatttcttaaaagtttttgtcaaaccttattgagcctagaaccctcaaaagtttttaaaaaactctcagtcctcattggctaagccaaaaaatcaaacaaggcaatgataaatcaagtaagcaaattgaattgataaaaatcacactccattattattatagtagcccccgactgataactcaagggacaacttgatgttaacagtcaaagaggaagatacaaaagtaatgcttaagcataaaaatgacgaagatgttcaatattccaagagttgtcgatatgagtaccatcttcacgcttgagtcggtaagaacctggccgagtgacttcagaaattatgaacggtccttcccacaagggagataacttgtgccgatcccgtgtagtttgaatttttctcagaaccaggtcgccgactaaaaaagctcgagatcgaacattgcagttgtgataacggcgtaacccttgtaagtaccgagctgactaaattaaggctgcctcacgggcttcttccagtcggttgagatcatctactcggtcttctccgtagcgattcaaattccacctcacttggcaacatcgcttccactccatagactaggaaaaacggcgactggcccgtagcccgactcggagtggtgcgcagggaccaaagtacagatggcaactgttctacgcatttgccagcatagggacgcagtcgatcaaaaactcgtgcttttattccttgaagtaccataccattggcgcgttcaacttgtccattactcatgggatgcgctacggaggcataacaaattttgatgccaaagtcctcacataaatctttaaatactctgcctgtgaattgagtgccgttatcagtgatgatccgattgggtaccccaaaccggtgcacaatgttgatgaagaaatctctagccttgtctgccgcgattgttataacttgtttggcttcaatccacttggaaaacttgtcaacagctacaaagagatgagtataaccacctactgcctttttaaatgggccgaccatgtcgagcccccaaaccgcgaacggccaagacaacgggatggtttgcaactcctgagccggtagatgagtttgtcgggcgaaaaattgacaaccctcacatgttcgcacaattttgtcagcgtcagacacggctgtgggccagaaaaaaccttgctggtaagccttgccaacgatggttcgtgtggcagcgtgattgtcgcagattcctgagtgtatatcctttaccaattgtcttccctcctccaaagacatacagcgttgtaggattcctgatggactttttttgtacagctcggtctcatgtatgacataaagtctgctgcgcctggagatccgctcggcttcatctttatcttgagggagttcttgttttgtcaaaaatcttatgaggggctctctccagtcggcttcaatcatgcttatgtcttgagtgtccatggcctcgattgtttctttccttggtacggttggctcgtagagatgttcacaaaacacgtcggaaggagctgcttctcgttttgaaccaaaattagccagtctatcggctgcctcattattgtgtcgaagaacatgggtgagctcaagtctatcgaatttgtcttccaacttgcgtacctcttgccggtaagcggttatgttatcatcaaggcaggaccactctttcatgacttgattaacaactaactaagaatctccacgaactaccagacgccgaatccccaaggagattgcaatccttagtccgtgaagaagcgcctcatattccgccacgttgtgagacgtagaaaaatgtatccacaatacgttgctcagcctctctccagtcagggaaattagaactactcccactctagtgcctgaaagcctcttcgacccgtcaaaatgcttagtccaatactccatcttctccgtgggcatgtcttcttggcactcagtctactcggcgacgaagtcagctaaagcttgagacttgatcgaagtttgcagcttgaaagatatatccaaagacatcaattctaagacccattttgcgatccgcccgtttgcttcgcgattgtgaagtatgtccccgagtggaaacgacgtaaccaccgtaaccgagttaccttggaagtagtgagataatttccttacggtaactaaaacaccatataatagcttttgaacctgagggtatcttgtcttggagtcagccaaaatctcgctaacgaagtagattggtcgttggactttttgaacatggccttcttcttcacgttcaacaaccaggactgtgcttacaacctgggaagttgccgacacgtataacaacagttgctcttgcggatgtggtgaagctaagactggtggagtagtgagaagttttttgaagtcttcaaaggcttttcgtgggtccccactggaaattgtcggttttctttaacagcttgaaaaaaggcatcccccgctccccgagtcgtgagacgaaccggctgagcgccgccatgcagccagttaacttttggacgtctttctgggagctcggcagtttcattttgaggatggcattgattttctccgggttggcttgtatgcctctatgggacaccataaatccaagcagcttccctgacggtactccgaagatgcacttttcagggtttaatttcatcctgaaagcgcggatgctctcaaaggtctcttctagatccacaatcaaatcatccttctgctttgtcttgacgactatgtcatccacataagcttcacgttgcggccgatctgagttgaaaaacatctctggatcatgcgttgataagttgctcctgcgttctttaatccaaaaggcatggtgatgtagcagtaggccccgaagggcgtgatgaatgaagtctttaagcagtcggattcctttagtcggatcggatgatatcccgagtagcaatccaaaaaactgagtagctcacagccggccgttgagtcaactacctggtcaatgcgaggtaacccaaaaggatctttgggacaagacttgttgaggtcggtgtaatcaacacacatgcgccattgccccgtcttcttctgaaccaggactgggttggccagccagtcgggatgaaggacttccttgatgaagcccgctgctaacagcttggtcaattctaccttgatcgcatccttcctatcctatgcgaaacggcggagtcgttgcttgattggtttagcgtcttccttgacatgtaaagagtgctcaatcacctctctaggaataccaggcatatcaaatggtttccacgcaaagatatctttattattttgaagaaaggtgatgagcgcgctttcctatttacaatctaactcagcgcctattacagcagtcttagtaggatcagaaggatctagaggaatcttcttggtcttggtgtcgcttgccccgctctttggcatcttggtcgcaggcacttctccttcgcttgctgtggacgcagccagtcggatttcttctcggtcgagcgtgatctcgcggaactgggccatctcgcagctttccttgtcacacgtgacggcttgcttgatgtcactccgcagggatatgactccttgaggaccaggcatcttcatcatcatgtaggtatagtgcgggacagccatgaacttggctaacatcgggcgtccgagtatggcgtgatacgctgtcctcaaaacaaatgttctctgtgtggaagttctcccaagtgccgaaagtaatgggaagagtgatctggctgagtggtgtagcagatagccctgagatgactccgtgaaagggcgcattactcggctttaattccatgcgagggatctgcatgtcgtccagagtcttgacgaaaaggatgttgagtgcactgccaccatcgatgagggatctgcgaagcttgacgttgcgaaccactgggtctagtaccagggggtaccgccctgggtggaccacacggtaaggatgatccaagcggtcaaacataattgttgtctctgaccaccgaagatattggggcgtgtcgggctgaatagcgttgatctcccgttcggttagcttttgctttctcttggattcataggacaggggtccgccaaagatgtggttgagttccttgcgatggtcttgaaaaccagtcggggcgtcaacttcatcatccttctttaacgtgctttgatctccgtcagaggccttgcgtgcattcttggcgtattgttctgcaaactgtttatagacgaagcaatctttggccgcgtgattggagtttggatgatgcggacattgggagttcatgatcttgtcagaagtgttgacccgtgaacgttgtcgggaggatggtgtagtagttgccacaagttccttgggtttacgcttgcgatccttgtgattggtacttccactcccccctgtagttggcgtatctttcttcggcttccaagtggtgcccgactgcttggacgcggtaatgacatcttctgcttgaccgtcctgggaggcttgcgcccgaacttgccgactaggtcatcatggcaaatgcccttggtgaaggcggcgatgatgacgtcgtcggtgatgtcggagatcttgttgcgttgctcggaaaaacgtcggatgtaatctcgaagggattctccagacttctaaacaacgttatagagatcaaactgtgtaccagggcattcaaaggtaccctggaagttggcgatgaagtggtcgcgaagttctgcccaagatccgattgtgccacggggtaagccgtgaagccaggaccgggcagagtccgctagggccacaggcaaatagtttgccatgactttgctatctcgtcctgctgcgcgaatagcgagaccgtagatggtgagccaagactccgggttagtggtgccgtcatacttctcgattccagtcggcttgaagccggctggccaatccactcgacgcaatttgcttgtgaaggcagcaactccatccacgtcgttgtcgtagcgatctagtgaatggtgggaagcgtattctcttgccgcgcagcgctggttgatagtatcgcgaagatcgacggggcgcctgcgatatgaggagcgaggtcgttcaactcgatgctccctgtgtcattcaggaggcgagtggacagatcgctcgtcgtgacccttactcctgcgactggatcccgcaccgacgacgctgaggcttggttggtgatagtcttgagatcgaagagggggaactcggctaccagtcagcgtgcggacgcttgcagagttaaccgggaccaaggcagagatcatgatcttggtctggttcaagatgttgacgacgtgattggcttgattgagtacgtcttccttgaggagggtgtcgaggagggtgatcgctgcaaccgcgttctgttgaggggtgcgaaaaacagccgttccctcaacgtcttgctgcccgataagttctcgtgctcgtcgcccgacatccaaggcgtgctgtcgccggtcctcagcctcttttgcagcccgttcgcactcctgttgctcacgctgcagccgttctcgctcttgtgcttggcgctcctcttccagtcagggtcgttcggcttcctgttgcacgcgttgttcttctgcttctcgggctttacgctgttcttccgtctcgttttcagccatgaagatgccgaagtagagaggcgtgtagttatcttcaaagtcttagtcgaagtcgtcgaggttgcggtctacggtagccgaagtcgtcgtactcaatgatctccgttggccgtgagtcgacgccgggggagctgaggtagccatccagttgttccgtcgaaaccgtgccgagaggctagagtatgacgccgacttccctggagctaggctggatcgaggtagaggccggatcccgcctagattgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcactaagaagaaaactgcagcggaaaataaaatctagcgaagctccggctccactcccacaggcagctcaactgggatataagccaaacgtcttctccttctggatcctttttcttcaactgaggttgattgattattgcaaagtgagcatatgacatactcagcaagccacacagcaaatatgcaagtgcacaaggataccaaaggatggcataatataggctcatttgcgaaagcagcatttagcaaagagttaagagtagtaaaacagtagagtaattaatcagaaattttaatcaacactgaacagcacacccatgctgtacaggcccaaccatcctgaacaaccatacccggctgtacagatctaactccaaaccaggagctaagcaaattgttaccagttataacatccataattattgtgagaggtgtgggactaatcacgaaaaacattgctcaacccgcccataaccacgggcacggctattcgaatagttttactctggccagaggtgtaccactgtacccacaagacacagcctcatcatcatgtctaccatgcgtcgcgatactggaaagtacccgaatagaggctgtgacaataccctttgcacaacacaactcaccacagtgcaccattcctggatcataatcaccccctcaaaaaccagaggcatggactccccagcgacccccgtgggcttatctccgccacttctcagtctggtgctccgcaatgaatcatgttatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaacaatgagtcataagttatctcaaaagtgtgctaatgtttctaagcatagctaagcaatcatatctaatatctagctgaaccaatatatatatagcccaactagtcaagttataataacccaaggtatcaaggaatagaataatcaatgcaaattggccataacaaaggaatagattcacaccacccaatgacattcgaaaataaatgcacagttgaaataaatagagaatttaagtataggatcaacatgctcaaaggattgtgtttaggatctatgtgacttgtcttgcaataatcggtcttcaattaatcttctgaacactcccgacgcactcacgaaccttcgcaacgacagaaacgacaagctaacacgcaaaaagaagaaaaagactaataaaaaccaaataaacagtacatataaagtaaacaaacatgtagatcatgattttagatgaatttagcaacttgaacgactcaaaaccgagttacgatgatttagttatgaatttccgaagatttaatctattagaaaaacaggaaaaagaaaaaaaaaacgatgatgacgtcagcgatgacctcatcaatggtggccggctcggaagg

SEQ ID NO: 75726 - DNA, 7407 bp, Oryza sativa
acacgcttccgttaaccgtttacttacggtaatttactgcgatgtttgcttgttttgtttggcatttgtactgatcaatgtcttagggcctttaggcatagcttgttatctatcttttttgcttctgagaatcagggttgcgcaacatagcttaaatctctctgtggtctttgtattatatttaccatgataaaatgctctagtagtatagtgtttgccatcgatatgcggtgttaatgctgaatgaagcattgagcactccatgttcgctgttgcctgcctaagccatgtagcccctgatgtttatgtgatcagagctgaaatggttgccaagtaagtgtggacttaatcgtgcaattgaagacaaaaggttaaccatttaactgtggacttaatcatgcgattcagaactgtggaattaaaaccatttttacactgttacttggcaaccatttcagctactgtggacttaatcatgcaattcagtatttcagaagatgcttataaattttggttggcctttctggtcaaaatatgtgcttgctattcgggattgtgcactttctttctatagtagcttctgtactactctgcatcttgtgctcctctttattgctttactggagagagttggcatttacctttcttttacattgaatactgactatatcctcataatgttttatattttctcaacatatagttaaaacacaacagccttttttgccatctttctgctgtcgttaaacttttaaccatgattggtaattcattgttgtacggcaaagcgtgagcttttatctggttattctgttcttttgtaattgtagaatttcataccaatggtgtatctgggctgctagttttaatgctaatttatgctaatgtgatttcatttcttgtgtgcagaaatacctggggatacaaatatttaggttttacttcaagtgtacgaaatgttcagctgagataactttcaaaacggaccctcagaattctgattacacggtggaatctggggctagtcgcaattttgaaccttggcgtgaagaagatgaggtgggtgatccagggcatatcttaggcacatcttatttgtttcgactaatattatattgaaagtgacaatgacgatgtatattccttttttcaggtagcagacagagaaaagaggaaacgagatgaagaggagatgggtgatgcaatgagagcattggagaatagagcaatggattcaaagcaggacatggatatacttgctgctttagaagagatgcgatccatgaaggtagaatatggtctatgggcatctgttcttttttctgtaaataaaaattgaaataagtcggacttagtgtgctgacattgttttcttgtgccttttgcagtctagacatgctggagtcacagttgaccagatgcttgaaattttgaagcgctctgctcatgataaggtaagatctcaaaataattcttttgcttttgtttaatgaatgaacaagtcattgtagcccctaaactatctcaagaatcaatcctcaactatgaaactgtccagcattcaccctctaactcctaaaactagactaaataaccccataactctggttttagtggtggcttttgccatgaggtactagatgcttgctgttggtgccattatgaacctccacctcagcattactcttcatgtacatgaaaacatgatataacccagcaaaatcttctcaactttcttcgctatacctgcttcttgtggtcgtttctggaagcagtagcaaacttgatgttactactcagtaggaaaccttgggttttaggtgttgggagtcgaggatctggccttgtggccttgttgctgctaggatgtagagcgatggtgaaggatcaggggcagcggtgacagctagacctgtggattaggaggccatatcaacgggtgaggtgttggtgttggttggctacctcttctgtcatagatgtttatgatctgcatgacccagcaaaagggagcaatgtagctttgatctgaaccgctaaaataaaaatcatgaattgtcttgttattaattggatggtggatttaatctgcacttggtgaaaagagtcaggaatctccatgcgaataaattgaattggaactagccagatttggaaaacagtacatagatgatagaattgaccttgacgattgagctgatatgcttgccctgcaaccgtatgatattcatggtaatttacctgctgggatgcttgtgctcccacaaccatgtacaccttgtactttaccttctgcccagcagcttgcactctgctcaccggggtttcaacatgctgtgttagcagcattgggactagtaggtttgtcatgtcagtgtgatgtaaaggtgatggttgcttgaagctgttttgttagacaggcaaaggacagcgtgaagataagagagtagaaagaagcagcacagggtgactttttttcctgttattatttaattatttaacttagatatgttttccaccacatagatgccatgtcagcatgataccaggtactccctccgtttcacaatgtaagtcattctagcatatcccacattcatattgatgttaataaatctaggcatatatatttatctagattcattaacatcaatatgaatataggaaatgctagaatgacttacatcgtgaaacggaggaagtagtatggagtggtgggctatcactcccgttctgttttgaagggtgaactttaaacaattctgttgttgagggtgaaaacagaccttttcctttaaaaaatgtttgacataggatagttcaagagggagaaaacataacttttcctttaaaaaatgtttgacataggacttttcatctttttggtaatatttatgatagcttccttacaagcatgggtggccatggtgtgtaatctgcctgcttaaatctcgcattgtttttctaacggtgataattttgggcaatgacaggaggagaaaacagtagctgagctagatgaagaagatgaaaaacttatcaaatcaatcacttttcgagtaatcctctacctcaacttacatacatccctgcatgtgcaaaactgtgtagagagagaagttacttcgtacaaattataaggcatttttttaacttgtgatcctattatttaatgcagaactcccaagattatgtaaaacggatagaggatgatgatgacgatgatgaagatttggtgataccgggccagtcgagtagcacatcaaaggtacttagcactcctgtttgatcttgtaggctccatattcttaacctccagttacagtaaaaatcattggacattagctggcattcacatattaccaaactagccctggcagatccattaggtactaaagcttgctaagcttttatttccatccccctttgtcatttaaactgtaaagtattcagctttttcttaatagacgtattggatttcttaaatagataatacctgcactttgagcactgaagctttgttctggttggaaaattttttagcatatatttttagttattagatttaatgaacagttggagctagggtagaaggccatttgaacataagtccaatgataatggtaaattttggtcaccaagcagcagtattatgcaaattggtagcaaacattggcatagtcatttaaaactattattttttaaaacttaatttaaaactattgttttggagtagacattgttgtagcattttcagaattgcttgtgtcagtctcaagagtttactggtcaattttctatgctaatgtagagttattttcttatgcttccatttgatgtctcttgaatttatttgctttgttgactaacagttctattgttctgtagatgaatggatcctcccagtcagtatcaaatgcaacagatgtcctgaccaagactagtggatctgataatgccaataaagaaggtaaaaactaagcagcatatttgtttttatcatgattatcgttatcctgaattcaaagtgttacattttttccccgcaatttggcagggatcgtgtgttattcccttttcttgattaagcagcgttctattttggaaacaaatgggctgcccgtgttctttatctagttattaccgcgtgttacttaccattaaatatgcactgcaggaaataagatctggccatctaagatgccaaaatttatagtcaagccaaagtctacccctacagatcctatcaagaaacagaagacggaaaccacggctggcccggatactggcaaagcgccagtcgcagaagaaaatagtgagcctgcgcagaacaatgtcctccaatccctctgccaaaactacgatagcgatgaaagtgagtgatgactgcgtggctgcttcgtgccgtaagcccgtaacaaccgtaaccgcgaatcgccaccaactgctgtggcattggttgcagcggatgacaattccactcacagaagaagaatattacgttgtgctaacattggataaccagatccctgaggatctattgttgccacaaatctgaatcccgggaattcattggttaagtatatacagtacttcaaaatctgtggctgctaacattgtccaggcgagatttatacgtgtgtggtttgttgctgaatgcctgaagagatcaaaagtcttgtaaaattgacagggaagatgtttgttgacgttgggttcttgcaccaatccttcatttctacgcctagcttatacacaacacaaatttgaccatgtttagtaattctctcccaaatggattctccttaaatccccttcaaaatctaagctgtacatgaaatgcaattccattcttattttatctcggtttccgttagcactttttcaaactactaaaggctatctgtgtaaaaacatttcatataaaagttgctttaaaatatcaaataaatcacgtgttaatagtttttcgtttttcgtgtgtcaatttaatcctcatcctcatgaaactcaattatcatctctactgctctcatctcagaacaataaactggaagtacaactgaactcccatgaccccctcaatggaagatcttaactaactactcttaactatagtgaaaatcgccgtgcgtacaaacgaggaaaggaaggaaatccagttgggtctccaatctcacgcacgcggccaccaccagaagactacgcacagccgccgccgccgggacgccaccacgctccccgaggctgatccatccatggaggaaaggcccgtctcccaccggagtagttgcacggtcaccgacgccgacgaggatgacctcccgacgcagtggaacaagtggcgccgcgcagccgccctgtctcggaggacccggcgcgcgccccgcgtcgccgtgccggccagcccgacctgcgcctgcggcggccgcatgcgcagggtccccaagcccaggcccatgcccaccgccgtggacgagcgcgccgacggtgcctgcggcggtctcgcccccgtgctgcctccggcggcggcggcggcgtggtatccgtatgatctcatgtgcacggagtgcgacggcgagaccggctggcgccggcggaagccggcgtgctgggcggcggattggaaagccgcgcggccgcggcagcgatggcggccatatccttccttcgccgacgtggccgctgccctcggcgatctgcggctcggcgccggcgacgacgatgatcattccggtgacgttgatatgatctcttgttcgtttcaaaaatagtgtgatcatctcttagggccgaaatttcagtgtcacttgtaccgtagtactactattctatatgtgatcatataatttcatagtagaaaaaaagctactaatttagttgtcctaaactatgaaatatcaattcttctcccctgtctaattctttagtcgtctatcgacaattgttcgtttcactccagttattaggcaaaataaatacatataggttcaaattattgtgccaatcttcctaactaaaatcggttctatattgatacgttatacgatccaccattccccaaaaagagagaaaaaaggaacatagatactgaaaagaaaaagaagatatcaagaacatcttaatttcctttcagatgatctgttgcacgctttccttccacctggcttcctggcttgaatcttgtacaaatactaggtaagtacttatttgcatatttcatgacttgacagcatctaatcagtctctgctaagctcattgctgtgttgatgctgaaaactcattacagcgaaattgaaaacatattatgattcttcaagaatggaaaaaaagggatcaaggatgaatctaagctacagtctgattagaaggtaggaatgataagagtagtgctgacctgcagagaatgtcacccgttcgtgtggttttcccatagatccaatctgggatgagttcttgtcgcaacctcaactgttcttttatctcacctggaaccttatcgatttaggatcagattgcagtatccggatatgtataaaatgatgagcatgtgttataaaatgggcaccggtaaacagtgtctcatgctctgttaagtatgggcttgaaagaattgcagttgaaagaatcattttagggccttttttttttgcctactctattttcttgatcgctaggaatgaattcagaggatatcattcgaggtacatacatctatccactattttagggttacttgtaattatcttgtaaatgagctcttgttttgtcattacagtttgttcccttgagcccttgactgaaagatcagaaagatagtgtcaaaagtgccaggcaagcacgcgatcagcttttgtcttctaaaggtatctgcaaaacctgtttccttttcctccaaacctctcttctccttctgctttatctgcaaagagagagaatatcaggttcggatgccatatgtagagaagcgaaacggaatttcagtaacaagcgagcccgaatctgaaagaaaatgataaacacagtatctttgtgagttaccctgctctatttcaacaaaaaaaaaaaaaactgtccattttattttgtaatcaagtaaccaactacatcttcatagagggtagtataaatagagatatatatatatatagcagaaaccatgatcaatacatgttgtaggataggatccatcaaacagatgctcataattctgttcgtaaattatgcaaagcatagtgtactgatataactttgcttacccacacattgaagtttgaacatcgatcctcttgttctactattcaataaaaaaaagcgtgaatattagggaagtatctaatactccctccatcccaaaatgtttgacgccgttgacttttttaaaaatgtttgaccgttcgtcttat

SEQ ID NO: 75727 - DNA, 1351 bp, Oryza sativa
ctgcagccctttgtctgagtttagtgtctgaccttggcccttgcaggttgtgtaaacaatatactcctgttaccatttaaggttacgatttattctctacaaattcatactaaattcatattatacaagttcatgcttaacaattgatttggatttctaggtatttataaaatccagattattttgtgaacgtgaacatggaatgtatctaaattcagcgtgtggacacagccatgccatgtttctcaagtcagtttatgaatatatccttgcgcacatagtttccccctatttttactcttcttaaatatatattatacgccggtgacgacgacggcactatacccatcccgtggttgaacctcaatggccagctcggcgacatcgtggaccgtgccgacggctcggacgtgccgttctctgtcggcggcgagatgttccacgcacaccatgccgtgctcgccgcgcgctcgccggtgttcaagacggagctcctcgggtccatggcggagtccgccatgccgtgcgtcaccctgcacaacatcgacccggccacgttcaaagctctactacacttcgtgtacatggacgccttgctgtcgccgactagaggcggtgccagctcgacgtcgacgacaaccggatttttcaagagcttgctcatggcggtggacatgtacgcattgaagaggttgaagctgatgtgtgcacagaagctgtgggggagcgtgtcagtggagacggtggcgacgacactaggctacgccgagacgtaccattgcccggagctaaagagcaagtgcctcagcttcttgatggcggagagcagcttcaagaaggtggccttcactgatggctactttcatcttaggcaggatttcccgttaattatcgaagagataaaaaagcggattgagagttaaaaactttacatacatctatatcaatctatactgatataaaaaacaccagttttctatttagtacacccatacattcctaaccgttagatcctctcatccaacgattcacatcgcgagttggcaataatatgtattatgataacgtgccttacacgtgcacgttcattagtgattataaatggagtaggttatattaatgatacttcacatatgcatgaattttatatgaaatacattaatgcataacacaacatacagcatactgccatcaaaatattcaaacataccactaacataaatacaagtttaatcttctaaattattcaatttaacagtacacgctgaatcatcaatagtggaggcagtaacaataaaatgttaaagtgtagcacaaccgctatgttcacttgcctttttgacattaaatc

SEQ ID NO: 75728 - DNA, 28445 bp, Oryza sativa
aaacacttgcattcaatttgtagtttagctcttagctggctacttctatttattctaagaaaaacaactgaattgtacccattttgattaatctgtgaccttttcatgtccttcaaatttcatcatcttctgcatttgttgatctaatacggcccagccacctgttttttttttcattcatagtctgcatgatcatcgcgcttcaccctgagtgggatcgatcctgatctgccaggtaggcctctgttctcgtcgtcatcatggtgctttgcccgtgagcatcgcttgtcgttctttgttgagtcatcgtcaagctgttaacaccaaaatttgatacggttgtttagaggattcagttaaggaaagaagtcaatcaaccgatcaggacttatatcttttcttttatctttaggaaacttgtatcttgtccgattaggactaatatcaacctaagggtataaatatgtacacccgtagactttgtaatctatttccacatatcaatacattactttcggtacattgccaacttttattccggcgagttcttagttttgagcaggtttgcatttgttaagttcgatctcccacgaggaagtaagtttcgtcaacttcccgcgaggaaataatctcctcttcctatactatttaactttggctacaactttctcgtttaagtccaatattttattcaggttgacgcaagcattgtctatctgatatattgattatatctttaactgcattgctatttagagtggtatcggcttagttaggactttctcacttaggtccgatattttgactaagttgatgtttttctaatcgtattgccgttttagatagatcgatgtatcaatcatgtttgtatatatatctattggctaaatatttttttcttgttatcgtcaatcttaaaatatcttagttaggctcgatctgttagattgctactaataagtctatttctactaagccgataggttttcatgcaacgtttcatcggactgttagccgatgagttgtctttattgtgggttagctatcagatataatgattacttagttgatatacactttaatttatttactgttggcggatggcatgaggcccttcgaccaaatctgccgaaacccgtggcaaagactatggagcaagaacggcgcgagacgaggggtcgtgcgagtaccttgtcgagccagaggcgtcccaggcgaagggtgcaaggcgaagagtatctgccgaaggaagacgatttcgccatggcaagttcgcccccgcgagggccgaagaagcctttccggcccatcaagcctaggggctatagggccggcggtcgcccgacggcccatcaggggcccatgaacctccataacattatgtaccccctgtaaatgtccctttcgtaagggtaaccatgtaaattcccctgtataacctaaaccctagtagtaagaacctataatggggctataaatagtcccctagggccatgtaataaggggatcccgaagtaaaaaattctaaaattaatacacttcgtttctttccaaccactgttgagtaaccacgtctttcgacgtatgcggttgtcgtttcgacaacatttacattggatcttcagccaatggatgttttaaccatcctatttacatcacattatattattagttttgaccgattggttcaaattatattatctcatggcatcttctgagttacatcggcttatactcaaacttgtataatcatagttaaatctatatttatcaacttaaatcttatattttttcggtttgatcttatctatcaatattgcttttgacaaagaatgtgtttacactcaaatttggcacctagaggcgaaataggaaaaattgccaagatttgggaatctaccggtttcctccagaagggccgatctaaccgccatgtatggaccactcagactgtggccagagggccggtctgaccagcagagtccaagtcagactccgtttttgtcgggtctcgagattccttgctcagggggctatgttttgggttctttttttgttttctacccctagttagacatggaggagggcctgtagagggcaagaccaacccctatttaatggataaggtcggttcaaacaatgtatcacacaacgatcaatcaatcgaatcgctttttcaatatcgctttctgcttttcacttagctctactttaattcgtccatctttattgatttacgccgtaaatcattcgccttcattgcgagagtgcgaaatcctttgtaggtttgtcccgtaaaccttctgtttgcccacgagacatgtagttattcaccgttttatctaaatcggctccgctatccggtttaatctatcaaaacccaacttgatctagattttgctggtttggggtggttggcgactctacaaatcaccgcaagacgtttaggtgttgcgatcatgcttatctacttgaccaaaaaagttgccaacagaaagcagacgggaagaagaaggacaagcgcgcgagaagatagaagaggcgagccgagaaaacaaggagaatttctttaatttgtacggggaaatctctactattataaaaattgaagatattttcgcggtccgtcatccgtttttgagtcggttataaaaattgaagatgtttctgctgttcgtcattcgtatttgagtcggttttaaatttatgttttggttttaacctatatctctgtctctgctatttaaaaaataaagatgtttttgtcgatatttttatatgtcatctgtgtatgagtcggtttttaagtttacttgctttttttgaaaataaatatccgtatttaagtcggtttttaagatcattcacatgcattttttttatagtaatagtattataagtataaacacagtagttaagacggagccaaacacagcagagccgtcccgatctaatcgaccgagcccaaaactaaccctaaattccccagctccccaccacgccgccgccgccgcctccatgggccgcaaagatacttcctcgtcgtcctccgccgccggcggcaagaaggacaagccgatgtcggtctccgccattctggcctccatggacgcgccggcgtccaaggccaagccatccaaggcggcgtccaagcccaagccctccaaggcgcccgcgtcgtcttacatgggcgacatcgacctgcccccctccgatgaggaggaggacgacgccgacctcgttgccatggccacgaagcccaaggcggcccgcgccaccgtcgacctcaacgccatcgcgccctcgcagaaggacgcgaagaagaaggacaagcgcgaggcgatggcggccgcgcaagccgaggcggccaagcaggaggcgctccgcgacgaccgcgacgcattctctgtcgttattggcgcgcgcgtcgctggatccgccggggcctccgagggtgactccgccgccgccgatgacaacatcaaggatattgtgctcgagaacttctctgtttctgcccgcgggaaggagctactcaagaacgcctcgctccggatctcgcacggccggcgctatggcctcgtcgggcccaacggcatgggcaagtccacccttctgaagctgctgtcatggcggcaggtcccggtgccccggagcattgatgtcctgcttgtggagcaggaaattattggagacaatcgttcagcgctcgaggctgttgttgctgctgatgaagagctcgcagcgcttcgtgccgagcaggcaaagctcgaggcctctaacgatgctgatgacaatgagcggcttgctgaggtttatgagaagctcaacctccgggattctgatgctgcccgggctcgtgcatccaagatccttgctgggctggggtttgatcaggctatgcaggccaggtccactaaatcgttcagtggtggctggaggatgcgcatctcgcttgctcgtgcgctgttcatgcagccaacattgttgctgcttgatgaaccgactaatcatcttgacctccgagctgttctttggttggagcaatacttgtgctcacagtggaagaaaacactgattgttgtgtcccatgatcgcgacttcctgaacacagtttgcaatgagatcattcatttgcatgataagaatctgcatgtttatcgtggaaattttgacgactttgagagtgggtatgaacagaagaggaaggagatgaataggaagtttgaggtgtttgaaaagcagatgaaggcagcaaagaagactgggagcaaggcagcgcaagacaaggtcaaaggtcaggcactatcaaaggctaataaggaggctgccaagagcaaggggaagggaaagaatgtagcaaatgatgacgacgacatgaagccagctgatcttccacagaaatggcttgactacaaggttgagttccacttcccagagccaactttgctcacaccaccgctccttcagctcattgaggtgggcttcagctaccctaataggccagatttcaagctgtctggtgttgatgttggcattgacatgggaacacgtgttgcaattgttggtcccaatggggcaggaaaatctacacttcttaatttacttgctggtgatcttaccccaaccaaaggagaggtaaggaggagtcagaagctgaggattgggcgatactcacagcattttgttgacttactgacaatggaggaaaatgcagttcagtatttgctcaggctccatcctgatcaggagggaatgagcaaagcagaggctgtacgtgcgaagctcggaaaatttggtttaccagggcacaaccatctcactccaatagttaaattatctggtggacagaaggcccgtgttgtgttcacttcaatatcaatgtcacatccccacattctcctgctggatgagccaacaaatcacctagacatgcaaagtatcgatgcattggcagatgcactggatgaattcactggtggtgtggtcttggttagccatgactcgagattgatctctagagtgtgtgacgatgagcagaggagtgagatatgggttgtagaagatggcactgtgaacaaatttgatggaacatttgaggactacaaggatgaacttttggaagaaatcaaaaaggaagttgaagagtaatgtgtttttatagttgcaggatactgcttattctttatagactgggctggtaaacttaatgtactagtacttattttctttggtttgcagagtatttgtatggttgagtccgaaacacctattcgagctgttcttgctttttgcatgatctaagaggttccaggatgagtctgataaatatgttttctatgattttgctgccaattactctgtactaagacttccatgatatacatccataataattcagtatgatttcatgttattggctcatataattaatattatattatgctcagcggtactttatgttggtcagattaatccaaattattatcaaattcttggtcaattagttcaatatatggttgaatgcctatatgcttatggatggaatgctcactgaacaatcatatggaactgcagcactgaattgaaagcacactaaatgtgcgtactgaaaccatggtaattgaaggacaatgttacactgctgattattgaaactctacatcctgcagcttgatcctgaaggactttatctggttattatcaccgtatgccttactgaaaacatgctatatctaactactgaaatgttcagctattgattgtgtcacaagttgtactgctaattaactaagctacatgctatgaatggcgatttaatgccataccgatacggattgctctggatggtttgttacaagacctatgatttctgcttaatggttcaactagaagatctgcacgcctgttggcgtgccacctaatttagcatgtaatatggctcatctgtaatatatatagaaaatttgcctacctctcattttatattatttgtaactctagcaaaatttcacatcaaacaaggagatgtggcaaattacactgatatgcttattaactacattataatcgttttcaaaagcaatattaactttgattgacagttatacatggcatttaaaaggtgaagatagaagaccacgatctaaaaataataatttgaaatgtgagaatgaccagtaatattaaacatgcagagtaatatattattacatgagtaagtttaactctgaaaaaaattctttcaaatggacatgttaatggaatttaattttatgtttgtcttagaattatgagaaaaaccaaagtaagattgtaattaatgatgatcaataatttggcaaatagctagactctattagaaaatttaaagttatgtttcctcaaaattgttgtgatttcattaaccaaaaagtcgtacatatagtatcaatgataaagtgcatatttgaagaaatggttcttagtttatatttgaacaaattctcatccaatctctttcactttatatttgatatttagtttttcccgattattatttattttatataaatacaggatatcaatattttatgttttgaagattttttttacaaaattatttatacttttctctaccttcctttttcctacttttgtttggtcctgtttgtgttattactaattaattagcccgagaaggtaaagtgcaacgtgcaaatgctgtagcaacaacgctagatgaccaggcctagtgcagtcatgcatgactgggctgtacagcccatgacaggcgggatggtaattttgccaatgggttcgggtatccacggatacccgatccaatgggcacgggtgtgggtgtgattttttacctgtgggcacgcctacccgagacccgcagacatcgtgagcaacagccgagtttcattttttatctgtgggtaacccatgcccgacccaattcatatgtattagctaatttcgacttatctcttaattcttatacccctttctcttgattcatttgtgatactaactactaataataagttgtgacgtaattcaaattattgttgatagctgataatttgataaattgttgattttatttctctttgttaaattatatatttttcgagtattattcatgtgagatccattgggtacccgctgggcatacccgtgcccgcatgggtacgggtacagagttttgcctgctaaccctagtgggtagggtttgggcgggcgacgacgggcatggggtcgggcatggttttgctctacccgtgcccaacccgacccgttgccatccattgacagccagtgaatgaaccaatggcttttcttttctttttctttttctttttcacggtccagtgtccggactaatcgagagggctggacgaatgaaacatgccacgtggaccaatgaaacgctagaagaatggctagctttagattaatagaagagatgagacaattgcacaatcgacgctctagctgaatctcacgggacacgtggctggttttcaaaggagcaaaccctaaaatcttagggagccacgtggcccaatcatatgcttgattttttaccttgaattcggtatattagataagatttgattcttttaatgggacatgctgctatgtggtctttcaggcttaaatctgaactactgatgccacttgaactgctgctaatttcctgaggttaatttatcaaggtcacaaactaattctaactaggtcataaactaatgataactattcctgtataaggttcatcctgtagggtcttcattagaatcttacatcatatatactagcttatgttgtcacacatttgcgcgactcttgttacgtgatacgtgagtgtcaatcaatctgttgtttttcttgttgctagtaaaatataatcaatctgttgtttttcttgttgctagtaaaatattgggtcaggatgagtcatagtattatgttggtaaagtagatggcttaatatttattgtaaattttaataggtatgagacatatgtatcaccctttattcttcacttattttctattagtgcgtacccttttgtgactcattgtcatatattttgtaggtttttaaggattagtttaatttctatttttaaatttgtgtgaaaaatcattaagcctatattcaggtgaccatgactcattattggaaggaatatgcatgtctcagtagcaattttttttctcaaatacattaacaacaaattgctagaaacaaaaataatcacatgaacatacattttgaatatgccctgaatagctcaatcttgactaatgaatatttagttaagggaatgagggtgccttttttcttccttcatttctttctttccacttctagtagcttcatctcctgaagtctcttgaatgtgttcttttgccatcatttaatccaatggtctaagattcattcactcttttttgtcttgtagtaagttcaatggctaatatttaccaaataatgtggctcattctcagtccactttggatgtcacttttcactagttaagatataaatagctgtgatgggctatgagataatgagatgtgagacggcgaatggaatatggagggtttgcatagggattggggataagatctgggcccttggattgtgaacctatgattcaagatttggaagattagagatccaatttattgtgaaatttatatcctctatgttcccaaatataagcaaattttaggattcaaattttatacacaaattgtttttataggactatgattccaatacatgaaaataaacattttcaaccaaatattccgtttgtccaaaaaaaaagaagtatgattggatgtgacgtaatctagtcctcgagccccgacatgatggtcagggtgggagacggggattgatagagaaaataacgtggagctgagacgggtggtggaggggggaggtgtgaagttgtttaaataaaaatgaaggggtcgagtgggctgaagttgtttgtagcgcatctgtcatctgtctcgctcacaatacgggatgtgggtgttgggtggtgccgttcgcttgtcaccaaatcatgccatcatgatcagtgagaaggtagctttaaaatagggagtttataggtagttttgtctgaaatgatattatagtgataaacacaccatttgagaataatattttgataaaaacctaatatatcaaaggctaagggtgaatgcgtttggtagaggggagattttaggagggatctcctcttgacctggataatggtgagttggaaaggatttcatcctctaccctatctaaataaatcttagcactatatttttatttaaaaatacatagtctaaactcaatattatttctaccttctaccaaaaatacaagattaagattgaaaaataaattttcgtaacaatcatacgatcaatttcctcataaaaaactcccaatcctcgtctcaatttaccaaacaagcccatgcatcaaagcctccaaggcaggcgccaaccccagcccgggaacatcttctccggttctccctcaccgctcactggctctcgtctctcgccgccgccgccgccgccgccgccgccgtcttgccctcaagcatccgggttcgccgatcgccccacttctcccttcctccctccgccagcgccacctccgcgctactgcctcctccctcctttctcgcgcccgcgcctcctgaaactgggatcccccaatggcaatggattcaagtattcaactctctctctctctctctctctctctctctctctctctctctctctctctccgtgaacattggggccgccatttgccaaagatataagcccgagaggttcagcttctcgtagaagctaaggctgtgatgcgactgggcggatggatgctccggccactgaaccgcggcctcctcctccccaccttgtcatgcccagttgccccacaccgccgtgggttcgcagcctatgcagcagcgctacagtggctggaggacgagctcacctcgctcgcgatcctcccctccgtccccggggtggactccttcgcgtgcgccaggcagttgcagggctgcatcgctcgtggcgacgcccgcggcggccgcgccgtgcacggccatgtagtgcgccgcggaggggtggggcgcctggacctcttctgcgccaacgtcctgctcaatatgtacgggaagctcgggccccttgccagcgcgcgcaggctgttcgaccgaatgcctgagcggaacatggtgtccttcgtcacgctcgtccaggcccacgctcagcgcggtgattttgaggctgccgcggctctgttcaggaggctgcggtgggaggggcacgaggtgaaccagttcgtgctcaccaccatgttgaagctagctattgccatggatgcggcagggcttgccgggggtgtgcactcatgtgcgtggaagctgggccatgatcacaacgcctttgttggttcagggctgattgatgcctactccttatgcagtcttgtcagtgatgcggaacatgtgtttaatgggattgtgcgtaaggatgctgttgtctggactgcgatggtttcttgctattctgaaaatgattgcccagagaatgcctttcgggtcttttccaagatgagggtgtcgggttgtaagcctaacccttttgcactaaccagtgtgctcaaagctgcagtttgcttgccatcagttgtgctaggcaagggcatccatggttgcgccataaaaacccttaatgacacggagcctcatgtcggtggtgctttgcttgatatgtatgccaaatgtggggatattaaggatgcacgtttggcttttgagatgattccctatgatgatgtgatacttctgagttttatgatatcccggtatgcacagagcaatcagaatgaacaagcctttgaactgttcctccgattgatgcgttcttctgtgctgcccaatgaatatagcctttctagtgttctgcaagcatgtactaacatggttcagttggatttcggaaagcaaattcataaccatgctataaaaataggccatgagtctgatctttttgttggaaatgcactaatggatttctatgccaagtgcaacgacatggatagctcacttaagatcttctcatcattgcgagatgccaatgaggtgagctggaacacaattgttgttggcttcagtcagtctggtttgggagaagaagcattgagtgtattctgtgagatgcaagctgctcagatgccttgcactcaagttacatactcgagtgtgctccgggcttgtgcaagcacagcatcaataagacatgctggtcagattcattgttcaattgagaagtccacatttaataatgacaccgtaattggcaattcacttattgatacatatgctaagtgcggatacattagggatgctctcaaggtatttcaacatttaatggaacgcgatataatttcatggaatgcaataatctcaggatatgcgcttcatggacaagcggcagatgctctagaactttttgacaggatgaataaaagcaacgtggaatccaatgatatcacttttgttgctctgctatccgtctgcagtagcacaggattagtaaatcatggattatctctgttcgattctatgaggattgatcatggcatcaaaccaagtatggagcattatacatgcattgttaggcttctaggacgagctggccgtctgaatgatgctctacaattcattggagatattccttcggcaccatctgctatggtttggcgtgcattgcttagctcttgtataatccataagaatgtggctctgggaagattttctgcagaaaaaatacttgagattgaaccacaagatgagacaacctatgtcttactatcaaatatgtatgctgcagctggaagtttggatcaagttgcccttttgaggaaatcaatgaggaatattggtgtaaggaaggtacctggtcttagttgggttgagatcaagggtgaaattcatgccttttcagtgggatcagtggaccatccagatatgcgggtgataaatgcaatgctggaatggctcaatcttaaaactagtagggaaggttatattcctgacattaatgtagtgttgcacgacgtagacaaggaacaaaagactcgaatgctgtgggtgcatagtgagaggctggctttagcatatggccttgtgatgacacctcctgggcatccaataaggatattgaagaatttgcgttcctgtttggattgtcatactgcatttacggtgatatctaaaatagttaaacgagaaatcatcgtgagggatataaatcgcttccatcattttgaggatggaaagtgctcatgcggtgactattggtgatcttctgttgttccttgatgtgttaaaggaatccatacaagttatatgtgatataatgtgtttggcaaatggcaatcttctaggaaaccaagttatcatgcatgctctattgttttgggtaacatggttttgaacttgaactcgtgcaatttcatgctattttcaaggcactggagaagagatatcatatcagactgggctaccattccgaaaaaaaaaacccattcatttttaatgtttagtgttacctaagcacattttcgttattgacttgaatactagtgaatgtcatctcattagcaatagaaaaccttatggctgaactgaattggctgatatttttcgttctctatgatttcatcaagttggtagatagccttttgtttaagtatgttctagtgactgcattggaaaattgacacttgcaccggccttcgtattgatagtaattagcatagttcatgctatgacacaaacattaggccatgcaagtggttttcatgaaagagctttccattttctaacgtttatcttacatagttttgttagaattgtaggggggttttagttataataaaattggcagcgaacctacaattaaagcatcggttgattttcttgagttatagttaaagcagcaaacctataattagttatatactttgagttgtttaaataaatatcgtttgattttcttgtgccattgccttgacatcattgtgccgcattatcagttcagtcacacttcacactgactaggtgatagcgactcttctagcactagctaatggggatattaagtgtaatgcaccctgactctgcttgctgtgggagaccaggagttgttttatttttctgatcttctcaagattgtggcaaagcttgctaaaggagaaggaaaaataatttcttttgcctatcttatatgatataaactgcttgcccttgttaaaataaactctgttctgcaggtgatagttgggcaaggcaaccataagggtaaaatgcagcctttggaagtgaaacgagcttgcctactggcttattcttaggctatataaccttctactacctccttatggaagctgagggattgtttgtgccggatcatcctgtaattgctcatcttgtagagatgaagagtattgtagaaaaggtttgttttcttttctacaacaaccttgtttctttaatttgtatattttctggaaggagttaatgcagtaccaatttcaattaatactatgattttttatcattgagttgattgcaaatatttgaataatatctgatattaaacgtatcattaaacaggccaatatatcttccaagacaacaaggagacattaatgactgttgtacgcctggtagcagtaccatggatgtgctagacaagataatttttttggacaaggacaatttactagtacgggataagataaaaataggatctgttcttctttactttactataaagtacaaacatgataattgaagtattctggtaactcatcatgataatttttattcagcgtgcggaagttgctgaattgacaaagaatgaccattctaataaggcttagaatgaaattgacaaaagaaaggacaaggttgaactgaaacaacacttttgatatattttagcattttgtttcgaaaataatgcagatgcacaaaagctgaacaaatattaaaattctaggatgagcatatcagctcacaaagccttgaaatgttggaagtatgagcaacccttgaagaaaaagggctctataatttcacgcagttgaagcctgagaaggtttcaaacaccaggacaactcctcataggtgagtcattagttgtgccatctctttctcttttaaacgacacatttaatatatttggatggttttagcttttaaatgcctttttgttaataattatgagatacctgcaaatgttggatgattttgatgatgatgttctcagaaatagacaagtaaccaaacctagcaaggtcctggtagcagtggtaaaatccaataaaaataaggtctgtatacatttttttaatttttttccacctttctttaataattttatatttggttggcttctttcttagtttctacaatttcttaaatcttgtgataacatgtaagcttgaaatgatttaaagtgtgccaatctaaccgaagccttctattgagatgatggaaatacagagctacctccaaaactgtagaaacaaaagtacttatgccatgcatttttttagagttactgtagaatattgatgtataggtagtttactgcaatagaggttcaaatatcatacttctatcaagttacccaatttgacaaacatttttttttaaatgtgacagtagattttggtccctggccagtggtctcagatgagaaaactgctatttcatccgtcacaaaatgtaagcattttttaggtgggcacgggtattaaagaagtacttcctccgtttcatattataagactttctagcattaccacattcatatatatgtctagattcattaacatatatatgaatgtgggtaatgctagaaagtcttataatttgaaacggagggagtaggtgagaatgattcgaggaatattgtgattgattgagaagagaaagtagatgaagaaatcaaatgaagaaaaatggttgtgattggttgagagtagggtaggtggaaaaatagctttcattttgggataaggtattgtgctagaaatagctacatttcgggacagaggtaacaaaataaaatctttgacatcagtttgttcagaatgatctgagaagaaaactgcgagaaaacgttgcttgagtttgcaattaatgttgtatttctgaggcagtgagatatctaggtatacattgccaaagtgtagtaggacttcacaaattgacagaagagaactgaaattttgtataagacctggtcataattcgtgtccattcttgtgaatatttgaagatatctcatccttgaggaagcgtaataggaatggactctgctgcatttggtgccttttgtccttgaaaacttggtttagctatgtactagctagatctaataattagctttctcaaatatgcagtaccaaaatatattggatattttcttcttgtattatttcaagtcattcctctaatggttgtctcgctgctatgctgttcttgcagagctgatgtgctaatctgtcatattaactcaataacatctgcgtgtgcataaattgtgttcaatattctttagaacaaaaaaaaatgtagttattcttgcctggttagagatagtctgaaatatgtaattgggttacagttttttaaattgctggtgaagtggtgataccgtgatatttcttcatcagtggtagtgtctggttatcactgccatgctcttgcatacaagataaactcttctttggtgtatgttatttgtggttgtgacagttgcagctgtcagatactcttttctgctctttattatctgtttatgtatctccagttcgggtatagtctttttctttggaataaaaaatgtaggcacccttttctggttagaggtatgtctgaatatattaagtatcttatagctttttggcaaaagttgcagttttgaattttatggtggtgttaagaaaagtatcaggtctttgtgtctgattcacaccaggccactactattctcttgcataggagtacctatttagcacatgcactttggagttctggatgtcaaatgcctacgttaattgtggttacgacttatgacagttgtagacttgcaccagctgcttacctctttcttttttttaacctgctatgttttcaagtttgtccctggtgatgatgagcttccaaagcgagataatattggtgaaagacagtgaaaatacgaactacatgttcttgccagagtagaagctagtacacttgaagaagatgacttgcccaatgaagatgcccatactgaagggaagcttaacattttcaatccaaaacaacaggaacagaaacatttccatactgaagtgaagaagatgacaatgatgatgacattggaccatcagagtacaaggacattaaaaagcatgactgaaaaactcgagcaaagaacagaaatactcaccgtaagttccattgataaaaacttatgaagattgattgtttccgatcaaggttcttttggcaaggggatggacacaaaaggaaatatagactagcaaggtgggacatcatatgtcgtcctaaagaccaaggggggttaggaattcaagatcttgaaattaagaacaaggctctccttagcaagtggttgcataaactactcactacagatggtgtgtggcaacaaatgctaaggaacaaatatttggggtcacagcctttgtctcaagctcagtggaaagcaagagactcacacttttgggctagtctaatgaaggccaagcttaattttcttaggtttggctccttcaacatcaaagatggctctcaagttcggttttgggaagataaatggttggggaatgcctgtttaagggaacaatatccttgtctctataacgttgttaggcataaacatacaactatttcagaaattttccaaaccagtcctctaagcttttcttggcgcagggaccttactggctttaagttagtggcatggaatcaccttctctcacgcatcgctaatattatattatctcacgaccaagatgagtttaaatggaatctaaccactgatggcagattctcggttaaatatctttatcttgcgttggtgcagaccgatgtcccaatataaacaaaagaatctggaaaatcaaagccccctaaagattaagatcttcttatggtacttacgtcgtggagtagtcttaacaaaagataatcttattaaaaggaattagagaggaaacaagtcttgttctttctgccacaaagatgaaactattaatcatttgttctttgattgtcgttttgcctgcacagtttggtctataattcaattttgcttcgaatattagtttacctaatagtacaactcatatgtttgggcattggataagaagacaaccacgcaatttgagatctttggtcttattaggggcaactaccactatttggtctatttggctttgcagaaattatgtggtttttgaaagaaaaaacatatcttctcctttgcaggttatctttttgattacacattggctccgcttatgggctatccttcagaaggtcaatttgcggggtactatcattgcggcttgttaacaattggagctagtggccatggagttttctaccccggtgcatgggtggtgttctagactacggttagagggctcctgaagttctttttgtccctgctatttggatgatgagtttatcttttgtttctttcttgttggctgtgtgcactctttgggtgcagaagccggaggtgctcgcagaataattatatcacttgatagagttttactaagattaataaagcttccattatctaaaaaaaatacttattcgttgactgtattacagaaaccccattactcaaccgctggaggaagaagctgaaggaaattggcaagaggaagatctcataccaggttaatcctccactagtgtacggtacaacctttcacaatttttattttttttatatgtgtggctaattaaatctaaactcctccagatagagaagaaaggttaacctgcacaagaacaaaagcttaagaatccatggaagatagggtaagtaataacataatatatgagacagccgagctatgtgagcaagtcattcagatgcactcgcttgtgtgtatgatcgttcaagctaagcatcaaaccaagcttgtttagcggggaggtaagtgcgtggcgtcaaccgtggggtgaatgtccggcatcaatccaaatgttagccatagtgttaggtttaaaggttgatggatcctgcatgatgaattgattatggtctaacatgatatttctttgatggtacgtagttttcttgttaagaattttttgagagatcgcacacatgatatttggaggttcaacgtcatgcattaaaaaattgtgttatgtgctatggatgcttagttctcactggtggagaaacctcaattgtcccagtttacaaccccctatatcccgggttgcaaaccgggacccccaaattctagactaaagatggtatctttagttccggatcaaatttgatcaagtttatagacaaattagttttattaaatttataattgaatattttttcataatatatttgttttggattgaaaatgttaatatttttttctacaaacttggtagcagtttgactttgaccaaaggcaaaacgacttataatctaaaacggagagagtagtttatatgggtttctcattgttttgataccctaccgatggagtagtgcaagtgtagaaatttatggagttaccgaaatttggtagtggtaaggttgtgatagttgcaggagaaaattaacaaaatcgaaaagatacgtagtagataaactcaaaagataggttcgtattacacccattacacccatcaaaagataggttcttttttttttaaaaaaaaacaccttaactatggaactggacattttaaatctcaaccattcaaaccaaccaaattaccttcctaagaataaagtggcattcataattttggcatccaaatgtattagtttttctacttagatttaactactttttatatcttttctaactaagtgccatataagtacgaaaaatatactcgctctgttccaaaataaaataaatggattcctagaatcccaacaaaactttagtagggaggaaatgaccatgcacctggtggtaggtagcaagggataaagtttttttatttgcagatcgggggtatgtaagaaggtaaaaatcaatttattttgggacaaaatttttaaactttaggaactaatttattttcggcttgtttgataacttgagggaaagagattgggagtttacatgagggaattgatgatgagattaagatgggaatttgatttttaatcccaatattttgtttggtagaggtgatggaaattgatagggagtttagttggagattaggtcattaataaaaacggatggctgagatttgcttagacaaagtaaaggaggaattccctcccaattacctgcccctacccaggtattgaaaatgaggtattgaaaaggagggggttccttcctcaattccccatccccatcccaccaaaattcccatgtctcccaccaaataaaacacttaatagcctcatttttctatattcccaatccctcctaaaaactccctccaaccaaacggaccgtttgggatggagtcgaaaacggtcggaaacgatcggaatcggcagcatcttttcagaaacgatgctcgaccggccggtaattgaccatatttatcatttaaactactcagtattgacattaatacggtgtagaaagaattgtgaaaaaacaacatttaaaaatagccaaaaacggtatggtcagaaacggtacctcttatatggaaacgacgctcagtcgatcgggaatttccatgaccgttttcacccctagatagagtataatatttggatcttaaaaccatgaaaccgctgttaaaattgggttttgttgccatttgtgtgtgtgcgcgctcatactttcggaaaaaattttaaaaaataatttgttggctatattgttggtactatgaaacagaggatcgaaatcaaaggtacttgctatactatcaggttctctcatcaagtatcaattaggtttttttctatattttagtaataaaaagttaataaataacaagaagacctctcttttagaaactcaattatattatgtttcatgatttaataatcaatgatatgatattatttaaaaaaatgtaggctagttttttaaaaaaaacaaaattgtaaagtagtagtaaaatcttgagattggtctatattacacccttaaactactggttttgtttttaacaacgaaactagacattttacacccctcaaccaccaaaatcatccaaaataccctcccaaaagtaattttagttttgatagtgtttcttacaattttactaccgattcaacttttctactatatagccaagcccagccaaaagattattatacacacccatataaaatcatgagtaaattgcatattgggctcagtattattaccaaagttttactttgggcaagggtatagcctgcattttcactttggactagagtttctttcctttggttgcacgttgggccacctttctcgtcggccggccaggcactgcgtgcatcccaccattgctggcagtggcaggctccaagggcagccattattgttgctgctgcaaggtgtgaggatctcctgcacatgtgtaggaagaggagaagctccgggggacagccatcagggtggtgaggcagaggagctcgtgcacagcggctgggatggcagcaccggcgacgctcgagcttgtggtggagcaaacggagtttaactaaccttgagggcgagggacacgattccttttgcatcatccggtcaggtccattggggattggaggggattatcgcaatagatgtagaattaatcctctccaaatccccctcaatccacttgtgggagggggccttagagggaagcaacagcaggttgcattctcatgcatggaggagtaggagcaagggggcggaccgcagctagaatgatatggagatgaggagctcaagcaggaagccatgggaggctcgtgggagttttgagttccttggccatgaagcgcgagctcgagctagcccagtatctcttcttcgtatcaccaggggacacccggcttggcattctaccccttgtgcaatgctgagcagagcagtgatgtgctcaagcatcgtccctcacttcctccccaagcagtcttggatctagaccacgggcgaggagaacggcagggattggcggcggtgtgatgaattggaagcagagaatgcacggctggagagattgagacatggggtggcctaaattgcaacaaaggcgatatttcctagtataaagtgaaaacattggctcttctcttgtccaaagtgaaatcttggtaataataactggcccaagatgcaattcactctaaaatcattgtcataactaatactaggtgacacctcatgctttgctacaaaatgtatggataaatatgttaaatattatacaaatgatttatgttgaaataatatgaaaataatgtgagaaagatgatttgaaatattgtatgttgagttccataatattatattctagatgatgtgttatttttgcatgagatttaagatattctagtagaatagtaatagctagtggatgatgaagtgacatacttgcatgtaataattgctagtgagtaccaactatatatagaaggtatagatttgttgatgaacaattgaatttgcaaatgacttatttaatggaaattggtttgaaaatatttgtcgatattggtgtaagtatgtgtgattaacacaaatcggattgcgatatctataactagaaacaatttgtgtgcagatgattaaggatatttttggtcaattgcggtgatcgggactagcatggataaaatgtcatatgacaagattgaactaaagtcatgagacctcatggtcaatctcggttaacagcgggatgatgactacgctcagagaaaccgaggtttagatcagtcaaggatactaggtgataattttggacataagatgacatgagggtggacacatgcgggggaggagtctgacacagtacgggtcggtctagattttctatctatggctgcctttccggagagagggttttgaatttgggaaattgtaaaaattttggataccaagggattgagttatagtgtaaataggagttttcccttaaaagaagtgtaaataggagcttttgtgatggaattactagttatagatagacgagaggtttaactcaacacatggataagcatctagagttagagagaaaagttagggttaggattaaaaggggggcgattgcatttttgaccttgttttgaattcaaactactaatttgactctacttttttaagtttgctcatttgaccctcttttttgaaaatgaaaatcagatctgaccctcttttgtgaatgcaatgtaacggtgttaacttaggtaaaaaaagacgtttacgcccatgcttatttgaccatattttttctcaaagtttttgtttatttgacccagttttctactcattatatatgatgaatttgaactaggtatgacatatttggcttagttttcatttgtttgacttagatttgaaagcattttaagaaatttgacttagatttgatatatttttgacccatttgaattagtttgatatatttttgatagatttgacttagatttgaaaaaaaaagtgaacatacaaaaaaattgacagcatttatttatacgcatacatccgtcccgattaaatcatttctgtaatatttaacatatatttatccatacatttcgtagcaaagcatgaggtatcacctagcgacaatgattttatacgagtgtctataagcttttggctgggcttggctatagtagaaaagttgaatcggtagcgaaattgtaagaaacactatcaaaactaaaattacttttgggaggtattttggatggttttggtgattgaggggtgtgaaatgtctaatttcgttgttaaaaacaaaaccagtagtttaagggtgtaatatagaccaatctcaagattttactactactttacaattttgtttttttaagaaactagcctacatttttttaaacaatatcatatcatcgattattaaatcatgaaaaacattataattgagtttctaaaagagaggtcttcttgttatttattaaattttattactaaaatatagaaaaaacctaattgatacttgatgagacaacctgatagtatagcaagtacctttgatttcgatcctctgtttcatagtaccaaaaaattattttttaaaaaattttctgaaagtatgaatacacacacacaattggcatcaaaacccaactttaacagtggtttcatggtttttagatccaaatagtatactccatcccaaaataatgtagttcctaaagtttaaaaattttgtcccaaaataaattgatttctatcttattcctatccgctatcctattcctatcttgggccttcttttcatctgcctacgtctcaacactcaggccttcagtttcttttcttcttttttgccccatccctttttaaatgaacaaaaaatttaatgtttatattaaaacataatatagattaataatacgaatctttctaaatatttgtaaatattttgcaaaataaaaacgatttgaaaatgactagcacacgtcgctggttatttaaaaagacaggtgattcctcgcgctttgctgcgggaattactaagcaattctcaatatattttttcgacaatcaagttaggagtaaaaaggaaaaaataatgaaacatcagggcttatcagtacttattaaaaaaacaaatgatactcgtactttaatgtgaaacatattaataagtatacattaaatattataaatttattagaatattatgcaaatgatgtgagggatgattgttggatatgcttgcatgaggttaaatatgtaattattgctagtgggtgatgatgtggcatggttgtatcttgagttttagacttagtgggctataactttatataaagtatagatagggagtatttgttattatttattagttacccatacattagaacattaaatttaaaaggaattgtgcgacaattctaggttatgagtggtaatgctcgtttctagggcaagacaatctcaacgatccacttccgaaagtatgttttgctctccgttgatttttcggattttctgaagatggctctcaaaaattccgaaatcacaaaaattcaaaattcggtactgatgtgttttcagatatgttcaaaatgaaattttgtaatttctgaaattcattttagccctgtttttggagatttatatattttcaaaaatgatttttggaatttttgaaaaatggaatctttggttccaacgggtagatctaaggttgtggttataaatagtttcctccactctcaagttttggctactgctccattgaatatttcatgccattgacttacattgatttgagatccattttgagccttgttttctcactttccctctcctccgcttcaagcttggatttagtgtgtgtgaggagttgtggttttgaatatgtatgagtgcttggtattgacttcgtgaagatttattgagcacttgattcatccccaagagatctttgcatcatcttttactcttagaggttgagaacttcttgacggctaggtgtcattcttaaggcaccgatctaattgtggtttgcctggagaagtttgttaaggtcagacctcacttccgaaaggaaagagataccactagtgaaaggagtgcatttgtacaaacctcaagaggaaagggttagtgaagacccggctctttgaaagctcctcaacggatagtagaatccctgaatgattcaaacttcgggaacacatcatcttgcaagaacctcggtgaaaattccctctcttcctcctctagctttgcttacttgtgccgctactagtctggttgctgttagtgcttgctctccatacttatggcttgctagatcttgtgcatttcgcttgctttgagttttttggaatttcctaaagtcattttcgaaacttctaaaaagttcagcttccacatttaattaaaagatttaagtcacctattaacaccctctaggcctaaatgactcttttaatcgggacaattgcttatttgaccctatttcgaagcctaactagtaatttaaccctacttttttagtttgcttatttgaccctgcttttcaaaaacgaacacaccgtttttccctgtttccacagcactgtgaaggtttcattttaaaataaaagaaatataattacttttcgtaatgaccagaatacccttgaagcaatcctatccattcagattatccctatccattcatctctcatatcacatctttctctcccccggctagtggcgcagtgacgtacgaaggggagtggccgtggcggcggctcgtggagggagggagcggcggtggcggcgggagggatttgcggcactaccagatcgaggccgcccgacgcggaggatgagggccacatccatcccaacctcttgctattctagatgatgtgtcatttctgcatgagatttaagatattctagaatagtaatagctactggatgatgatgtgacatacttgcatgtaataattgctagtgggtaccaactacatagaatgtatagatttgttgatgaacaattgaatttgcaaatgacttatttattggaaattagtttgaaaatatttgtcgatgaggagcatacaaagagctgggtcttcactaaccctttcctcttgtggttgtaccttccactagtggtatctcttccctttcggaagtgagatccaaccttaacaaacttgtctagtgtcacgcccagaaatttagcccaaatttccagactattttttgtattaaatccctgtccaggaatcagccaagatacacaaaacgacaagtaataaacagttccaaacgtaaataaagcgtaaatacttacagaagaggctcttagtcctcacaccaaaaagaaagcagcagcagcggaaaaagacgatcctagcggggcttcagctccactccacaggcaaaactcaactggggtctgagccttggtcttctaacttagtcttcagctcagaagcactacacttctgaaaatggggaataatagcaaggctgagtacaaccaccgtactcagcaagccacaccaacgatgcagacgtgcaaggggattcaagaatggcttgtggctatttgtataaaggtggttgtaaaatattttattgagcaaatcagtaaaactgttgagtacttaaggtaatattaaatctccactacagtgtaccaaggggattcaacgctacaacacgttgaacaggcccaaccatcccacctgaactacagtgcattgggtcgattgattaagtgtgagactaatcacggtgaatctggtcgatcgcccataaccgtgggcacggctattcgaatagttttactctggccagaggtgcacaactatacccacaagacacaatccaccggcatgtcaccgtacccggccggacacgtcaccatgtcgagtgattgtgacaagacccttcatataaccccctctgaccaagcacaccacacctcaggtttcacccccgcccccagcaagcagcgagcagtcccatctcgtgcctaggcgaatcagaaagccgcataggccgtcgcagggcccatccgaactccatcacgctcacccttgtctggatgcgtcagccagagaaaagctatacttcaagtcaggtagttacccattcccgcttgtggcaagcgctgtatgtcttccagtgcatcccgcgaaccggtccttaattgccatgggtgcgaccagcaaaaccatgcacccatagcccatcattcaatcgcattttagttggatagttacaaccaatgaaacatggccggatgtctcgagcatgcagctcgtaatgatactaaaaggtctattactgccattatcccatcaactgagttagtggtaattaagcatggctaacatatagttctagctagatcaacataagtgacacaagctagtcgaattatcacccacggttgacaaaggacaggtatcaagtaaacatggcacaagcgagcagataggttaaccctaatcccatgtaattagcaaaacatgcatatttatttgcaaacagggaaaacatttgtaacgtaggatcaaaatgctcaaggggaatgtgtgacttgccttgcttcttcaaacaatcttccgaactcttttcctcgcgaccgcggacttccgaaacaacagattctacacgctagcatgcaaaatgaggaaaaacactaataaagaccaagcaaatagtacatcataagtaaacagacatgtagagctcaattttagatgaattttgcaagttgaatggcccaatttggagttcatatgaattagatatgaattttagaagttttgagccatttaaatgaatttctagaattaaatacgatttatgacgcaattattaattatttttccaaaggaaaaggggttgctgacgtcatcaagggggaggggcggcgccggcaagtgggccccaccggttagcgacacaagggcgccggtccaccgtggaccaggaccactgaggctgtccaccgccggtccacgggaaccgacgtcccggatcggccaaagccgatcgggcggccaggggcggtgcggctggggcacagcacggcacaaggtcggcccgaccaagcgacggcgcggcagcgcggccactggtggcgatggccggcgacggcgcgggcagcaacggcgcacgcgggcagcggcagcgcacgcgagggaggcgtgacaaaggggaccggtcggcctgggcgagcagggcagcggcaagcctgctggccgagcacacgacgcggcgccgacgtaccgggctcaaggaccaccggcggcgaacggcggcggcgcgagggggcaacgcacgcacggaagcgacggcgcacgatgctaggagggagaggaggaggaaaccggggtgctcaccgagggattcggctggtgcggagggaggcaacgacgggtggcaatggcgagtgaccggccaacgacgacgagcggtggacgggatgcgggaggacctacgaaacacaatg

SEQ ID NO: 75729 - DNA, 14244 bp, Oryza sativa
gtcaacggtgtcaaacatttagggaaggagggagtatcaaataattagaagggtgaggcttcgaacccatgtcgtctagcccactaccttgtggagctagccggaagacgcctgggcgtttctcgttctgctattcaataaaactacacgatcagaacagaagcattttgtcttatgtcacgaagatttggagaatcaagggattaacattgttatgcttgaagcatgttcctcacataaatgacagttcttctactggacttatgctagattagtaagtctctgcccgtatgactatgacgtgtgactaatagaacaaaggttggagatgctacggcatgaatgtgacatgggagtgtgcgtaggaagaggtcaaagatcacacttttctggcttggtcgccggcgttggtcgtcgccatggttgagcccccatcttgctcctgcgaggctaccccgctgctgcggcttctccggtgtcgagatccgctaaaaccaccttcgtcgaggactacacatcccctggcttcctctccgtcgctgtggtccgctcggcctactagggttgtggcacagtccacgcttctaagatggatgacggatagtttggcgggaagagccggcttggcgcgaggcaacagttaaggctgcattgtttcagtgccaatcatgtgaccatgtacagaaacgtattggaatttcagcccaatccaaaagaagctgaatttgggaataagaaaaataaataaacatgatacttttgcgacctaaatttgtttgataacaaactgtggttgtgaaaatagaagtagtataaggccgaccagtggccaatatcataacagcctcaatcgagtaattgatatggtagaacatgatcaataagcaataattgagatattggtggacaccaactagttcagcagatatgaaaaccaaaggtgcatcaaattaatatatttacccaacgatccatatataggagagaggtctagtatgcgatgttcttaagcaacttttatggctctttttttaaacattttgtataatatatgattacccataaatccatacgagaaatgcctacattatgatgttcttgttctttttagatacattttgaatagaatatgtttactcacgtaatatccacaagggagatgtctatatgttgagatgttcttcacgtgatcttttagatgcattttatatcgagatgttcttcacttgatcttttagatacgtttcaaatagaatatgctcacataatatccataggccagggagatgcctatacatcaagagatgttcttaagggcatgttgttcatcttgtaagaggatcaaactaactaaagaaagaaagtataaaggagcaaactaactaaagaaagtataaagtggtaataatgtttttgttatattattttgccaagtgggttccatttaatcaccgacaacaattgacttgataaaacaacttcgatttttcgaataatcaatcgaagcagctcctacactgctatcaaagtaatactacctctatcccaaaataagtgtagttttgcactgttcatgtccaatgtttgaccgtccgtcttatttgaaaattttttttatgattagtatttttgttattattagatgataaaacatgaatagtattttgtgtgactaattttttcttaaacttttcaaataagacagacggtcaaacgttggacacagaaacccacggttatacttattttgggacaatggtagtataaatcaagagcatttgttctaatttaatttgcatcctccctagaacaaggtaacttctcgaaaacaactgacaacaatgatacaacatgcattcgtcccaataaatctcatgtggagtaatacaagctttttagtaatttggacatgacattcatacaacaagttgttggaaccaccaccttgtcgtgatggtgacggggacaattgatatccagtgataaaaactgtgaaggcagaagggagccgtcagttgaaccttgtgaaagatatatgatggatggatagcatgttgtttaagggcacatttatactgtgattactctcctcaatactgagatggcccaatgagatgttggagaaaactctttatctcggcgctgtcttgcggacatttttaggctgagagtcattttttttctaattatggcatcttgaaaaccactgttgatttcatctgttatataagggaagatcttactgtaattgcttcgtttatcattagacatagttgttgtttttaatggaaaaaccgggccgaacttctaaaactaaaaagcagcccacccgcttccatagaacaatatcgcggcaacgtattgactaagatgagccaattagatgttggagaaaactatttatctcggcgctatcttgcggacattttaaggctgagagtcattttttttctaattatggcattttgaagaaccactgttgatttcatctgttatgtaagagaagatcttactgtaattgcttcgtttatcattagacatagttgttgtttttattgactaagatgagccaatgagatgttggagaaaactatttatctcggcgctgtcttgcgcacatttcaagactgagagtcatttttttttctaattatggcatctcgaagaaccaatcttgatttcatctgtgtgttatataagggaagagcttactgtaattgcttcgtttatcattagacttgtttttattatctcactagtcatttagcatctaaattttggtaataacaaaaataaacaatcataaaaatattcctgtttaaattatgctcaagcaggacctatcaaactaattccacgtagaagggattatttaaagatacaaccaattgaagattgatgcccgaatcaaccaaacaaaagatagatcttgccataattttatttgctactaaaattttagcgttgcatgaattttggcaatgtcaactcatgcaatgctaaaattttggctatgcgtttttgttgggacaccttggggtttacttggccccaaaccaaatgaagccccttaacaatgctatcaaaaatttagcagctgactaagtgctccaacttttatcaaaattttgaaaatatctaatattcgacgcacccatatttcaataaggttcatattgtttgtaaacccaaactaatgtctcagaattttggtagagtatgtccattttatctattgcaaatgttttagaggtgtgtgggtttagttgggtactttcgacaaaaaaaaaggctatcatgtgcttcaatcttgcttcaaatacaaattcaattaagcatgaaattaattggtactatgcatgtcgttcgtactactgtggaggttttcttcattctggaccaaatcagtgaatccagatgaaacaaatatgctgctcggcaaccatactgaagctgacattttctccgatcttaaaattgttttgttatcataggaagaactgacactttttttttttgcttcgcagatatcagcgaccccataggtttaatgtattccatcttctataggagcttctcctgtctcatttcctttgcttcaaacctagctagtccccacccttaaatctttcacatcacagtagtgggcaaaagttctgataattcactggtttgttgtgcatgatccgacttattctcattttccattaggcaagataaggatttcaccctctccagctatcctctaacggctcgtttggttggagggagtttttagaagggattgggagtttagagggatgatgctattaagtgttttgtttggttgggagagacatgagaattttgataggatgaggatggagaattgaggaaggaactccctccttttcaatacctgagtaggggcaggtaattgggagggaattcctcctttactttgtctaagcacatcttagttatccgtttttattaatgacctaatctccaactaaactccctatcaatttccatcaccccaactaaataagatattgggattaaaaatcaaattctcatcttaatctcatcataaattcccttgtgtaaactcccaatctccttccctcaagttaccaaacaagccgtaaggatgaaatggcgctagacatcaaacatgaggacactcccaagtttaccacttaatcaatcacagtgtacaatattattgataattctcatatagttatgtttaaatttaaaaattacgtacataattctcatcatatactgtgtaaaaagttctcatcatataaacaaaccaaattggatgctagggcggctaatcacatgattagtagaacattacaggacaaaccttcacatattcttctagaaggtcctcaaagtcaaacacccataaaccactaaattcagacattcattagggaggaaatcaagagcatatcttcttaattgttctgcaccctttccggaacaagctgacttgttcaaacggtcattaagtttcctaaaaacaaatgatagcaatgatacaatatatatcatgtaatacaaagcttgttccagaaattttgaacatgagattcacacagccggctgtttgaaccaccacattgctgtgatgatgatgatgatgggataattgatatataaggcagagggaaaccatcagttgaatgttgtgaaagatgatggctaccatgttgtttagggacacgtttatgctgtgattctgtgattactctcctcaacatgtataccacgatgtcaataaataaatagggacctgaagtggtaaagagtgataccgcttgctttcctttcatgggctgtatgtgtgggtatatagctgatagagtgagataaatgagaaaagtaaggtggtgagatgcaagagaatatttagaatcttttttttagataatggaagctttattaatctcagtaaaactctatcaagtgatacaattattctgagagcacctccggctttgcacccaaagagtgcacacagccaacaagaaagaaacaaaagataaactcatcatccaaatagcagggacaaaaagaacttcaggagccctctaaccgtagcctagaacgccacccatgcgccggggtagaaaactccatggccactagctccaattattgacaagccgcaatgatagtaccccgcaaattgaccttctgaaggatagcccatgaaagataacctacaaagaagaagatatgtttttcctttcaaaaaccacatcatttctgcaaagccaaatagaccaaatagtggtagttgcccctaataagaccaaagatctcaaattgcgtggttgtcttcttatccaatgcccaaacatatgagttgtactattaggcaaactaatattcgaagcaaactggattaaagaccaaactgcacgggcaaaacgacaatcaaagaacaaatgattaatagtttcatctttgtggcagaaagaacaagacttgtttcctctccaattccttttaataagattatcttttgttaagactactccacgatgtaagtaccataagatcttaatctttagggggactttgattttccagattcttttgtttatattgggaacatcggtctgtaccaacgcaagataaagagatttaaccgagaatctgccatcagttgttagattccatttaaactcatcttggtcgtgagataatataatattagcgatgcgtgagagaaggtgattccacaccactaacttagagccagtaaggtccctgcgccaagaaaagcttagaggactggtttggaaaatttctgaaatagttgcatgtttatgcctagcaacgttatagagacaaggatattgttctcttaaacaggcattccccaaccatttatcttcccaaaaccgtacttgagagccatctttgatgttgaaggagccaaacccgagaaaatcaggcttggccttcattagactagcccaaaagtgtgagtcttctgctttccactgagcttgagacaaaggctgtgaccccaaatatttgttccttagcatttgttgccacacaccatctgtagtgagtagtttatgcaaccacttgctaaggagagccttgttcttaatttcaagatcttgaattcccaacccctccttggtctttaggacgacatatgatgtcccaccttgctagtctatatttccttttgtgtccatccccttgccaaaagaaccttgatcggaaataatcaatcttcttgatcgctcctttaggtatttccaaaaaggacattatatacattggtaggctggtaagcactgaattgattagtgttagtcgccctccaagtgataaaagtttgcctttccaacttgccaaccgtttttcaagccgctcaatcacttccttccactccgaattacgaggtctcctatgatgtataggaatgccaaggtaacagaatggaaaagaaccaacctcacattgaaaaaggttagtatattgatcctgagctgtttgggcttcaccaaagcagtaaagctcgctcttatgaaaattaatctttaagccagataattcttcgaaaacgttcaacaacattttcagattacaagctttctctagatcatgttccataaagagtacaatatcatcagcgtattggaggatggacaatccaccatcaatgagatgaggcaccactccaacaagctgtcttgcattatttgctctctggatcataaccgctagcatgttcgctataatattgaataaaatgggagatagcgggtcaccttgttgaaggcctttctttgtttgaaagaaccgtccaacgtcatcattaactttgattgctacacttcctcccgaaatgaaggactcaatccaagaaatccatcttggcgagaaacctttcatacgaagagtttgtagtaggaaaggccattttactttgtcataagccttctcaaagtcaatcttaaggatgaccccactcaatttcgatgcaacttatgaacagtttcatgtatgacgacaaccccatctaggatgttgcgacctctcatgaaagctgtttgagttaagactcactatacggtcagccaccgagtttattctattagtgaccaccttagtgaaaattttgaagctagcatttaggaggcaaattggtctgtattgttggatacggttagcttccttgactttgggtatcaaagtgatcaccccaaagtgtatttagaatcttttaaaaaatggtaggatcaatatgttgacacactactcttgtgtatgtattatggagaacctatgttttgattagtcgtactatctttctaacgtgtgagaatcatacctatttcattatgcaatttctttctcttctaactagggaagagaagggattgttgtaacttaatcggtatggggagagtgttcttattgtttcatttactattaagtattattgttggttttctcatctcatctacttcattgtgtgaaattattgtaattgtagaataagagaatcacacaacaataaacttttctaaacattgtgcacattccacccaaattttgaaattaaaacacaagtgtatgggtttattcgaattggtgcccaaaccaaccacaaaaactttgttaacaccgataaatttggccattttcttcactaccaaaattttgattgttccaacttatacaaagctacaattttggctatggattttggttgggagtccatttggtttcaaaccgtatgatagcccttaaccccccttaacaacagcactaagaaaaattggcagaaaaacaattgttccaaccctcatcaaaattttgaaaatgtcccagatttggaatgcagatattttgcggcctcagttaggtatgtttgcccacgccccacccaaaaaaaaatggtaatgacatattttaataaaccaaatttatcgctggtgagattagtgctacttgaattttcttttcccaggttaggagtgctgggattttattcacaatggtaagtttggtaacatcttccatcaagattttagaactttttagggggttttaatgtttttctgtcttaatttggagagaaacaagtctaatgggccagaaagcccaatgccctagcaaggcccacacgtggcgcctcctcctcctcgtctccttccggcgaaagcccaaacccttctctctcctccccgcgccgccgtcgagatgtttcggagcccggccgccgccgccgcctccgccctcctccgccgcctaggcccccgcgtatccggcggtggaggcggcgcttccactcaccggcgattcgcgcctccggtatccacctccatcctctcccgctactcctccgcgccgacgtcctccccttcgccgccgccaccgccacccccaccgccctccgacgccgcggcggatggggataaccgagcggaatcgggggaacccggctccagtctcagcatcaccatcgaccgctccggcctgtacaatcccccaggtccaaacccttcctctctcgcgcgcgcgctcgcacggacgcaacggcggtgtctggatttagggttttctcatggtttgcgtcgggtttatgccgcagagcactcgcacgagccgtcgtcggattccgagctagtgaagcacctcaagagcatcataaaggtgtccgctgtttataatgagcctcttcgtgataatctctactgtttgccaatgcggaaaatgtgatttggtgttgtgaaaattgtgattcggaggttagttccgcagcgggcctatcagcgtagccgagtacatggaggaggtgctgacgaacccgcagtcagggttctacatcaaccgcgacgtgttcgggacatccggggatttcatcacctcgccggaggtcagccaaatgtttggagaggtaaatttgtattgttgaagtaataattaccatgcctctgcatatcatttttctttcgccctgtagggttattagaatagggaatgaccgaatgatggcactcaggttcaaagcaattcttcttgtgaagattataggacaattaattcatgtgttcgtgctatggggtgctagatgagagcaattaatgatgtttcttttcctcagatgactggtgtgtgggcaatgtgcctctgggagcaaatggggcagccagagaaagtcaatctgattgagcttggtccagggcgcggaactctcttggcagatttacttcgtgtaatgcatttctgcttgcatctatcctattttgaactttcccgatttgtgtctttgactgatgcatccattggaacaggggtcatcaaaatttgttaatttcaccaaagcactcaacattaacttggtagaatgtagccccacgttacaaaaggtgcaatacaatactctgaaatgtgaagatgagcccattggcgataaaacaaggacagttagcaagctttgtggagcccctgtacactggcatgcttcccttgaacaggttccttcaggatgtatggagttctttcattgataactttgcttctaatgaacattaactattgttgaaggctcataagcacttgtattatcaactttcacacttggtaaaatttgtttttgtactgaaaataagtgcaatttcagttttgatacccaaagaatggcattttgttttgtcctttctattcaaaggtccattttgtttttgccgctgcagttaccattcatcagtttggcagcactgatttggcatgcattgttaagtacagtagggaaagctttaaggacattagctatataagataaggggaaacattatgttttttattttattatggtaccgaatgtgccatcgtgtataattgagtactacctccgtttcagtttataagactttctagcattgctcacattcatatagatgttaatgaatctaagcacacatatatgtctagattcattaacatatatatgaatatggacaatgctagaaagtcttataatatgaaacggaggaagtaacagattgggtttagttaatctgcggttcaactcttgtggcgaggagccaaaagaattgaatgtgccaatggactgtaatttttctaattagttgtatcatctccttgcacatatgttaccatttcatatttggtaatttagttgtttttgcatgtgtaaagtgtatagtgttctcgtgatatatgctcatttttagtattagattgtaaatattttctcgtaagtgtcatggttgactttgaaactggttgccgcctttatctagttctctttttcgtcaagctattttctttttgacatcttgatcagatttcttatgcttgttctgtttgtatatgtattctctgcagtgccaactataattattgcacatgaattctatgatgccttgccaattcatcaatttcaggtctggttacaccagcaattccacctcttaatgttttgtgacacaaacagattgaatattgttcatgcattccactgaaccgtcctttttcttctcttcagaaagcatcacgtggctggtgcgagaagatggtggatcttgcagaagactcatcgtaggatttacaaattttatttttaagtggttaaccttatggagatgtgtaattctaactttgtagcaggtttcgctttgttctatctccacagcctacagcctctttacttttcctttccaagcggtgcggttgggctagttctgaggaacttgagaaagttgagcatattgaagtctgcccgaaagcaatggagatcactgaacagattgcagatagaattagctcggatggagggggtgcacttatcattgactacggaaaagatggaatagtctctgatagtcttcaggtttggatattaaatttgttttactgcacaatatgaacccatggctctgtccaatcctggtctaatgcctctataacattaaatttatgtcctagatccatatgcttctgtagtctgtaacaatggctagtgtttgaacctaaattcatgtcctgcatttctgcattatttggattttgatttttgtgctcacactgagcttttgctgtatatttttatgtaagaaataatttaattaatttctttggcactaacaatactataatttatgcaggcaatccgcaagcacaagtttgtacacatattggataaccctggttcagccgatctgagtgcttatgttgattttgcatcaatcagacactccgctaaggaagcttcaggtttgcacagatatcttaaatcctttctgcttgtttttctcatgtccagacaaacatttcttactaggtctgtcttgaactttctgcagatgatatttctgttcatgggccaatgactcaatcccagttcttgggctctcttggtataaacttccgtgtggaagccctgctccaaaactgtgctactgatgagcaggccgagtctctgaggacaggctactggcgtcttgtcggagatggtgaagccccattctgggaaggtcctgacgaccaaaccccaattggcatgggtactaggtacttggccatggccattgtcaacaagaagcaaggcacacccgttccattcgagtaaaagaaatactggaaccgtttctcctctcctcaggtaaaataacatcactgccgtgtaactcttatgctgctgatgaattctgccggcgggcagtccagatagataaggacgattcttgtcaaccttttctaatgcacaccatacatggactcgttcagatgcgtgctgttttttttataagaagtgtgtactgctttgtacttgctgcacggaaagaattggtcggtttgacattcctgttactacataggtttcttcgtgcaagatgggatagtggttgtatcaaagtttctggtacaattcctgaatttctactagtgttcaaccttgagatacaagttatgcacattgtttagctgcggagtcagctgtttagaccttgagatgtcatgcattacgcatttgtgcctctgtttggtatatgtgttccagttcactgcttctaaagtctaaagaggctatagattagtatttaaaaccggtttacccgtttcaaaagcatgcttatcttatgtcattcgtgcaaagccttgtatgattgtatccttgtatgccaccaatcagttgaagtcaaatatgtatttgttcggtacaattattccaagtcactgcatttttcccccagtcaagttactactataatactctttagtaccttcttccacgccaacaaagcatgcaatttgacatcctaacaccaaagccccggcaaaataatagggtaattaacagtctccattagactttgacaagcctcttgtttgttctaccaaatcaatcactgccaacatcttcagacatattgatcccttcaaaagctcagagttggaaccaacagcagtccaccgtcagaatccatcgaagaggtcggtaaaagaagttttagagatggacacggttattaaaaaagtaggtagaagtgaatgatgaaaggttgtgattggatgagtagtggagataggtggaaaaggtggatggcgcagggttgtaattggttgggaagagattgttggttaagaaattattatattttgggacaaatcctgaaggctaaaagtagttatattttgggacggatggagtaattagtaaaaaagaaaaaaaaaggttggcagaaaagcgactctccaattattggcttggcatgaaacgatatggcagatggaagaaaagaaagaagaagaagaagaataggcagaaaaacaaaacggaaaagttgcaaactgaaaacggccttaatcgtgtttactagtattatatggtggacgtgatgactttggatggacacgagagtcgccgtctccatcaccggtgcgatgagtgtcgccggaaaactacattgtttccattcacatgctatgacgggtagtagggtaggatcgacgaaaattggtgccgcaaaacaaccgtgagtaatccaaccagtgtggcaggcaatcccccctcttgctgtggatatcgtatcattatcccggaatttaagtatctgtataaattgaaagggtatgtagtggcttgatccttgtcgacgtgatctgatcctattatccctaaaatagagcctcaccggttagcctaataatacaaagaaaaagctaaaatttaaattttcaaacttgattttgatcttgattttgagatgttttcaatgtgatatttttttttaccttttaatatattttcaatgtaatttttttagccttggcttttaagtcactataacggatatataaaagttttacttataaattaatttttattctctaataagacgttctaacttaatagggaatatgatcaaccgatgagacactattgttttataggagcgtaagactagttgccctgatcatatatgcatacgacttgattttgatcgtgcgatccctcgagtaccctgatgggagcatgggaccattcaacacaatcctatatgaatatctgatcgaaacatattcagtagtacttaacacctacaatttcaaaaataataaatatacaaacagcgctagactaaactacagccttgtaaggctataattataaaagaacacatacacacggtcacgtgccgataatgccttcgcataccactgagagagaaattagcaatgggccgatcacatgaccttcagccaccaaacctacaaattgttccaataaggatatagaatatcgagtcaccaagattctacgcatagtaccaatgaggatacagaggatcaagtcatcaagattctacatatacactacgcgtcctcctgtaaatccttaaaaatagatcaataagaacatatgatgaatcgatatgtacgcggttcaactatatccactacttaacactagtaataaagtagtagtaaactagtgctgaaatttacacactagttaactattagagcataatggtgagttatatgtcaactataaacttacgtgaaaaagagagagagagagaaaaacgagacgtgttactcttgcaagagttcgctctacgcatgctccaaaatatttatattaaatttaggagagaaaaaaaaataaagccaaccgtaccctatagttaagatattatactccctccatttcaaaatatttgactacgttgactgtttagc

SEQ ID NO: 75730 - DNA, 6283 bp, Oryza sativa
cgcgcgaactgacttttggggaaagacactctgaaaagttggatatttgctggtcacaacatattaaaataatatttttcggttgaagaggagacgtcaaagtactgaaatgcccttgggcccacatctgatctcccctcctcgatcctgactccgtgcgacaagttcgattaccgttgcgatggatttctctggcggcggcgtgatgttgtcggagatgtaccagagcacgtggcggcggctgctctcagcctgcgatgacgtggccagtgtcggtgccaacctcgtcttcctactactcggcaccgctcgtcagcgatgtctgggattcggccgccgccgaggacgtgcggcaggaggtaacccagatctagggcttgtccgcgcggttgggacggctctggcgatcaatccgcgcgctccccgctgccatccccgttctctcttcccgaccgcctcgccttcctctccctctctacatgcccacaccgcgtggtcctgggcggcggcgtcgaccttgacttcctcctcgcggtggtgttcctcactatccgtgctcacttgtcgcgcttccggtgcaggaggatcacgaacggcaaagggaaccccgcggacgagtaacccctgctcgcaaagccgccgctgctgtctgaggttgcgatgccccgtcgagggaggttgcggaatggggtcgggctagtgaagtccgtgtgttttatggccgcgtcgctcgttctgctcatgctcgtggacctcatggcttgccacgaagtgtgttcttcgcagcacagttcatggcgtaccttgccattgtggggttgtcatgacagagaaggccgtggcggtgacggcgcgttctcactcggtgcacctccgtctcttctgggttgggtccatgacactggggaaatggggtagacccagcgcccgtggttgcagactgtcccactcgtgggcaaagtcagcgagaggattaatagataagaaaaatgtgagttctaacatgtggacgcaagggcatttcagaactttcacacgatttctctcttcttcaaccaaaaaatattattttaatgggtgcagtgtccactagcaaatatccattgagtgtattcccccaaaagtcattttgcgcagtgtcctacagctaaaaccgctaagtcacgatgtcctgtagcaaatttgcctaaaattaatagctaaagtttaaaaagtttgaccgaatattttcctaaacgtcaaaaatatatttatgctgggactatttcttcacagagaaatgatactcacccaaagtggtccaagggttggctaaaaaagttgataaacatttttttcacattgaaatacattgtcgtaacacaaggtttaaagttggcccctagggtttagggtttacaagggctgtgaactggaaaacaaattaaataagcatatttaaaaaaaataagagtgtcatacctcagaaacttaatcaggtagaagagattgctctactgaagagactgcaccatactctagtgaaggactgtcacgaccggaaataacccaacgggcgttccttacgtgcgtgtattattccttgtcccaggaggcaaagtacatcaaaagttgatacaattcagagtttaacaagcggaagcgtaaatagttaatttattacatgggcggcgaaggcccggcacacatgaagacaaacgaaaaacagcggaagactagggtgacgaccacaggcgcttgacggcaggcacgagctagacaccaaagccttcatcatccaggaactcctcttctgggtttgggaaaaattgagcaagactgagtacaaccaccgtactcaacaagacacacccacgagtgcagaataaatgcaaaggagtacaatggagtaataatatagggggttagggtttgtagtaaacagcattagaagacacttagttgctcaaagctacttttagaaaacacgatcctagatctatacaatattattaaacaaggccgtgaacccacacgaacctgccttaacccaaggcctacgatgattcagaccgaactggcaacccgaccctgggtcccagctcgtcccaagccaacccaggccaacctttccacattttagttgttaagcaggcttttaagaatttaaaacactaacttgggtacaatgctaggcttgcccataaccaagggcgcggctattcaaatagattatactctgatcagaggtgtacatctttacccacaagacacatcttactcacgtgtaaccacgtgccacataccaccacggcatatggacggaagacatgacatagtttccaacccatcctagccatagacaagagtaccgacccaaccccacctacggccggaacctccgggacaggtaggcaggactgagcccctagcagcaggacaacagccctgtgccatgacatctcgactaaccgggccgcagctcgtatagccttcatttgtcctagagatgtccatcgacccccgacttcgtccatctccatccgtgtacttttgtttataaccagactgatccacaaactaagccttatccactagacatgtggaagtacggtagtgctttgcaatagaggcccgaagaccggtccttatgtggccgaggtgctactatcaaaaccatgcaccccgagcccagcctaaaaccattttgagggttttgaatagagggggaggtgtgcatccaattccacaataatccaaccattccacaatgtccaagtgatatgaatattcccaaagtctagagttataaaaccacctaatgttgactaattgaacagcgaagcatctacataaattcatactagtggaaccatgaatagagtacccactagttggggttttgtttaatctagggtgaacaaggtaataataacaataacaataataataaggtcataacaaaggtaaataagcatggctaaataaaagagtgataacgcgggaatttaaataaagcgataatgcattaatttaaatcaaaataatttcacagactaggattcaatatgttcaaagatgatgtgacttgccttgctcgctttcccaaacgtcggcttcaacctccacgtagagcggatcttccgaagctgcagcgtctacacgaccaacggaaaggaaaaagtcttttactctaataaactccatataacaagcaggaacaaagcacaaaaatgggttcttgacttcttaaggaaaaattagaacttgaacggtccaattccgagttcaaatggccaagttatggccatttgaagtttatatgctctttaagtgaatatttgcgaatttcttcatttaaattttaatttaaaaagggtttattgcgtcagccgaggggagggggcgcgcggaccgggtccacgggagtggggcccacgcggcagcctcacggtccacggtggaccgggcgcacccgggctcacaccggccggcgccgtgggccccacgcgtcagccgcacccaagggcgcgggcggctgacggccgggccccacggcgtgcccggaggcggccacgtcggcgcggccggcgggaggcggcgcccacgcccctatggtcgccggcggcggccataggcacggcggagcggcggccaagagaggggaagggaaagggagaggaggcggcggtccatggctcaccccgggtcgacggcgacggcaaaagaggctgccggagcgcaggaaggcagcggcgcggctcgggtggacgaggacgacggcgctccggcggtcggcgagctcggcgaggtggtggacggggtcggcggcggtgcggcgaagccggaggaggcgacgccgaggcgggggacggtcccggtgagcggagagggccgaccggaggtcgtcggcgacggaggagagagagggcgacggcgcgagctcgtttccggcgaggagaaggtgcggcaagtggcggaaacgggcgagggaggcgcggggagggtttaaatagggttgggagggagagagggcggccggcggggaaggaaaccggcgcgggggatccggctgccatcaatggtgccggcgagatttgcgggagcaaatccggccgtttgaatacaggagacagagggaaaaatggggggaaagggagaggagatcacggggaatgatttcccccacttaattgcacgcgggaacggccggaggcggcgagattcgcggcggcggcggcgctaggcgcgggcggggcggcgggaggaaggggatgacaggtgggccccacccgtcagcgagggtggcgggcgggcctgcccatcagcggcgcgcgcgaggggagaaggccgaatgggccgcaggggagaggagagagagggggagggagatgggccgagccggcccattagagggggaggggtttttagggtttttctttttataaaaccttttcaactttgtttatttcttaataattattatttgtgctctgaaaattccactaaaatttatttacacattttaggtttttaggaaatatacaaaaatcctccaagccttatttgacttttagctttgcacattttaatttttggaggctttcacaaggattttaatctaggcataatttaaaggatatattttttgggtcgttttgggacgtgacaaggactcaattgagtatcacaatgaacgatctcttaaactagtaaaccatgtatgtgcaggaaggcaacagtccagtcatcatctagccaaagagattcaatgaattggaggtgtgaacgtgtacttatggcattcttagaagatatcacatgtactggaaaatgcaatccaatatgcatgggctgatcttatcttgtatatgttgaaataccttttccctagtaacagaagctggaggtgccaattgcaggtggaacaacaacaatgaccaggcaatgaagggcatcatcctagtgagagaaaacataccttccgaaagatcagtctggagaaattcagaagtagacatctcaattaaggataagagttctctcataacttctctgaatctgttatcagttcaatactttggcccatgtcagattaattcttgagtcagtgctctattaatcccggagaacactcttttactagtgaaatttgagagaggcgttcaaaaagaagtagagagtaagcagcagacgatggatgagatattggctgtgaagagaactaagaatatagcccactgactgagcccttcgcaagcccccacagttccatcaactcttgtgcattccagtctctggtgaagcataaatgacaaatgatgccacaagttcccaaaaattcatataagcaatgcgacttgaagatatgatgaatgaggcctcttcacaacaagactttgcaattgcctctgaaacaccagaggccaagaacaaataattccatcatcttgttatttctttcagcataatcccttgaatcaataatctgcaaacccaggaagtttctgtttcttgggtatccaaagcagattcaactcagttaaggtaacacaatgtaaccaacgcggattcaccaaagcttaacattaactcatctatagcgctaaccactaatttaagcttctccaagcagaggttgcaacaatcattttcttattatcagccaaccatatataactgctgttaatttcacacccaccccacctagttcagccattattgacaatgggaatcaacaatatctgccaaaaataacagattatatgaatgtagcgttgtactagtacgattgaaaaatgttatggtgcagattaccttgttgtactacttcccttgggctggatgataggcaaaagatggctacatcaagccaactcaaaatgcttttcgccaaaatcagcgtaacaagaagcttcattcaattttaattttcctgaaaacggtttgataattataattttaagctccacaaaatgattccatgtttgagtgctgaatcagagaaggtaagactgccaaatacactctcccctatccatttccaagtgcaaaggatctcagcagcaacccatgctttagagaatgaaggaacagttgaagtagtatcaattgattgtgatatgttgtaacacgtatttccaagagcacctaacaagcttgtcaacaaaagcaacaaattggcggtgtttcaaaagaaaataacctaacaactgccataaactatatatttttttgtcaggcactatgctgtcataaatttcagaacatgaacagaatttgtaaagatggcagtaaaaggcat

SEQ ID NO: 75731 - DNA, 10197 bp, Oryza sativa
gtcaaacattttgaaacggagggagtatatgttagctctaacactctcccaattcagtactagaatcaaacatcaaccaaagaccaaaaagttggattttcagaagaagaaaaataaaaggtcccacaagtgaaaacctatcacaaagtcatcaccatctcctttttctttatatataaatcacaagtcatcaccatctttgccctgcatttcctcaggccagggaacaccagaattccaatgtcaacctcccccctttggaattggaatcaaacgcaggaaccaaaccaaccaacaaaccaaccaacctaaccaaccgaaagggcaggagcaacggcacgtccaaatccggtgacccaattcgtcgccccggcgagccccaccggctgcctccctgtcccttgccgacaaccggcgacggcacgtcccatcgctgccgacggcgacgccggccggccagccggaaagcccggacccggaccaccttttccatcagcaatagatgagacacatttcttcagttagtcaaacatggttcagactttcagagattcttttcttttagagacgaatcatcaaatcatttccaggaatcagttctgaatccgaatccatccatccacacgtgcatgatcaatttcagtgcagaatcggatcaaacaaggggacacagattgcacaggcatatggagaagatcaagatagacagatgctactaatattacttgcatatacatatattccttcttctagctagtgaggagggaggggggccaaaagaacagcattgaggaggcactgctaatgctaaatactgtcccaattgacatattttgccaaaacaacaaatcggcagacccgagctaggggccgcctttggctaaatcttttcggttagtggatgttactttcccctggctgagaaaaacaaacttcctccaggatcatattcggcttcggcacgagaagaaggtatcgtcgtccgccggttagaagcttgggtaagaatagggccagagccgagagatcaggatgaggtgatcctggtctcgaggtcaggcgcgaagctgtgcggcatctgatcgtcccaaaccaagccgacctcgtactcgggaacatactcctgaaatttccaaaagggtacatacaaacttggtgttatgagaaggaaattgccatgtagggcaatgtgtcgaaaatggaacagtgcaagctgtgagttttttttacctcaagcttcagaactagctccctggcagttggagccgagatgataatgcgccgcgcatcctccgctatgaatccttcgctgacagccatgtcaatgaaggatagaaaaggatcataaaacccgtcgacattcagaaggccaacctggtaaatattgaggagctgttagagctaggagtagagaatgtgcatttgagagcaataagggaaatcccgcgcgattaaaagacgagcattcctctaaaaacatggatccaagaaggatcactatcctagttaatacagttacacgacaccatatgaattttgtgggggccatcagcaaagctgattgctaggcatgatgaatgaggtttaatgcactgctcagatccattgggtcattaatttagcatagatgcaaacgataagttcctttttgaattaaaaaaaatgacaggtacaagatcctgcgaacatcattctattagatgagttggaacattcataaaagtataaagcatatatcatattaacaggaagcataaacaatagagggtgcagatctcgtgatccccaagctatcgcctaatgtactgtaagatctgcagatcatagagggcttaaactattggtcaataattcggtttctagatggcaaaaccttcagccaaccacatgggagcaccacgaagccataatcaagggcaagatgttagcacaagatctcaatggatccaacgactttgcgattattaatttgcctcaattgcaaccagagacaagaaaggaattcgggatcatgcacgcacaaccacatggcctccaaattatcgcgcaataatgccattcgttttcttcgtgaatcttactagtacaagatatacagaggaatcagaaccagttggttacttaccggcttcttgtggattcctagttgggcccaggtgatgacctcaagcaactcctcaagagtcccgtagccgcctgtcgcgcaaattaagagtgtcaaattttgcatccttaggatgcagcatcaaaaaaaattcactgcaaacgacgtcgtagtagcaactaaattatcataccaggcagtgcaatgaacgcatcagcaaaccgggccatttcagccttcctctcgtgcatgccagagaccgctctaacttcaccaacaggctcaccagtgacctgcaaacgaaaaaccagtatatattgaggatccggcacacatcacacttgtttctctttcagaatcatgttaataagctcatcatcctagtagaaaaatatttaaaaaccttttttagtgaaactagcaatgcaaaagtccatagaaatacatggctgacaacattcggatgcaaactacggcacacagagttgttcagcgtgagatcatcatcgacattagaatacacaggaaatacaagttctacgtacgtaatgcagtggtcaaagaccacgacaatcaagaaagtcccatttttaagacattgtactaccgaatgagtactagtacaagtagagatacgtacaagaagagtaaataatcccagttactgcacttactactacgtgcaagccccagtaaattatccgaaggcaaggcaaatgcgatggcacatcctagacagctactatagctcaaaatccatttaagagcagcacgcaatgctgttggataggcgcattagattcatgtgatgagcataaatgcatcatgtccccccaataagcactagcagcatgccaacttggttctttattgcaactcctatttttcagctgcgcacagcagcagcagcagcagcagaagccagcagggagaggaattgaaagcattcatcaatttcgccccgaacaaaatggagcagcacggccacattaaaaacagcaatcaagattatatctatctctatcgatcgagcttgtgtaatagcagtagtactactcctactagcttccaggagtagacagctcacctctctgggcatcaaggatttcgggatgaccctgccaagaacacaaagagagaggaaacagaaaagcacatcagtttttagcacaaaagcggtcaaacaggtgtagtaagaacaagcaggcttgctttctctcccttggtaaagagactggcaaagccaaggcccaggctattgcacaggcagcacagctacaccacactagcaatacagatagatagagagagagagggagctggaccaaataaacactgcacaataatgagagcaaagaagagaagagcactagtactagcaagctagcagcagcagcagcagcagcagattgcaggagctgagctatgcaggagcaggccaagtgaagttggagtgtgctgctgcacaaacaacaattcaagcatgcaggcgagtagcctttcggaaacggaggcgaaaaggccccagatgcattcaaaatgccccccccccccccacactgagacccaagaaagagagacgaaaatgggcagggactcagcacctactactcctcctacccccaatctggcgatcaaaagctgccgtttttatcatcccagcgacgcatgcattctcacacatctcacctggcaagcaaccagagaaagatagagagagagagagatggacaaatggatcactcacccaatgacatggcgaccaccgtcgtgaacagcgtgggagacgaggcccatgaggccgatggagccaccgccgtagaccaggtctatgcccctctcgacctgcaccaacacgaaccaaaaacaaaaggggaaatgtaaaaaaacaagaaaccaatcaacctctctctactctcttgagtcgacaagaaaaatccaaaaggtgggggagagagggaggagatggtggtggcgttttgatgcatgcaaaaattgtaagattgttgttccgttcgggacgcaactgaggtcaccgcgctcgccagcaatcatgattggttttgtttgctcatctagaaaacctactactatagctgcctaggatactagggacgcgcaccaagagagaaacggccacggcgagccggagagtcggtcgccgccgccgccgccggcgagccggccggcgaagcccggagggggaagaaagaaagaaaagtagaaaatgaaaagattggatttttatgacggatttgggagggagggagggagaaaggacaatcaatcaaatcaaaaaagaagaagaagaagaagaagaagaagaagaagaagaagaagaagaatcctgaccagttccttgccgagctcgacggcggcgtcctggtagctggccttcctccccttggcgctgccgcagtacacgcagatccgcctgaaccgcgaccgcctttcccctgcaccaccgccaccgctctccggcgccgccgtcgccgccgcccctgctccggcgctcctctccgccgcagcctccattgccatcggcaccagcctcgccctcaggtaggtagagcgcgcgtgcgtgagcgaggcagcgattggaggagagagatggagagagaggaaattgaattggagggggaggcttttgcttgagttgaggcggatgaggtggggggaagcggggggtatttataggagatggacaaggagaggagtgggtccagcattgttgggggagggatgtgtgttgtgtgtgtaggggtagtattggtaccacgggacgggagtccggaggggaaaagattgagtttttttttctttttgtgtttgtgtgtgttagtagcatttttgttttcttttcctctcgcgcttgtgcgaaaattgcttgccacccgtcgacctccctctcactcacccaaacgttatctgaaaacgatcaggtttttccatcacacatcacacgtttgggaataggggtgaaaacggatattttttaaaaaaacgggtgcggatgcggagcgtgtttcgaatatcggaaatgggtgcggagcggtgcggacttggttcggaaaaggattaaaattattggatgttatgtatatatacaagggacgatattgatttagcaatacaggggacaacaataacgactcataagaataatccattgctaataacatgaataaataatatccattatatgaaaacgcaactacgtaagtatgagataagacgataaaatcctcgaacaaaggagtttacagcttgtttggtaacttgaggaaggggattagaagtttagatgagggaattgatagtgagattaagatgggaatttgatttttaatcccaatatcttgtttagtacacatggtacaaattgatagggagtttagttggagattaggtcattaatgaaaacagatggttgagaattgtttaggcaaagtaaaggaggaattcattctcaattaccacccagtacccaggtattcctcaattccccatccacatcccaccaaaattcacatgtcttccaaccaaataaaacagttaacagcttcatccctctaaattcccaatgcctcctaaacactcccccaaccaaacagaccattaggttaattgataatataggtcattaaaatgggtcgactcatgttatatgcaatagatagagtgattatatgggttgataatttcagattatctagataatccaatagaaatatcatataatccatatccgccagattttatagataccacatccaaatctgaatccacaccataccattcgcattcgcattcgcattcatatcagccggatttctaaaaacccataccttatcctcgttttgaacggattcagagcaaattggatcgatataatctaatccgttttcacccttatttgggaaaaacctaattctccgaaaaggatggacccagactttgagcaccctagactgtggcacgaggcataataaggttaaaagtccatatgctgaaatttattttcactatgatgtgtcgagatgatagcaaggttcacgttatcgtgcggttattgcgcttactgccggggagggggtcggttaccggtggttagggtttgagaaattttgagcaaattcaaatttttggaaaaaaataaaaaaaatcatggatgtagttcttgatttttaatggtagatggtgaagaaaatttttgaaaaagagtaagataatatcaaatatgagggcaaaaccgataattgtttaggaaatagaaaaaagaaaaaatgtattgggcttcatttttgtattttacatccacaagctagatttgaagtgtcctatatatccttccccaatttctacacacatttaagtgatttttcttttttttagcttcttttcatttttttttcatgctttctgcaaatatcgcgtttagcgtgcaaatatcgcgttaccgcgtcaaaccatgcgatgaccgcgacaaaccgcatggtaaccgtgaaaccgccaaaatttttaattcaaattttttaagacgaaattcacatggttttcggcggttaccaattaccgcagggagacgataacctcctgtaaaacggtaaggtaaaccctggatataaaaaaacatagaaacaagaaatcgaagcaattcccttattacaaaggaaaaccgaaggatttgattgccatgtcaactacaaccctacagaaaatatatgaatttgtcaactaggtattttggaactttggatactccacgggaaatcgacaggaattttatagaaaaaataagaataggtttgaggagagattaaaaaagagttgcattagacttttcaaagaaaataaaaaccaatatgtttgagatcatgttttaaatcttccaaaaagtgaagggaatatagtatttctatggaaattttccctccagatctttctatttcacaaaattacaagtttaagaacttgtttcacaaaactatagatttattgtcttcgtttatcacaaaaatgcaggtactttgcacaatatatcacaaaactacatattcaagaaccttgtttcataaaactacagatttaatatcttcatttatcataaaactacatgcttagtgtctttattatcacaaaactatatgctttagcatttgttaaaacctgtagttttgtggtaaatgaaaacactaaatgtgtagttatgtgataaccgaatacactacatgtgtagttctgtgataaatgaatacactaaatttgtagttctgtgataaacgaatacgctaaatctatagttttatggaataagttcttaaatatgtagttttgtgatagattgtactaagtacctatggttttgggataaacagaggcactaaatttgtagttttatgaaacaagctcttaaatctgtagttttgtgataaattatgcaaaatacctgtagttatgtgaaatttgctcaaaaaaaattattagagggtttcagtcttacaggttttctaagaaaatttccttgttccaaataatccctaagtgagtttcttcttgtttatggcacaagtgtcgtgcttttccttgatctcacgagcgtatcgtggctctagctcctttggaacgtctagtaattttacaatacttttcgcataactagttttgttttgtagaaaatcttatggaattatcattgtagaatctataatctactaacatgagtgcttagcctaaacatgatcaccctagtacggaaattttagggttactggccgttgtttgaagccgttgatgcgattctcattgttccttctgcaataccatcaaccggagtggaagtagaggatgaagtccctcgaactgctccggtaatcgtcggcatatgggaaataatcgtagcagtgagaacaccggcttgatcccgaaggggttgtcgtcgatcacttgcggggtagcggcggccttccggtcgccacctacactggcccggaaccgccacacgttttccctccatcgcctatgttgatcgggtttagggtttggctgtcagggagattgagaccaagagagatcgccatccgctcttgggccggcctccccttttatatttaacactgcagggaatcgggggcgactcaaaaggaaataaattgggcgccaccgatcataacgcgtagttaatcgggaattaaaacaaattagatcgctgtgatttcgcgtagacaacgggtggaaaaacggtgtagcacgatctcctcccggtttttcaaaccgagatatcaattttttcaacactcattcgatcgtcttcctggatacccttcgacaagggtaaggctgttgatgtcaacaataaggctgaccaagacattcacatcgtacaccttgccaccatggccacatgtttctgagcttgtaagtcatagtaggataatggcaaatcgcttatcgtgttacacgcatgggatgatggcaaaattttcgattatttatgaactatttagagttcaatattggaagtacgtttcctcaattgatatactccatatagtaatttccaaccagttactcccacgcttagggcatctaaaatagatgcaaaagtagtccatatgtaatataatattctattcagtcaccttgtattgttgtgcaagtagtcctcataaataaattatcaaaaggtacccatatacatatggattacttatatgggataaattatactattatctatctctatttatgtctcttttcctaatgttatcatgtatatatacattgtgaagattgctatagttaaaatctatttatgtagatcctatttatatggaccacttttgtcatgtatattggtgaatggtgatgcccttatattcagagcaataaacaacttgaattcaatatgctttctttttttaataaaaaatgaaatcatttttggtccgtcttaatttcatccttgggcttatactcagacccagtttcccttccatcaattcatttcatatcaaaattgaaaaaacacatactcttactggagtttagtacatttacgcacgtaaaaacttcatcaatcttaagatattacttatgagtttttaaagtgcccataagagtacacatttatagaagtgagtgtgtccgcgtgtttccgagtggttgcatccataccgtgttccaagaaaataatttgatgcacgtgtacagtgatgtgtatgtgcgtctgtgtcccgctatgtaataaaaataaaggactacacatttaacatttgatataaaatcccttctaaaatctgttaaatgtaattctttctcatttcctcctaatcgattccggagtatgctaagctcctccttgatagtccaaaccaaatctgtcatttggagaaaaattaactggaaaaaaaaaagagatggaacagggggaatgaagaccacacacggttcgttcgccctccctcctcgggcaaatcatcttatcccagtcaaacgggtgatcgaaatttattgccgtcgtgagtgcgaatcgcatttgcattgcatctacatcgcgttctcttctcagccacgtcgtgttgctgttgctgggtgacgacgccggaatgccgaattaatggcgagatattagtagggctgtggctggggatttgcagcacgcggcagccatggacaatgtgctgctgctttgcttcgctttgcttttttttgtggttgttgccaacaatttaattcatcgcgacgacaacgacgcattatgcatatcaccatctgcactgtccatggatggatggactgggctgggcggtcaaatcgtattcgtatctatcggtctcgtgctggaatcagatatggtatcggaggagggagcggtcaaatcgtatcatcatgggccattaatcaaaacgatcaattgctagtagtattgcccgcgagcaaagggcatatggatggatgtgtgtaggagtatgctctcctcgcattgcatgtgcattaattttgggcaagcgctgcctagttgggccctggattaattgctggtgtggttggaaaatggagtaacacctgaaatgattttttagttacttttt

SEQ ID NO: 75732 - DNA, 13099 bp, Oryza sativa
agatgactctacactcaatacacacgatttgcaggatatattaccaaatataaaaccttgattccatttggtcaccacccaatatcagtgcgctgctcttttggaatatcagttgatacaggataaccgatcagcctgcaaacccaaaaaggatctcctgcggttgtaccttcaaaagcatcaactggcgcacccaacgccaaggctatacctcgcatgatctttcttgaaagatctacaagtaaattttcataacaaatgctgtcactcataagtaacaaataataaatggatcaatagcatacatgcacaaataaagatttaaactaagtatagaagttaacctcttagaaggctgatatagttttccagcagtacatcaaaatttgatggatatttgggcctgcataaaaataaatgaaccggttatttgaattttgatagatctctgacctaaaatactcaaaggcagtctaccaaagttcagaacttcttcagtaatagctgaagtaattcaacaagcaataattctgtggtacctagtaccaactatttaatatgcttctagtaacaaaaatacattgaagtatgcaagtacaattgtagccataacttctattttctttactataattcataattctacccatattggaacataatacatgttggtactagataaaatattgtaaatataaattttattccctcacattcttccaaatagaggtgtgctataagctaaattatttatattgtgagtattattaaaatatgcaatagatcaaaactggggtattgttttatatcaaagtcaagtacataatatctgtctcgcatatgtcaaataatacagtgctgtaggaaaaaaacagagatggagagttggatacataccacaaattagatcctaccattggtttagcaaggtctccatatttaccaggttcaataggcgtgtagcactgtgatgttttttcttccagggattaactcaggaacaaattaatggatgataaaaaaataataaagagaaaattaaacttacatcaattgcttcatgcatgtcaggtttacccttggtaatattttcaccaactctttggtaccctctgacagtaaagacaacaaagttatgttatacaggaaggaggattagaaggatccaatgtggaacaaggaaaaatgttggaaacttaaaaacaggttgaagctgtcattttatatcacacctgtatccactctgaggtgtcattttaatcttgagtttttcctcataaggaagctgaaagaacttctgtgtcacatccctaacttgcttcattagcgagtcagcaatcccatggcctttctgttagtaacatacagacaccatttgattaggattgatattgtgtagctagtctgctgtacccattgtagtaaactgatgctaaaaagtctgaagtaggctagtaagtaaataagtaaattttaccacataaaagaatccagcctccctgcaggcatcgtccaacatttgcacaacttgcagcaaatcctcgtcattgaccatgctcggatcatcaatctttccgacaaggggactaatgtctgacaaatgaacaaagatagaggaattcttcaaatggagatttcaaagtacaagcatatatcatctcatcccaccaagtatctttacacaaaattctacaaaagctgtatctagtatcctttgcagacaagcagtcgtaatctgtggttaattgaactaactgcaactggtggtggcaaagcaggtaaaagaaaaaaaagaatcccacgcaggattccagaatctgaatctgaatcttaccgatcaaggggattgccttgaagtcagaacccatggtgatgcagggagagaagccgcctgtggggacacgaacgcggcggcggtcgggcgatggcgattccggcggcgggcgggcgggcgaagagtggcgtgatagtgcggttgggttgggttgggttgggttggggattttggattgctgcgatagcggggtgactttcgacgtcatgtgcggcgttttatagaaccaaagtgtaagaaaaaaatgggaaagtatgtagtggaaacctatacgattggattgcccgaaaaaaatgatgcgatatgcggtgcgctctgacccccgacccgagtaagaataggattggattgccatggtcaatttggagacgaccaagcaaagcaaaaccacttttcatgtactctgtctgccgtaccataccatacggcgagaaatccgagattttgccattgccatcgccacaatgccactatgtttacgtcaaaaaagaaaacaatgacatctcacacaaaaatacccttggttcttcttcccttccggctgctcgccggcaacgaagccatggcgtgggatggagggagcaagtgtcacaccccgaagttcttctcccaagtctaaattaattaataaatagtctcgagaaattatttgtgaagtggcaagagagaaaccttaatttaataaatgcaaataataatcggaaatgacatgtgaaatttttcttgagttctacgtgtcaaaatacgctaacaggatttttagtggaattttcagagctttagaaataattttaaccaaataaaaatgagcacgagcaattatttaatccctgaaaattcatttctcctttttctttttctttttctttttcccctcctttttcctaatgggccgctggcccattctctttccccctccccctaccagttgggccggccgaagtccaaggcccatcagccggccgcccgagcccctcctcccctcgggtcaccgacaggtgggcccgtccccaacctctggctggcgccgcccgtgcccgaaatcgctgctcctgcctctcccgcacctcccgggccacgccgccggcgtcgccgccttccccgcgccccgctccctctctccacctccccactactccggtgaaatcagcccactcccagcctccccgagccccctcttcccctatttaagcaccaccgcccctccctctctctttttccccatttcgccgagctcccccgtgccctccttcgccctagcacagtcgccctcctctccgccgccgccgccgtagcttcggtcgccactagccgctgcgctgagccgcgccatcgccgccatcggattcgcgagcccgagggccacgccgtcagcccctccaccgctggagccccgttcgcaccgcacgccggtgagcttcgccatggccgccgccttcggccggcgtccccgtcctctatgatctctctctccctctctaatctttcccattgtgttccttaggtgatcccgaagctcggccactcatcgccatcatcatcccgccgctcaccatcattgatcgtcaccggtgaggaactcctcaccttcctctctctctctctcccgcgccacttagccgccgcgccgctgcctagccgctcattttccgccgctagcgttgcccgcactgccgtgtcgccgccgctctccgccgccggtcgccgccttgtgccgccgctgcgtcaaaccgcgccgccgcgcgccatggccgccgagccggcttgagccgggcccgtgccaccctctctctctccagggtttaattattgcgcaataaatcaattaaggattttttttgtttatagtaaaaacgcagtgaatcttctaaaattcatagaaaattcatccgagctccgtttaagcccattcaagtctcagtaaatcaagaaaaatgcaaagaatccattaaaaatggttttgttctctgtttcagtagtcttatagcctgtttgtattattttatcacgcccagaaattcacgaaccagaatttctaagctgaatgtgcattaaatccctgtccaggaccagccagggtacacaaacgacaactgttgacatacaaatccacgtcttacaaaaatagaaaagattacaaatgcagcggaaaagataaaagcgagctaaaccgagaagcttgacttcagtagcggggtgactccactccacaggcaaaccttgacggcagcgacgaaaccaacctctctgagacggctccaactgagaagaacttcaactctggtgtgggggaaaagagagcaagactgagtactacccactgtactcagcaagtcataccggaagaggtggtatgatgcaggatataaccaaagcaggctaggggttcttttgcataaagctagcatttaaaagcagtagttgaaagcagtaaaacagctgtagtaattaatcaatattaaccaatcactgtccaacgctacaccacgttgcaacaggcccaaccaaccacctgaactacaccagttcattaagctaaactagggtgagactaatcacggtgaatctggttgatcgcccataactgtgggcacggctattcgaatagttttactctggccagaggtgtacaactgtacccagaagacacgattccacacatgtcgccatgccccgaagtatcaccatgatactgcaaagggggaaatcgtgacaagaccctccgcataaccctcccctaaccatccacaccacgctaaggtttcacccccacccctcaaaaggcagtgggcggtcccctcttgcgccgcggtgaatccggcagttggacaaccggacaccccggccgacccaactccatcacgcccaccctcgccactggtgcctaggaaagggtcgagctatacttcagatcaagcagttacccactcctgcttgtggtaagcacggtaagtctcccagggtttcccgtgaaccggtccttaattgccatgggtgcgaccagcaaaaccatgcacccacaacccaccattcggtgtattttaattaactaacaccattgcggtggcaccaaaccaaaactatgctcatagtcagagtctatgtaataatgtgatccccttttgtgtactagttgaactaagcatggctaagcatttcctaaaccaacatctaatcattttgataccccagttatcaatggcatatggtaaacaatatatggctgagtaataggacccatcccacataacattgaaaaagaatgcaacatttaatagaaatgcgggatatttgtaaatagggtacaatatgatcaaatataatgcatgacatgccttgctctcgcactaatgagacctcagcaacgtcttcgagaaactgcggatcgacgaaacggccgaaatctacacgacaaacaaagcacacaagcaaaacatactataagactactgaaacagggaacaaaaccatttttaatggattctttgcatttttatgaatttactgagacttgaatggacttaaacggagctcggatgaattacttatgaattttagaaggtaaactatgtttttactaacaaagaaaaaatccttaattaatttattgcgcaataatacccagagctgacgtcatcaaagggggggggcggcgccgacatgcgggccccgcttgtcagcggcacaaggggagagggagggggcgccggctggtggctcaaggggaggggtggtccaccagtctgtgaggcccaccgggcagcggcacaaggcgggagggggagtggatggtggctcggcacggctcaagccgaccgaccatggcagggcggcggcggcggcacacggcctccgaagacgaccggcggacggcgaggcggcggcggccggcgcgaaggcgacggcgcacggccggaacggcggcgtggctcggcgcttgctggaagggaaaggaaaggagggggagggaaggggtcctcaccggcgatgcgagggaatcgggttccggcggcggcggatggcaaccgagtggtgaccgaggtgcgggcgacactggcgagcgcgacggcaacggtttcacggcgcggcggcggctttagcggtggtggcgcgcggccggaggcggtagtaggcagcggcgtgtagggagagcggtacggcggtggcgaacggaaagcgagcggcggccgaggtagctctcacggcggcgaagctagcggcagtgattgcgcggcgaggcgacggctcttgcgacggcggcgtgcggccggaggcggcggcaagcggcggcgctagcggcgagcggcgcgggctcggtaggaggcacgggagggggcggcgagagcgggaaggggaagaggaggctcgggggagcaatttataggtggagggggaagccgtcgtggccgggaaagcctccgatttcgccggcgacgtggggtggagagagagaatggggggattcaaattcgaatcccgccccttgcgagcgcgcgtgcgggccgggagacgcgggagagagggcggcgatgtggggaggacgcgggagcggcgcggtgtgggcgcgggaggagcggaggaggtgggcgcggtggtttcgacggctggaggaaggggacgaccccgacaggtggggcccacctgtcggcgtcccggagaaagagggcgtgagggaggacttcggggaggggaagggaggagcgggccggcccagcaaggggcacgcgggaggagaaaggtgggtcgacggcccaagaagaggaaaaaggaggaaaaagaaaaagaaaaagaagaaaggatttttcctgggatttaaaattgcccttgctcatttttaattggttaaaattatttccaaggctctgaaaattccactaaaaatcctgttaatgtattggagcatggggaacccaagaaaaattccacaatgccatttccaattattaattgcattcattagataggaaatcagctctaggttaattaagataatttcttcgggcaatttatttaaccaatttttaaagcaagaaaaaggggggaaagcttcagggcgtgacatgtttgctttgtatgtcgcatagattcctgctctcccgacgctccggtgtacttcgagatagtcgccgaggtccctccagccgcagagcaaggcaagtcatgcttgtcacttaaacatattggtcccatattgcaaatgctctattattttccttaaatactgcattgttttataatgttactatgggataattacctattgtctcagccatactattggttatcttgttcctttgttagcttggggatataacaagattagatgttcggttagggattgcttagcaatgcttagctcaactagcacacaatgggagaactacattaatgcatagatttcaaattctaatattggtgttggactagagccaccgctctagtgttggttaactaaaatatactaaatggtgggctgtgggtgcatggttttgagtcgcacccatggcaattaaggaccagttcgcgggatgtccttgaagaacttactgtacttaccacaagctagcgtgggcaacggctgggcatgtagtatggctttcctctagctgacgcatccaggcaagggtgagcgtgatggagttcggatgggccctgcgatggcctatgtggctttcggattcacctaggcatgagaggggactgcccgctgtcttgcgaggagtgggggtgaaacctgaggtgtggtgtgtttggttagagggggtaatgcgaagggtcctgtcacggtctctttctggtatgtcgtggtggcatgccggcgcacagaaacgtgttgtggggctgtgtcttgtgggtacagttgtacatctctgatcagagtaaaactattcgaatagccgtgcccgcggttatgggcggtcaatcagattcaccgtgattagtctcacccctagttagctaatggaactggttagtttaggtggtggtttgggcctgtctcaacgtggtgtagcgttgagcagtgattggttaatattaattaattactacaactgttttactgctttcaactactgcttttaaatgcatgttttatgcaaaagaacctttagcctcctttggatatatcttgcatcatacctccccttctggtatgacttgctaattgcagtgggtagtactcagtcttgctctctgttccccacatcagagttgaagttcttctcagttggagctgtttcgaggaagttggtttcgtcgctgccatcaagggtgcctgtggaatggagtcgcccgctgcaggagtcaagtcgtcaggcttagctcgcttttatcttttccgctgcatttgtaatcttttatattttttttgtaagtcgtggatatatatgtcaacaattatcgtttgtgtaccctggctggtcctggatagaggtttaatgcacattcagcttagaaattctggttcgtgaatttctgggcgtgacagcaagtagcatcaccatcgcactgtgacccctactcgccagtccctcgctccttgcgcgactcccggtgctcgcactccgcctccatcaggccacaaggcgctctcaattgttcccttttttttaatgaaccagcacaagacagtgccaatttaattgaatagagcaggagaaaaacggggcttttaactatttgccactcttacggatgttgcttaacgatttgccactagacccacatgtcatagacacataagggcccacatgtcattgacaggatgtggcaaatcgttaattgccatgtcacaagagtggtaaatagttaaatttcccgagaaaaactaatagaacgacaacatcagctaacaacgtgtccgcaatctacggaaggtgactaggaggcgatcttggaagctcatctctaatctgaagcgctgacaagtcctagccaagatcaacgtggtttctcgtttgatctttggttgtgattcgtaggtgttaagttctcttaatctgttttggattgcaactactgctacgtatcttgacgggagcgactcgggttgttttaatctgctactgccaagattgattcttggaagattctggttgacgacaaatttctgtgcaagtgacgtggtaaccctaactctacgtattgttgcttctttgtttcttgtaacctgttctgcgttggtgtcgccgtctaacatcggtgtgggcgatcaaggggattccggtgaggattctacccgcccgaagccgtttgttagtgggacgtctagggtaggacgatgtttactcaggaacatctgtgtttcttgatcatcgtcgacaggcaggacgtgggcttccatgtcaaaccatgaagacgccggcaagggcgaagtgcatatggtggacaaggatcaagtggagaaggaggatgcttgacttgtttctttcggtcatgcatctaaaccggaagataatcataacggtgcgatagttttgtgtcacagcctaattttccatttcagaatttataaattatttaataaattattaatagaatttatattaaatgtttattaatttacaagtgaagttaaatgtgggaaataaaatttcctaaatataaagcatggctggatttaatttttattaaattctccatgaataattatattctctgaaattttctcatatttttcggagctcaattcctaattttaattatacaaagaacatttcagtaattatttaaataataaattaatcattaaattatctggatattattatattaaatactttgagtgtccaagtatgttcaagagttttcttggaattatttgagcattggaagtatttttaacaattgaaagatcatttcattggttaatttatttggaaaagcaataaaatcatccttcctagtcttgggccgaattcagcccattccctcccttcctctcagcccggccgaaagtttgttttgcccccccccctcgctacagtactccatcttcctcctccagccgactgtctcccgtgccgtgcacagtgtcgccgatccccttccaaaatccggccacctcgttgctcctttttccaaattagttgcgggaatggaatcctctcaatctcctctttcttttccccaaaaaatccccaaaagtttctatggagatcctttccaatttcgcggttcaatctttcctttttccggcgagaaccctagactttcccgagtttttcccgtcgttgtgggctcgatcccggcctcccatggctatatatagagccccctccctctcctctttcggccgccacctcctccttcttctgccgccgcccgaaaccttctccccgcgctctccttctctctccaagcgccggcgccgctccagccgcatctcgccatcgccccggccgtcgccgatcagcgccgccacctccatcggctccgcaacgtcgagctctaccccggccgctgttgttttgcgccaaatccaatcggaggtagcccgtcgtcgtgaaccggagcgccgccgtcgccgccgtgtctccagccgccccgcgccgtcgctgtggtcgccgctgctgctcgccgttgcctccgtcaggttcgcaagaaggagctgcaccccgtccgccccttcgtcgccaccaaaatccaccggagctccatcgtcgccgtcaacccgaagttcgccgtcgcgttttgatctccggcgaagccctgctgctcctcccgtcatcgccaagcttcgccgtcgcctccattggattcgcagctgcgaagtgaagcctgtccacccctcggttgtcgtctctcatcgccggaaagtcgtcaccgccgtgtacagtacctcgccgcccttccaagctggtcaccggctatcttctgtcgccgtccgtcgtcgcgtaagtgttggtaaggaccgtcgcctcgcgctctttctcctggtgccctccgtttgcatatttgtgccgtggttcaccggcaaccgccgctcccataccgttcaccggtgtaggtttttccctagggccttaatttaatctaatcttgtttggccctagcgtcgtcgtcgtctccgtgtgttgtcgctggcgtcgccgttgcctcttcctcttcggtcttccccggtgaggcctcttttctgttccctaggtttaatctttgtgtagctgcaatcgtgtcttcgtgtagtcgctgttgtgcagccttagcccgtgcgtagccgtgtgtgcctagccaccgcagccgacccatgcgccgtcgctgccctagttgcatcgccgctgctgtccaagccgccgccttgcgccgccgcttgctgccatcgtgccgctgcttgctgcgctggctctgccaagctgctgctataccgcgtgccgtgtcgctgctgcatgctgccacgtcggccgtgtcgcttgctgttgccgctgctgctgcgtcgcctttgctgcgtcaccgctgctgcgcctgcacgccgtgcagcgttgccgtcgctttgccgcagccgcttgctaccaccgcgtcgccgccctagcgtcgagccggtcattgccgtgcaccgcacccgctgttgtccgctgctagccaccgcgtagccactgccctagtgcacgtactgcagtcgccgcgccgctgtcgtgcatcgctatcggctgtgccgtcaccctaaccctagctttgcgtttccgccgagccgccgcctagccgagccaagtcaccttagtgccgctatgtcgcagctgtgtgtcacttaaacctagccaccgctttagctcgttgctcagtagtcgagttgtctagccgtaggtgcaaccctaggttcctaccagcctatcgtttgccgtacctgggctttaccgtgaatcgtgtttaccccaccagtttagccacagccgttgttgagtcgttcgctcgttcgttcgaacgaggtgttccccgtgcttcgttcgtttgtccgtgttgagtcgtcctttaatttagagccgttcagagccgccgattccgttcgccggtttcggttgatcattagagtgatcccgtgtcacgtagaattgactcgttgagttggtatctcgtgaggcccgcttgccagatcaatccaagccatccaatcttggtcaactctatgtcaagattaatcttagccatccaaaatcaatataaatcatttcctctcttttcagtggcatattatttctttttaatatatgtcatctaccaaatataatctaatcttttccggaggttgttttaatcttttatctcagttataaatcatttgtaaattatttaattaatttggaatagtcttttctttaatagatttaattggaatttaatcttgtaaaatttgtaattaattcatatgaaatcggaatgaggtcgttcaagtctctaaattcatctaaaatcatgatctacatgtttgtttactttatatgtactatttatttggagtttcttagtcttttttctcgttttgcgtgttagcttgtcgtttccgtcgtttcgaaggttcgtgagtgcgttggaagtattcaagaagattaattgaagaccctttattgcaaggcaagtcacacagatcccaaacacagttcctttgagcatgttgatcctatatttaaattctctatttatttcaactgtgtatttattttcgaatgtcaccgggtggtgtgaacttattcctttgttatggcctgtttgcattgattactctatattccttgataccttgggttattataatttgattagttgagctttatatattggttcagctagatgttagacatcattgcttagccatgcttagaaacattagcacataattgggataactaatgtttcactattacttaatgatggatatttaatgatagctcacgatggtcaatcgtgattggttaattaattaatgtgcttactaaaacttgataatggtgggttgtgagcacatggttttgatggtcgtgctcatgacaattaaggaccggttcacgagtttcggttgtgaaacattaaccgtgccaaccacaagccagcatgggcaacgactttaccttttgtataagaaggctcattgcggaacaccagactgagaagtggtggagataagcccacgggggtcgctggggagtccatgccttgtttataagggggtgattatgatccaggaacggtgcactgctttaggttgagttatgcgaggggtcttgtcacaatcactcatcatggtgacgtgtctgcgcggacacggtgccatga

SEQ ID NO: 75733 - DNA, 23122 bp, Oryza sativa
  unsure (1)..(23122): unsure at all n locations
aatatgaactggttatttcataaaagagtgtatacatcaattttatcagcattgggcagaaaaaaacctaactaattactttggcccaatcaaaaacctcaggatgagatgaaagagcaatctgcaatattatggtaacttggacgtataatttgacaaaaaaaattatattagagcaattacccataaaccataatagtcttctgaacattaaatcacaacatgaggtacaaaatagcctgaactgtggtttgcattcaggaaagaccaattaatgttatgaattaggaaataaatatacaaatctataatgctaacatcaagtaatgtaaatcttaattgatcatgatggtagaaaaactgaaaaaccatgctccgaaggtttaccttagtataagtagaagggtgaaggtcccttgcaaacagtacaaagtgcaaatttgacatcccctgcaactgaatttttaagaagaacttccatctacactgcagaaagccacaaactcatatattttggagtgcaaaatatctatatcattatctattttgaacaaatattgggcccgtaatattgctcttacctttacaaagaatcctcctgctagcatgaatgccatgattcatgactgtaactgaaggtacagtttttgccttttttttatatccaagagggtagctccaattgccaatcctaaattcctaatccctgcatattacttcctgggtcacagatttctaatttccaggtaatatataaatttaaagatgaactaaactaattgccagacaatataatatttgcatattaccttagctatatgatgtagaagctgaattatcctgagagtcgtcgttgaatccggcctagacgttggctcatcaacaatggtagattatgaaaactacctttcaaggcgaaatatttcatatatgatatggctcagcgaggatgacacgcaaggagtggggtgtgaccctcgtcgcgttccacctcgtcgccaaccacagaccacctcgcgaacatagaatatacaatgaaagattagcacttcatcgaactgctatttaaataaaaattagtgtaaatattagtttataacttaatgcaaagcttatttaaatgaaaattattctgttttacatactaaccttgcatcacatatctgtaatgttctttttaaactttcagcattcattgaccttgggcgcgcaatagctgtggaactgatctcagtaatgatgcccataatatttgcttgcatatgaaagtagaatagatcacagtcttataaggcaatgtacaaatagataaaatgaaaatattatagtaatatatcataccaacatagaatatgttttttatcaacaagagaggggatttcatggaaaggcgtcaatgaaaatgttatggcaggggaaatcaggtgggatgtcaatgcattcttctaaggttgtccatttactgaataaattcatgaagtcgtttgaaactggtttgtaagtcttgtttgcatctttaacaatgaacgactctatgtattagaccttcccttcatggatgagaggtttcagaacctcaattgcaactcggtatatctgaacatgaatgctattgccctacatatttttaataggatatactatattagtaatatgtttggtatactaatgtacacatacaataagaggcatatgagtagtgatttgataagtaccacttcatcaagtaagacaaggtctgcaggatgtttgtatcatcattgatcacgaaaatgccaaagtttagaaacccttgcgagaatctttttgtctgaatccccagggtaaagctgtgaaatgagcatgtgtgcaaaaagcataaacattttttttcgccaggagcataaacatttcagtatctaaatggagtaatgctatgcgatgaaaagcgatgataaaaagaacattacttacaattataagagccttatattgcaggaaatatatactatacaatactgtctaggtatctatttattataaaatgtatgtataaaagcattggggggggggggggtcttgttgacgaaaaacactacgtatcaagctgcgaagcctgcaacaacagtatatttgcattattatagtagctttggtaggaaaaaatgaaacacagtatgcagcaatgttgagagcagcaccgttgtcaacgtagcaggtagtatctcagtgtaaacaacctatagccctagattataatgaggggtattttttaccttgcaccataatcctttatctctcttaaataacttcctatatccctaattatattatggaatggagggaatattaaaatctgtggagactgttggaaacatagaagctcattgcatgagactgtcatatctgtactatgttcataagcttctcgtgtgaagtattttttacgacaaagcttacttttagagaatgataaaaagtttcatatttattttataaaagtttactaagaagagtacatgtagcatattttcgtatgctacatataacatattttccacatgttatatatattatctaaaaggaattctatacaaaattaattgttatctttaccgtcttcagatacatactatttttaatatattttaattttcccatgcataatattttctcatatgacaaagttataaacattagttatagttgcacaacaaattactatattatcaatggtagatattccacaccttccatgcccacgtgtaaattcaaccttccacaccaattaaacggtcacttgacgaaaaggatatatttggaagggaaatttttttcaaaattcagggtatgcaagtgagtgaataaaactcggagcatggaagtgatagcatatgatcttaagggaatacaatgatttttctttaaactgaaactgaccaccattaacatgattacggttacgagaagtgcttctatgctcctcgaaaaaaaacctgcacgaaaattaaatcacatcaatggctcagattaaaaggtgattactaggataaaccatcattagcaaggggcaattttgtcctggaagtaaaagcccacatccagcccaggccgatcgctccatcgatctgggaggttgacatggcaacagggctgggtggtgaagatcaccagatcggccggccatgtgcgaggaacgggaggggcgacgagctgtgcgggctgttgtcgttgcgctcggctttgagacgggttataggacgatgagatagaggaccagttctcgaagggtagtgtggaagcgacataccagatggagcatggccgcatccgctacggcggccgtccatgatgacacaaactcccggcgaaatactcgcttcttgtacctagcgaaaccttgatagaaatcccaacgattcaactgttttttgatttagtggttttcgtccttttcaaaagctgaaccttttggccgcttgacatgggtgttgcagatcttatcagaatatcattccaggtgcattgcgagggaatcgccatcgtgaatcgatcgatgagaggcggctgggtacgggatgggtatggatatgaacttttgcttcctggacgaaattgcccctcgctagtgaggtttatcctgttaatcactttttaatccagaccattgatgtgctttaatttttgtgcagttttttttattgagcatagaagcacttcttgttacgaagaaacatgcttatgtgatcttcagatgacatgcaatagttcttagattgaagaaatctgagagaattccatgtgagtatctttgaactgtgatgtatatataggagtacataccttttgcttgtacatttgaaacttagcctcggtgttctgctcctatttgtatcaagtcatatccacttctcgttacgaagcagaaactggtgctcttttatcaacttgtgaaggttaatatatcgctacaacggctagcatgttccaacagacattttgacccaaattaaatccattttcttttgttctgaaaattgatgttcagattgatgcctaacatgcagtggagatttcaattttactggtattctacctgtttaaatcttgcttatcccaaacagttcctctacgagagattttgattcactgttatcttccgtgacaaacaattacaggtgtacttacataacaagctgttctgaagcaggtcctgaagcatctctctgctgaattcgtgttgtttgcatatacggaactaaatgaaattccagatatgtttctgcatactatgctccacgaactaggaatccttaccacttcctctgaatgctttgatatataaaaaaaactgcatactttgatattcacttgattgtgcatcacacctgacactttacaacagcacaagtgatgaaagtaatgtttttcagaactgatacacctcaaactccctcagaagcactgtttaccaacctgaacttttacatgccaacacaaaggaattcagagctggtgcaacacaattttgttcttggcatcgagcatcgttcaacgatggtgaactgaacgtggcacacatcacagggcatccaatatgtaggagaatacttagcagtaacacaaagagaagtgacatgcatatgtataaatataaatcaaacacggggctttagacacggaaaacaaccaaattacacataatatacgcagatccaaagagagcagtgcaaagttactgaaacattggccccagagagtgaggttacagagtgcactcaaacacctaaaacaacatagcacgtcgctgctgctcttattgacttcctagctaaccccattgtcatgattaagggtaacaaactgaccattgccctatgcaagtaagatgatcaatgtccatctgccagtgaatctgagtacaagggaacatagggaagataatgcagtgtggaaacaactccaagctcacctatataatgcacttccctgctatccatttcataggatatcaatattccttcatttggcaaaacaaagaaaatgatattccgttccgggtgaatcgagacaacttagtagtcatgtccaaaatcttttctccttcttccaaatagatgtaaatggctgacagtgtgcttcaaggtccactgatcactgctgtagtcctgaagaacccatactgataagctgttatacagatcgtagcgatcggtatttacgaaatacagtcgaccttgagacagatctacgaacccgtcatcgacattgcagtcaggatcatcaagagtttgtggcattggaatggtcctccaagaattcccctccacatccaccactgcaaccacataccccatggtgatcaaatgcagcatcccgttgaagaacacgctcctccaatcatcaagcaccccgatttgatggccccaaccaatgtccttgtgactccacactccagtttcagatgaatagatctccagcgcgttgatagttgcatcaagttcaccatcatctgcttccccatccgcgttcgcgggattcttttccaccaactcgaacacatggaaatgggaggaggagaccgccggatcgaaccccaagtaggcaatctgtctcttgtcagaccttgcggattcaggcaggacgacccattgccgagtggcgtgattaaccactaggtaatcgaatctccgccggtaatcggaaatcctccagcagcggcagaggaggccgttgcaggaatcgaggaggtcgagggcgcggcaccggggaaggaagtggagcgaggggtcgaggaagagggggcggcgtagtggtcgaagaatccggcgatggcgccgtggaggtggtagcgagggaggcggtggtcggagtcggggtgggagatgacgcggcgccaccgccagcagacgcacttgaggccgcagagcgtcttgtagggcacgcgcgagaggacctcgacgaggaggtcgtcggtgaggttgtcgtccggcggcgggatcccctccctgcgcgcctccttggggggggggggggggggggcgcaagcgcgcgctcagggaacgaggttgttcatggggttggggcgcgtacgcgcgcgcgcgtcagtggggccccatgtccccatccccgcgcgcccccttttttttttcttttcctgttcgtactttttttttcgattttttcgcctccggacgcgtttttcctttttttttggccctttttttcgattatttttcaatcttttgcacatttctttataaatgtagaattgaaagtttataattttgactcttgacttgaaagttttcaaatttgagatgaaagtttcaaatctaatgttttaaatttgtgttgaaagtttcaaatttgagataaaaagttaaaagtttttaaatttttacttcaaaaattcaaatttaaggcaaaagttttcaaattttgacttcacgtatagatttatttttaattttttatttaaaaaatcttaaaaaaaatcttatcttaattatcgtcatatctaacactaatcggattagttattttattgtacgcgtttctggaaaaaaatcgcaaaaaagaaaaaaaactcacggtgcccaccaaactcacgcgcatgtaacgagggcccgccacgtggcacgcgcgcgacttctctaagtcgcaaagtcgcatgtacgcactaattagcaaaaccgagacatgacagttgcaatgttctcccaaatctaaacaattttgctctatattttatcggtaaattttctcccaaaatttattaaatgtaaatgtagtataattataatgaatttttttaagaaacaatacaaacgcgggcgaccacaatatgcgtgcactcaccgctatgagcacacgcacaccctaccctattaacctaaagttttctaattagcacgtagctaaaaatctggcgcgcaatttttgatgaggctgtttttttttttttttgcgctagcaatgacgtgcgccggattagaagaaaaaatcggataatcacggttttaattaatctttcattccttttaggaggtttgtttcttttttccttacaaaataaaaatctatacgtgaaatttaaaactttctatagaagaaaattaaatcacacctgtaatttaaaacgtccaactcaaaattttgaattttcaactcaaatttgaaaactttcaactcaaaatttaaactttcaagttaattttaaaaacgttcaactcgaatttgaaaactttcgatccaaatttttaaaactatcaactcgaattttgaaaacttttaagtaaaattgaaaactttcaagtaaaaatttgaaaacttccaactaaaatttggaaactttcaactcaatttggaaaactttcaactcaaattcaaaaaaactttcaacttaaaatttgaaaactttcaattcagatttgaaaactttcttggtcaagattttaaaacttttaatttgtgtgctggagattaaaaattttggaataaacgaaaaggaaaaaaagaaaacacgtcaggaaaagggagcgcaaaaaatggaaaaaaatatcaccaaaaaactacaagaaaacaagtcaagagaggggagcacaaaaaccacgtaaaaacatgtggacgcgatgggggcgctagctagcacgtgccagtccttttgttgacacgtatgcgcgggatagcaacccccacccccttcccccataaacacctccgatccccttcccccataaacacctccgaatgactggtccggcatatcttgagagttgagattgaaatatcaccacgggcaccttattgtcgatgggtacgtttctaccgctgaaagaataattagctgtaaatacgagcactcgtgtcaaaattaggatttgatgcaacttacatataattttaaatcgttaaatttaccttaagattcatgcaagttgggaaggaaaaaatcatagcgcacacgggtgaggagattcggtcttgtgctctctggttcgcgaaaatagcttgttaatagggttttttttttgaaagttatatacaagttgtatatttgtattgtagttatatgcaagttacaatatgattatactatatttatatctgttatttttttaaaaaaaacaagctaaatgctcgtgcgttgcaagggaattacaagtaaaattcaaaaggcaaaatataattattccctctctaatcatcatatcacatttggtataattttgtgtatatatgttgagctacacagttgctcatagtgatgaacaattgatataaattattcagagtgtttatagtgatgaacagtctatctatctattatatatattattaaggcaactaaaaaagaagccaccacgctcaatgtaaggctagaaatttccatattcatcacagtaaaagaaaaaaagttcaagcaaaaatacaatttagaaattaactaaaattcagaattaaaaataaagaaaatttgaagaaaatttcatataggacccaatacgagattaattaaaataaaatataaaataaaattttgaattagaaaaagaagagtttaaataaaaatgcaattagaaataaatgaaattcaaaattaataagttataatggaagacgagtccatatagaaacccactatgagattaattaaaattcaaaataattcattcataattgcaattttcataattgcagcactagtatagtgcagcctgcagacatttatgatcaacagtagagaaaaataattggcaatagataaaacgaaacaggttgatgaaatgatcaatcattattccatcattagctaccaaagtcaggatatatatacaacaactctaggcatctagaatatcaaaaatttccagtaaaaccactataatcggacacaaacagaacagttttaatagtttccattgtctagatgacacacattgttcaacgcaacaaggagacttatcaatgaacatcaacttagccatagccattgagttccactaacatgatcgatttcactagctaccacatgaaacattacagcaaagctaaaatgtacattttggaaatatacagtactgctaattggcgtctgacagaaaataataattcattatagccgagtataccctcgacatgttctacaattgtgatatctttcatgtgatttagcgttcaacagatcaaatattggaattttccttaacagtctaataaaaaggtgtagccttccttaactagttcatatcattccaacactgagaactaacataaactcccatgctaagcaaaacaaaaggtaggtaaggtagtctgactaaggaaaagaatccaacaaaaaaaaaaaagataaatagcataatgtgaaagcttaaacaatattgacgtgaataaacgcttcctcatgagggaataagcaatgtcaagaataaatttcttagacactaatcatgcatgactcaatggaaaatataaatatatgattatagcctataggatccatagttaaatggtaagtgctagagggttttagacactgtaaacaatcggataaacataatgtcatgcaagtccaaacagagttcaaagttactgaaacattggccccccataaagtgaggttactgatgacttaacttcaatgccataattaaagttaacaaactgagcattacgctatgcaattaagatgatcaatgtacatttgccagtgactccgagtacaagggaacatagggaagataatgccgtgtcaaaatatctccaagctcacatatataatgcacttccctgctatccatttcataggaaatgaatattccatcattcagtgaaaccaagaaaatgatattccgttttgggtgaatcgagacaactttgtcgtcatatccaaaatgctgtttgtcagttccaaatagatgtagatggctgacagtgtgcttcaaggtccactgatcactgctgtagtcctcaagaacccataccgataatttgtatagatcatcgcgatcggtatttacaaaacataggcaatcttgagacacatcaatgaatccatcatcaacaccataataaggatcaacaaaagtttctggcattggaatggtcctccaagaattcccctccacatccaccactgccaccacatcatccatggtgatcaaatgcagcatgcccttgaaaaatacgctcctccaaatatcaagcgtcctaattatgcagccccaaccattgttcctgtgaatccacactccagtttctgatgagtaaatttccaccgcaacgacatttccatcatggtcaccactcatacccatagcactatgctccaccaactcgaactcgaacacatggaaatgggacgaggagaccgctggatcaaaccccaagcgagcaatctgttccttgtgagtccagccagattcaggcaggacgatccattgttcggtggcaggattggccaccaggtaatcgaatctccggggatcggagagcctccggcggcggcagaggaggaggccattgcagatgtcgaggagccggagatcgccgcagtcgggaaggaaggggagcgaggggccgacgaagcggcctctgcctgagaagctgatgaaggatctgtggtcgaagaatccgacgacggcgtcgtggaggtgataccgcggcaggaggcggcggtggtcggggtcggagatgacgcggcgccaccgcctgcagacgcgcttggagcggcagagcgacttgtagggcacgcgcgagaggacctcgacgaggaggtcgtcggtgagcttctccgccgccggcgggatccacaccctagaatcctcctcctccgccatggctgcgcaagagagagatcagagaagcaaaagggatcacggcccgtttggttaggagggactgggtgtaaagagagatgagactatttaagtgttttgtttggtttggagacatgggaattttgatgggatggtgatggagaattgagtaaggaactccctcctttttaatacctgggtaggggcaggtaactgggaggaaattcctcctttactttttctaagcaaatctcagctatccgtttttattaatgacctaatctctaactaaactccctatcaatttctatcatctctaccaaacaagatattaggtttaaaaatcaaattcccatcttaatctcatcatcaattccctcgtgtaaattcccaatccccttctctcgagttatcaaacaagccgtcaggaaaaggacggcggcgcggcgagggctttgttgtggtgatcggccatacggtgtggggaatttcatctaatcccgatttttacggggaatcatattatgcgaaagaaaaggcgaaacaaggtatttacaaataaaaaaataatttataaataaatttttatataaatggtaacgattttaaaaaaggctgaaaaataaactacgatgaaaaaattccaaaatcaactctacatttaacgttagaaatttaaatgttttactaataagtataaacataattgaaaagatgaggagttttttttttattctgcactttagccctttggttatggggttttaccgaaacagataatatcactattaacaattatcgtacatgccatgagtttgatcaatggacaaagaaaccataaacccttccatgcgcacgcttcctatactattaaaatgtgtatttttttctgaaaagtttcgatataaaagttgttttaaaaaataatagcaatctattttttaaatttaaaataacaatatttctctcaaacactccaacttacttcctcgttttccgcgcgcacgtttctcaaactactagatgatgagtttttttgcgaaaaaaaatttctatacgaaagttgttttaaaatattatgttgactcatttttaaaaaatagttaatatttaattaatcacgcactaatggattatttcgtgttttgtgtatggggagttggggataggcacctcccgaacacgagaaatttggcattatgccatctttggaatggggtttcgctgaaatgtcattccggaacgtggcttcgttaaaataccactttcagacgatgccaacttactggaatgccattttctccattttacacgaattgtaaatgttttggcacatacactaatctttttgcgccttacctaagccgatgatgcctttgagctctgccgccgattgtagccgagtgaggaggacgggttgccatcggaataaagatggcgcatccggccgatgtcacctttgagctactccgctgtcgcggcgccggtttccgctgagcgagaaggagtggtatgggtcatgggagatgggtggtgttatggaggaggaaggtgaggaactgggacaatagccgccatcctgaccatagagcgaaccgagggggagactcgagttcgtcgggcttcctgtttctctcgccgccgttctgctttcccaacgctagagcggctcaacctttcactcatctcaccgtgggtgcacccgctcctctcctccatcccagtcctcgctcgccatctattgctgcgaccctaccaagcttgtcaacctcgccgcactgggagggctccctctgtcgcgtcaagctcgtgcgatggcaccagcgctgcctgagcctctaggcgtggatctagagccactgctataggcctgccattttctccaaggcacggggaggaggataatggcagtggtggctcgccggtgacggttcacataggaacgaaagggaagagatggaatctagagggtattttggttagcttgacaagaaaaatagggtaaaattcatgtgatttgataaaaaatggaagaaatagtagtagcatgttagccttgtttgaagatgacattctagggaagccaagcaatgtcaattttctcccccggagacagcctagtgcacagctgagagcatcctatttatcaacacaccctagccgtccattttccgtccctctcatcaacggccgtgatcaaacaccaacgctagtctccctctataaatcttcctcccccttccccatccaaaccctaaccccctccaaaaccctaaacctctccccctcacctgcggcggcggcggcggcggcgaagcacctcgtcggcacgacaccatgaggccaccgcgaggtaagcaaccacccgaaaccctaggattcatctcgcgctcgattccacttccacccttacacgatgctgttctgcgtcaggcaggggattcgggaggggaggaggagggagaggcgatggcggcggccgcggcggcggcggtgggaggggattcgggagggtcggggacagcggcgggagaggaggccgtggtgggaggggaggcaggacgccgaggggccgtggcggcggccgcggtggcggcgggaggggtggcatgaagggcgggagcaaggtggtcgtggtgccgcacaagcacgacggcgtgttcatcgccaaggccaaggaggacgcgctctgcaccaagaacatggtccccggcgagtccgtctatggcgagaagcgcatctccgtccaggtcctttgctcttactccctccatttttttttgcgttctacttatttagtgttttgctagaactgtagtatgattgtattgtactgtagcaagctgtaagatgttgcaatgttgattctatgcagtgtacacagattatgttcaaatcgtgctagaactgttaggataatttagtgcgctgtagaaagctgtaagatgttgcgcaatattgcttctttgtagtgtgatacaaagattgtgtacatgacgcttgtttctgttcatattgatctgttttattgtacatgactgttgtttctgcttttctgctatgtacagaatgaggatggaaccaaggttgaatacagggtgtggaatcccttccgttcaaagttggctgctgctgtgcttggtggtgttgacaacatctggattgtaagtttcttggttgaatccacgtgtgcaactttatgcttaagtggtttaaaatcactgtggtttgttaatgctgtagtataaaaaaatgcatcaagtgttaatgtttgcatcatgattttaggctcctggtacccgtgtgctgtatctcggtggtgcctcaggaacaaccgtgtctcatgtgtctgatattgttggaccggtgagatctcatttactgttctcatttattattcagtcacctaggtatgcaattttgccattcgctaatcaagtcattttgcagaccggtttggtctatgctgttgagttctcgcacaggagtggtagggatcttgtcaacatggccaaaaagaggaccaatgtaattcccatcattgaagatgctaggcacccggcgaggtaccggatgttggttggcatggttgatgttatcttctctgatgttgcccagccagatcaggtatacctttctcacaatgatttcatgatcttgaaaacgaccttagataatttattatatggttactagttagtattcattaagtgtgtgacaatggttttggtgacattctttgattacttgcgggctgcaaatgatgagcttactcggattccccttcaggacatcaaattggatgatgcagattcgagtttctgatgcattaaagcccattaccacctgttttttctttgctgtttttgcctgctttttaaactgtctttgttgtcagttttcttatgtctagctgtttatattccagtttatgtttaagcaacctccaacccagaagttctattcctacacacggagtagtattcttgtatgcttctgaagtacttaaattgtaacacgaagatgcattctttcttttgaaacacttctgttatatattttttgaatctatcctttttgaaattggttttcaattgttatgagttaaccatggctatggatttcttttggaagcgtttggtggccttgatgtcttttactaatttatagaattatttacagcacgagtatacctgcagttttgcttctatatggctgtgttatgcatatgaggactttgcatttcagtgccagcactacttactatgtccctatatcccttattatttaatattttgattgggcttagcatatgatgatcttactcggattccccttcaggacatcaaattggatgatgcaaattcgagtttccgatgcgctgtgcctccattatttcattcccttctctttgcattttatgagtattctgtacatcatatttggattgtgctagcaatttgccatatgcttggttgtttatactctctttagtatggtacaaccttcagcgatatgtgtgctttgttggtggctaatagtcatgtttttgactttttgcatattaattttcttgatattgtcttgttcttttttctgtaatatgtcagctttcctggtatagctttctctcctattgttattttgttagtctagtgctaattagaactattccagtacttgccgtactacatttcttaattctgtggcagtgtcggacattgatatgtttttgccttgtaacattgcttacaataattcatgtatgtttgctgctagagtctcggataaattgtctgcatataaaattccctttatggaatcttcttccatggccatgtcctttgttgaagatcttgaagattctcactgatttttgaaacctttcctatggaatcctctgtcctgcaggctaggatcttagccctcaatgcatcctacttcctgaagaatggtggacattttgtcatttcaatcaaggtacttttgtcttttctctcccctgaatcctgaagataatcaccttgattgaggttgagattggggagatattagatgtaatactaggtattggactgaaattgtttgaacaggcgaattgtatcgactccaccatgccagctgaggctgtgtttgctagtgaagttgagaagctgaaggcagatcagttcaagccctttgagcaggtgacgctggagcctttcgagcgtgaccatgcctgcgtcgttggtggttacaggatgcccaagaagcaaaagggtacatcttaagaagaataaaacttgtggttgtgagtgactggtgctaaaatgtagtgctgcacaaaacttttggtctaattgtttttcacttgcaccctggtttgtaaggctgaaatttttggacaaatgatgctaggagagaagtaaaaagtcactcaggttttgcactgccctttactgcaagttgcatcattattggtgctactaggggtgatacgctaatcaatagggatgaaattggtcaccgaaattcctcacagttcctgtttccgacagttagaccgttatcgtttttggccacatatatacaattttgatttttttttatgcgaacagtgaatattttaattgataaatatggtgaccgaccgagtgtctttatgacgacccccttcctaccatcaaaggttttcattttcgtcataaatcttgcgatgacttgccttttcattttatcagaattcttgcctcatcttctacttatcagctaaaatttaaattttcaaccttaaatttagctaaaatttaaattttttaccttaaatttagagctaattttaggggttttttttattaaagattatttttatcctttgcttttatattgttaaaaacatgtatataaaagttttattcataaattattatttttttacaaatacgccgttagcgaagcgaagtttctaattttcttgctctcaagtattataataagctaatgttataggtaacatttccatgcattgagagtataatgtggacgttaaaattatcgtgacatgtccatgctcaacgcattgagagtatagatcaacgctaatattaccggtaacatgttcatgcattgaaacgggcccttctgatttggatggtttgggagtattgatggaacctaaagcacgggattgagagcaatgtggtgggaggagggagcggaaggagaatgacttcacttttacgaaaaatattcaaccaacctttcgagaaaaataaaaaaaaatatcaactacgaacttagttcagttaggccttattttgttcccacatcaaaattttttcacccaatcacatgaatgtttggtcaaatatgtagtattaaatatgaaaaaaactaaatacatagtttgtgtgtaaattgcgagacaataagtctaactgcgccatgatttgacaatgtgttgttacagtaaacatttacaaatgatggattagattaattaggtttaataaattcgtctcgcagttttctggcgaaatctgtaatttgttttgttattagattacgtttaatacttcaaatatatgtccgtatatccgatgtgacaaacaaacccaaaaatttaccccaactaaacaaaccctaagtgaaatggttgctccaaaaaggaaacgggattcgctttttacattaaaaaactgctctgatccctgaaaaaaaactgcactgaactaatactccctacatccccaaacgtacgaaacagaggctgtgtttagtttctgaaattggggagaagtttggggaaagttggtagtttggaaaaaaaattgagagtttacgtgtgtaggaaagttttgaatgtaatgtgatgtgatggaaagttgggagttaggggaagtttagtgtgaactaaacacacccagaaaatgaaatctgaaaaataatttagcactcgagcaattttgttatgcgttttatttactttattattagcaacgtggattccacgtgcaagcatactatttgtgaagaaagtagtggatttgttaacaacatacttcctctagtttttttatgacgttggctagtttaaatttatactggtgaacgttacacatatatgcatggaggtagtatctttctgcctctacatgtgtcaacaatctttaatcaaacaaagtggattttgcttgctaactaaagattaaactttgggtcactcattgcttatgaaccaggccttgctacctcaactttggtcggttgggcttgtatattttgcttgtgatttggtgtttcagcatcggaaagaatgtatgttcttcaatgttggtatgtgatcgagttaaaatgcttttatagctgtaaatattgttgatgtatagcacgtgcattgttgttgtaaatcttaagagtggccagtgtaccgaagaagatccggcggtcacggcggcgaggcaaggaatttctggttgcggcgatgcgccgcacctatcgacgacaagcaaccatgcggtgcgggggactgagaatttgggtctgagctgaatttgttttaaaaagtctcaatttaggctcctcaaacaggggttgagtttggatagtatccctcatcaacgaaactggaatagagctgattagttgactgattatgacctgccagaggaggcatgggccagctctttggggtggcggcagggttcagcggcaagttcaaaagtcgaccgacggagagacgcagatgaggtgtggtagaggccacttgctgtcaatgcttgtgcagtggtttctgagttggtgggcgacaaattacaacgaaggttgtagggtttcatgcgaaagcatcgcccagtggatcactgggccggcaaaggctatgccttcgggtgtcgttaccccttagggcgccgctaagggtacctctctttattcttggcgagttttctttgggtgaaaaccacatctttctaagaatgtgggagatggcgacgtccttgatggcgtgacctacgtggtggcattgttttcggaatctcgtttctgtggtgttgttggaggtctggcgatgatcagccacgcatagcggggggtcattttggaatgctacacattctaatattgcgaattgacatgagacctcgtaatcctgacaggaggcttgttcgattaggatacaacacatcgtattactttgtgaatctagatatatcaattctattagtttattttgatacggacaaagtatccatgacactctgaaactctgctagtgttaagctccagaaacagagaatgcaaatgtcatgaacaaacaactcaagatgtatatgtgttgcaacttgtcaagtgaacagctgaaatactgagttgccttacattatatgctacgaatataattaaaatgttcaccgcaaaagaatgtaattggaatatatccgtataaataacatcccatagtatgtgtaacaacgacccctcaaacaaatgactaaaataacgggtgtcacaaaagaagaaaaaaattcacaatttacgctgctgggctggcttcttcgcaggcaaaataaggcttcacagttccatcgtatcagcagctagcgccagcactgaagtagctaataaacagtggcataacttagataaaaaaggtcttcatctacacaaaaagaagatcccattctagcccccctcaggtatttacacaagggggggtagaccttgattgattgaagttcatcttcgtaacggtgccgatcagcagttcacaccgcattgccccaaggcgacggctttctgagtaggcgaaatgaaaggatcgatcttgacccacagaagggagaagatcgacgcgaggaggatcgaccagacgatgacgatggtcggagtgcggttctgcctgcccatgagacccttgaggaaggggtagagatggaggatcacccagatggagaagaagagctttccaaagagaggaccccatgattggtaaccgctgttaatggcatatgatatacccgccaccatgcccaccaggttgatgacaagcacggtggtcgggggaatgaggagactggtccacttgaacacgtatagctcagcaaagtcaccatcctcatcggacgcctttgaggtaacagtgaagttggtatcaattcctgctaacactttcagaagaccttggaacacagcgaagagatgggcagatgtgccaccaatgacccagaactgttcatttctccaccagtcctcgataccaacaccactccatcggagctccagaataccagttgcgaaaatggaggcgaaaagcagaataaagaacatcccagcataattgctaatctgcatatgnnnntaaggtgtgatcagagaagttccaaaagggcagaanctcccaggnnnnnnnnnnngttttnntnaataannanccntnatgattagcaaaaggtattgttgattgtggtcataacaagtgctacaaaaacatgggggggtttaaaaaaaatttttttaaaaaaaaaaaaaaaatattcaatcccggaaattaacagaataagaaagtgaatggatatcctttgactaacctcaggaatgataaatttgttggtgaggagacagatagcaggaagcacacaataggcgataagtggaatggatgtaattggataaacaatggtgttaatgtaagccagcctctccagaagtttcaaacgcccattgtaaccataccagataggacaatgtctgctaagcagaatctcaacagacccaagagcccaacgtagcacttggttaagacgatcagacagattgattggcgcagaacccttgaagcatggccgtggtggcatgcaatagattgatatccaacctcttgcgtgcattttaaatccagtcagaatatcctcagtaactgaaccatagatccagccaatctgaaatcacattggaaaacaaaaaagttaacttctaggcttctatttctatacagaacaaggagtccacacccatgacttggcaagaagtagaacaaagatctctaggaagaaagagaaaattacgggttgccccactaacctcttttccccattcagttttgtcctcatatccacaactgataacatggatggcttccttcagtagagatgctgggttcgttgagggtggtatgcctccttgagtcatgaaggtggacgcaataaaaattggcgattgaccaaaacgtttctctaatctcttctgggacatcagcactgacctttcatcttcataacctaatgaattacaaaagcaatattagaggagggagccagcttgagtatctcaaaagtctgtgtaaacataagactagatagaagcataatgttgataacactaaatgcagtggttgttcataacataaaagataaaagatgaacaaagactagcacaaaccttcaatgccctcttctatatcttccatgttaaagataggagctgaagactctgttctcttcatcatacggtttttgctatccatgtagctcttgctctttttctttctgccaccacagcagctcttaacaacaatgttaggttccaaatcagcctcagttagtacaggatcatagccatacaaggcctgcctattgaagcagcaacctgttcccacataaactggaccctgaatgccatctaaacctttcatgttaatctgcaaagcagaaaagcatgtcagacatgaaaattttgatatgatggacaaacaaaggcaccattgtactcacatcaaagaagactatgttgcgattagcgtatcgatcgtgcaagtcaatgccatcaaatctttgtgggaactgaacataacaagttttccttcctagtgcgggatccatcatgaagcacattgcttctctaagagctttgctactgttgaagtagtgatcacaatccacattgagaagataggcaccatttgtcagcacagcagatacacgaatctgcccaccagaaataggggtatataagtattgggttgataaacttcagtgataaatttacagaattgaacacataccaatgcattcattgcaccagccttcttgtgatgctggaatcctggcctcttttcacgagagacgtagacaagccgtggcaactcgttaccatcagtgtcaagcccaccactgtgccccaagaacacctgtaatcaacataacaggagtttagtatacacgaacctgattaaattagaatcttaaaccactcccccattagaagtaaagatcacctgaatcatgccagggtgatcccttgggttattcccaggccaagcagtgccatcagccatggtccacccctcttcaggtactttttgtgccttcgcaacaagagcattgatccgtaccttgaattcttcatactctctctgaaacagagtatccaaagttaaatactcaggcacaatgcagattggcggtaatctaaccatgacagtagaagcttaccttcattgcccgcctttctttaacaaaggaaggttggattttgtccttcaggtaatctattttttgagcaaagtaaaactctggagctcgtggttcaatattgtgcttcttgcaaaacggaacccacttcctagcaaattctgcagtttctgacagagcctcaaaagttaacatagctgaaccatcgtcagaaacatagcatgacactttgtcaacagggtaatccacagccagaatggacaaaacagtgtttgctgtgatcagaggaggttcctttagtggatccaccgtactgacaaagacatcaatgggagcaagctgtgatggctctccctccctatcatatctgcaacattagattggacgcctcaggacacagaatatcaatgtaagagagtttcagtgccacgaccctgaaaaaatgtatatcaagtatctcatcttacctcaatgcaagcctgtcaaggtatgtttcacggtttatcgggtaccactttgggaattgatctaggagccaggataaggcaaaccaaatttcacagataacagatactagccacaatccataagcatcccgcactggatgagtgacacgatattggaagaagaacatcaggatgataagacggagaatgataacaatccggtaaaggttgagctggtttgaagggataggcactatgcggctcagaggtagacgtgcatcatcaaccctgtgaaagacaattacagaaagatcaatatacttgaagcaatatatacaatatacatcaaactgcagtagtggtaaagcatagtcaatgaaaatctatatcctgatcaaactcagaggtataaaactatctaataagt

SEQ ID NO: 75734 - DNA, 8471 bp, Oryza sativa
ctttgagctctctccctctctatctcaactcctccttgttctttgtgactgttgctatttaatacagtcacagataaaatccgcaagcgcatggatataccgatgtagcacttccactatggagtattccaagggtatcaaatccaagggaacgtgtgtggtcagatcttcctccggttcatccaaggacaccaagcaaatgataggccaggatagagaggatttactagtgaaaaacagtgtcttaggaaatcttaactttaatcctaatgcaatactacaggctctggcaacccgttgttcccagatgtcgctctactacgtacccggacagggaggacttaagtaatctcgagggctatcaccacctctacatccacctcaaacgtactgtgggatacgcagcaattactggataacaattacctaaacaccacgtctaagcaactactatctactccaatgtttataactcacaaaagcaatcactatattttagttgattatagtgaacaataatcccgtatgctattcaggaactaaccaagagataattatcacaagataaatctaaattactcaagaagaatattatattaaattcagagtaataaacagaataaaagaaataggagaagattaccgatagctccggaattcttctgactcattctactctactctcttcctattctagtatacaatatagtacaatagatcctcttataattcagctcaagcttagaagtgtatgtgagagtgcatgaagtgaggtcctttcataaggcagttatgacggttgtgagaaggggaaatgtccgaactgctccgcaaccgtcattgggagaacatctagagcgtccacgccaaaccctaggatcaaccgcgatcaggggggttcggccgaacctaggctgggccctcctggcctggccttcgttcagtggactccctagaccttcctctatccatttctcggagttttgggttgattcactgatgtttcgatgaagtacacaacccctccttgtatggatgcataattctcctcactttagtttgattttcctcccaacttcagcgtttatcatctgcatacaaatatacaccaatacttgtggaatatgagagattaagaacctatcactatgttggatgttttattatctaaactttatgcagatgttggcggtatgggattggcatttatcagccgccaacagtgacttggatctttgtgtgtggatttggagtttgggagcctggtgtgtgtttcttgatcttgagcactaggatttgtccaagagttgtgtggtgtttattactcttggaggttgaggactcctagatggctaggtgtcattcttggccaccgatctacgtgtggttggacaagagaagtttgtgaaggccggatcgcgcctccgcaaggaaagagatacccttagtggaaggaggagtgcatttgtccaacctcatgaggatagggttgaaaaagacccggctctttgcgagcccctcaacggagactagaatcccctcaaggatttgaactctgggaaatacatcggcgcgtaaacctcggtgatatcttcactctctttaccttcttgttccattgctttgtgctatgctcatattgttgttggtcgagctcacctctttgcctgtgtataatctagagctcttaggttgttctcttgtttgtattgttgttgtgcaggtcagatagtctgatctcagttcagacaatccgatcacataggactatccgatctgatatcggacaatccgaccctgttttgttttagcttccgtatttatttttaaaaaccgcctatttagccccctctaggcgacatcaaggtcctttcaattggtatcagagccaagtctctctattaagggctttaccgcctagagagtaatgatgtcgactagtggtttggtagatatggttctttactccttttggatggttcaaattatgattcttggagtactcgcatacttgacaaatttaggaccatgggtccttaaatagagcgagttgtagatgtgagcatttctcctcctaatgataaagagctatcatttgaagaggaagagaaatgcatgcatatcaatgctcaagctactattgttttatttggtgttttaagtgaagatgtatttaaaaccgtcatgccgtttgaagatgctcatctcatttggaccactgtcacaccctgaaaattcaaaatatataaattgttgtttaattggaatttttagaaatgattttaaaagcctagaagagaagatctaatttttaatcaataaattccaacataaaatggggccagataaaatttcaataaatactttgcttaattctataattcctagatttttctgggatttatttgagctaaggaagtatttttaataaatggaattgcatttcataaataatttaaattgaaaaaggttttaaaaagtcttcttttggctttgggccgaaagtcggcccaaaacccttctctctctcctcggcccagccggcccagtccgcagccgcccgcgcgcgcgcgtcctcgctcgctgacaggtggggcccgcctgtcaggtcgtcgtcttcctcgcgtcggccgccgcccgaaaccctagcgccgcgccgccgccgtttccttccaaatccggccgctcctttccttctccggctgaatcaaaagaggggaaatgatcctcgggatctcctctaccttttcccctttggaaacatcggctaaatcggcttggaaagtgtttgattcgaggtcgaatcggatcggcttttctctctccgagcccgatctttccttctcgtcgccggtcgccgtgggccttcgccgtcgcctcctagcccctttaaaaggacccccgagctctcctctacccgccgccaccctcgccttcgcctctcgtcgtccgtagcgccctagcgccgagtagcctcgagccgccatcgccgccgtcgctccagccgtgcgccgccgccgttccggtcatcgccgtcgctcgggaagaccaccgtcgtggtcgccaagtcaccgccgtcctcgtccgcctcttcgtcgccgccggagatcgtcggagcaccgccgtcaccgtcgacccgatctccgccgccgctttgacctcgtcgccgtcgccgtccgttcctcttccgccgtcgctttggtcgccggtgagtttgccgtgccgtccgctacccgttggtgtcctccgttcgtgccgaagcgccgccgttcgccggcgagcgtgcgccgtccgagccgccgagccgccgccgccggtggtgacgtcatcgctgacgtcatcgtccccgtctcccgtgagccggtcgtggaccgatcgatctcggccgtccgttttggatggatcgatctcggccgtccgttcgcatgaaccgccgccgtgcgcccggtccaccgcaaaccctagccgctgatgcaataattccctttttcttttcaaaaataattcaaccctttgagcatgttgatcccgtttaaagctattgtttctattcaactattgcatttattttcgaatgtcattgggtggaattaacctattgtttgctatagcccttttgttcttgattactttattccttgataccttgggttattataatttgactagttgagctttatttatattggttcaactagatattagatataattgcttagccctgcttagaaacattagcacactattgggataacttaagattcactattatttaatgatagcttaatgatagttcacgatggtcaatcgtgattgattaattaattacttgccaactaaaacttgataatggtgggttatgagcacatggttttgagagtcgtgctcatgacaattaaggaccggttcacgagttttggttgtgaaacattaaccgtaccagccacaagccagcgtgggcaacggctttatcatttgtatagcatggttcattgcggagcaccagactgagaagtggcggagataagcccacgggggtcgctggggagtccatgccttgtttataagggggtgattatgatccaggaatggtgcgctgtagtggattgtgttgtacaagggatattgtcacaactcctttccgaggtaccgtggtggtattgaggcacatggtgacaataacaaattgataatagagtacaattattactctaattaataagcgaataaaatatcattatagaggtagatagttcctctcaatcaataaagatctaagcagcggaaaaaaataaaataaacggcgcagacggctccactccacaggcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcatagtagggtctcatttgcataaaccgcatttaacaaatatttgagaatttaataaaacagttaagtaataattaatcaatattaatccaacgctatacaacataccctgttgtataggcccaaccattctgaacaaccatcccggctgcacagttctatctccaaaccaggaatgtaccattccaaaccaggagctaatcaaattatttccaattatagcatcatttactatggtgagaagggtgagactaatcacgaaagacattgttagacccgcccataaccgcgggcacggctattcgaatagttttactctgatcagaggtgtaccactgtaataccaccacgtgcctcaataccaccacggtacctcggaaaggagttgtgacaataccccttgcataacacaatccactgcagcgcacctttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcattaagtaatagtgagtcataagttatcccaaaagtgagctaatgtttctaagcagggctaagcaattatatctaatatctagttgaaccaatataaataaagctcagctagtctaattataataacccaaggtatcaaggaataaagtaatcaagaacaaaagggctataacaaagaataggttaattccacccaatgacattcgaaaataaatgcaatagttgaatagaaacagtagctttaaacaggatcaacatgctcaaagggttgtttgggatctgtgtgacttgccttgctggccttggaactcttcaaattcttctccggcgaaaacagactctccggaaacaacagaatctaaacaaaaagaagcaaaatcaccaaaacagcacataaacaagcatgaacagtacatatggatatttttaacatgtagatctcaattttagaaaaatttagagacttgaaccaactaaatccgagctaagatgaattagttatgaatttttgaagattaaatcggattaaaacacttaaattgattttaattgaattatgacgtaataatgaattatttttgaaaaggaaaagagggtttattgcgtcagcggctagggtttcggtggaccgggcgcacggcggcggttcacgcgaacggacggccgagatcgatccatccaaaacggacggccgagatcgatcgggtccacggcggctcacggaagaggacgactatgacgtcggcggtgacgtcaccaccggcggcggcggctcggcggctcgggcgcgcatgctcgccggcgaacggcggcacttcggcacgaacggagagcaccaacgggtagagcgcgacgcggcgaactcaccggtaaccaaaggagcggcggaagaccaacggacggcgacggcgacgacgaagaaacggcggcggtcttcgggtcgacggcggcgatggcgctccggtgatcttcggcgacggcgaaagggcgaacgaggacggcgacgcgacggcgaccacgacggcggtcttcccgagcgacggcgacgtctagaacggcggcggcgcacgactggagcgacggcggcgacggcggcgctagggcacacggcgctatggcgctacggacgacgagaggcgaaggcgaaggtggcggcgggtagagaagagcttgggggtccttttaaaggggctaggaggcgacgaagaaggcccacggcggccggcgacgagaaggaaagatcggggtttgaaggaaagagaccgatccgattcgaactcgaatcaaacacattccaaaccgatttagccgatatttccaaaggagaaaaggtagaggagatcccaaagattgtttcccctcaatcaatttcaccggaaacaaaaaggaacggccggatttggaaaggaacggcggcggcgcgaaactagggtttcgggcggcggcggccggaggttgacgatgaccctgacaggtgggccccacctgtcagcgggcggacgcgcgcgcgcgcggcggcggactgggccggactgggccgaggagagagagaaaggttttgggccgactttcggtccaaagccaaaagaaactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaaaaaattccaattaaacaacaatttatatattttgaattttcagggtgtgacagttattgtgtgcctcggctgattcctggacgagggttcacacacatgtaagcgtttggaattttggatagaaattccgggcgtgacaaccacactcaaggagagatacgacaagtccaaatgtgatgattccaaatgtgatgatgtactctttttggaagaagcacttgaggagtgttcaacttcatcaccaaattgcgactaccttcgatgatcaagataatcatcccacaaccaccttatcatcaacacatgactacattgaaggtaatgaattggtgtgtaaggttgatgatcgtccaattctcccattggattccaacaacaccgataatgaatttgtcatattctattgtgttgttgactcatgcatctcacctagccccaagtatatgtgtgaggatgatatggataaatgctctacttcatatagtacttgtggaactaacctttagaagggagaagtaaatgagcgccagcggacaagtgaagaatccacctcaccaagatgctcatcttctatttccaaagatcatgcttgctttatgggagaagatggtgacttcgagtttgatcacttgagcaagaaggatattacaattgtgataaagctcatggagaccattaagaagcaacaagcatgcctcattaagaagaatgaagatatcatgagtctaaccgaagaacacaagaaacttaaggattttcattcttcattgattatgaggtatgaaaaattggaaaatgaatttgcttgtgccactaattctattgcttgtgtagcatctttggagaagcaaaatcaagagcttaaatctcaacttgacgagatcactaacaagtatgtggatttacaagaaaaacatgatgaacttttgtgttctcatgagaatcttgtggattctcatgccatgctagaggtatctcatgaggtgatagttccaatggtaaaatcctatgagcctcatgttcaagttgatctcacttgtactaaccctagttgctcccaagcaaatatttccccgagcactatatgtgacttggattgtgtaggcaaaagggagaagcaaatagattatggacttgtgtgcattgctcaaccttctcaagataaccatgagggcatggtgaagaagcttgtggaggaatcaaccgtggcttgcaccaagatccatcaaagggatagcaagtccatcaatgcttatatcaagggacgaaatcaaaagatgatcaagagttccattacttgcttcaagtgcaagaaagtgagacatcatgttagagattgcccttggaagaaaggaaataagttaaacaagaagaaggacattcctcacatcaagtgcttcaagtgcaccgaagtgggacactttgcctcaaggtattcttgcacattggatgaaca

SEQ ID NO: 75735 - DNA, 5963 bp, Oryza sativa
tttttgggtgtctgatgtgaatttctataatgcaaagatacgtatctaaatccactgcaaagcagcgtgtataatataaggataggttgtccatacatttgcatatcttcaccatttgaaccagtcccttccatgtctccccctcttgcctctggatatttattagctacctgcatcatatttttgtcctgcttgttcctccagctggcaactctttcttgccagtcaacactgttaatcccataggaattcaagtccttggaggggtccacaatcctcacaggaactggaatcataatagagaaatgttagcactttccaaaccaatgtttttcccaaggagcaatttatgatgagtaagaaaagtacctggaacacttggatcaacatagcttgatgttccgctgcggatagaatggcgatcgggggaagcatcagggatctctcctgagatctgaatgaaaatatcagtttgtcagtacccaagagcacagcattcttacagaaacaagttcactgatacaagtgagaacttatatcatgttaaactgtacctgttgcccacttgtcagacggggaatccgatgttgttcgtggcgagaagatgaagacaggtcaacatcttccccctgtctctgtatctgccactctggacctttgccattgccatgcttataattgaattcattgtccaggtcatcaacatcttcctcctcctcatcgccctgaactctagggctacctgcattttgtccaaggcggcaaaacaatcacagtatacatcaatcatttgtctttatggaataaaagacagagttggtagtctaattttatatgtggatacatagatatgaagcaagaatcaaacatgaacttagtaatgatatattatatgacatataaataatagaacagttgtacagaaaccaacctttgtgcctcttgtatctagtcttgcactgggggcagcactggttcccttccttgcgctcgtactcgtagcaagggcggcagaccgggaaggcgcactcattgcaggcaacaaagacgtcgccggtggccgagacgccaacagtgtcgccacaaatctggcagacctgaccattcacactcttccctggcttagcctgcatcaagcaagaaaacgacagttagtacatgcccaaacggaactacagaactattagtaattaatcactaactaaagaaccatctgcttcgcttcaagtcgaaaccaaggtcctaaagctagaaatggaggagctctacaaaagctgggcatgaattccacagttctaatgattcagcctctgcgtcatcagtactaaccaagctgagatctaacacatcaatggcacctcaaatgctacccgcgaagcctagactggggaattccgggagctgcattgctctagctaaatccctacaattccacaaccaccggacatttcctcacatgaggattactcactaacaattccacacaggaggacactacaatcgcccgcgccaaatgcacatagggaaaactgcgggggaaaatccccgagcccagcacaaaaaaacaaacgcaattttgcggggattcgattcgagagatgcgcacccaacaccacactcactccctctcccctcaccccagatccaccaccgacacgctctcatgtcgctcgctcatcgcacgcacgcacgtaccggcggtggcgcgtcgccgtcggggcggatcatgacgaactcgttccggttgcgggatcccgccaccatccccgcgttcgccgccatcctcctccccttcctcctcctcctccactcacagcgagaaacggctacgcagctagcagatccgcgcgcgcgcggcaagcctagatcgcggcggccgccggcgacaccaccattcgccgctccgcctccagatctgcagcgccgcctcctccactcccctcctcctcttcagctcgcgctccactacttcctctcgcctcctcgtcttctcttcttacatacgcgagacacgctcgggttggtttcgcttcagttggtgggagtctcgccaccggctaccgccggtcacccggctcgcctcctggccgtcggatgagatgagggggagatatctcggccgtcggatgaggggtggagctgggcacaggctgtcacccgctgacggggtgggcccgggtgaccggcggtagcgggtggatctgtcggcgcctcggcggtggacgggaatgccctcctacctgccgctactcttttttttttgtggtgttttttggaggtaggaaagggggaaagaaatgtggcatgtgcagcaagcgtgtaacatgtgagttggcatcaaatcgatggtgctgtgattggtggatcgaaattatatggtgagaattatttgcattgccaagcattctgtgatatttgcagggaagttaattcaattcttaattataaaaacattgagaacttatgtttctcgaatagcagatgtaatttgtgtattggtctagttttctgcaatgtttttccgttctaaacatgttttgttttaatttgccacagtatatataacacttattttgctgacgtggacaagagaaaatagttgtttcttcatggagaagatatacctcgagcacatgacaggaaaatatgagaaaaattaaagaggaataatattaagtgcaacattgttagttgttttgcataccagcttttaagtagttttctcctatatcatcaataatattacaagtttgaatattctcaatgctttggattgtcattcttaaccaaggttgatgctaacttaagcttgtgcataatatagacttggtgcattatttgaaaatggaaagaggacctggttaggggctcgaggattgaaaaaagaagtgcattattcacatgattaaaactattcctcttctgatttaggggtaagcaatatcttatattaatttgtttgcactccctgaatcgattaataaatcttttatagaacctgctgtgcttagagtacctaacactcctcccaggaaactaattttcttcttgccgtttcatcgaccgacaaatgcaacgttttggcacacatcattacggttttccaccttaccttgggatttataacaaacaacaagattgtagttctttttacttatttacaccataagcgtatagtacatgctatgcaatttttatttaaatttacagcaactaatatataaaatcactaaaataaaagtccctggctctctttactccacatcccatatagatagctactgaactcccctttgttttcatcattgcacctcaaagattcacaaactgaacataattaatttgtgatgccagatgtagattaattaagcatgcattaagaggaaaaaaaatcagaccagattatagggagcctgtcactccaaagttaacaagaacaaatgagatgtgctgacttgtgctttgcaataagcacactgtcaggtaaaccgttcttgtcccaataatggcggttgggctgccactgtcctgcccgtcggtggcctcttttctttattgttacttgcaataatcactaatatatattttttctccttctctctctctgtaatctctcctagtttctttttgttcctctaaccaaattggaatcttcacatcgcatgcatggaaaatgatttgccatcggcttgatggtgctgctgtatttctgttacactgttcgacacgaaaacttcagtttggtttggtactgttgttgttcatcataaaccctcacttattttacttcttttttaaaaaaataataaaaatgggttacatctccggcctctgtccataggcatacagctaaaaaatacatctcacttattttacttctaggatgcagtaacaaatacatagtagaaagtgtttttttttaaaaaaaaaaactagttgcaagccatgtagcagtgaagtcaaagaaactgactaaacatgacaaaaaaatttctcttaacttgctaaaatctatctggtgatttgtgaggaacagcatggaggttcaggctctactttgtctgcctcttttgcccttgattacaacagtggtactacgtactgtagtggctgggattatgctgcaacaactaattgaagtattaaaacgagtgttgctcttgcctgcagcctggttgatggtctagtctaattaacccgtggattagtattagtcctgtcgattattagctgtcttgaggccaggggcagcaaccaccgctggtgacgctaacgtgtctctgcaccgctggtcacatgcgaagttggggcaaaaaaaaaaaaaatcaagggcagaaacgcaacgtgggggaatattcagagttgtctcgtgtacgtactctactactctctgaagaacagaactggacagtgtacagaacggtcagcatccagttaagttaactgtttgtacgcagaactgaagaggaatttcttcgagcatgttgctgtaactaattcttgcgtgtgtatccccagagatctgtgtatttttgtttagaagaagaataagagagggagaaaaaaaaagagtggtcatcggtttgattttgagtagggtatataaactggcaagcagtttctctgtgtgatgatttttcatttaatttaagtttatgtgattcagtttccttctctagttctcttgagtcgtcacaagaaaataatttggaaagagaacggaagcaaagcagagaagacgaaggcctcatttgtccttgcttagatggaccgttgcttagatggaccgtgattttagcttatgaccctgaattaggaataagtccaccttgacccccttcattggtggtcgaatctaattcctatctctgaaccacagtatcggatctttaggtcccccactattaaaactagtgtaatttaattcgcttggtagttttgcaggccggttgcgctgacgtggcgtctatttggcgggtgttgacatgatcttcgtcccagcccccaggtggcgtcgacgtgccgctttagctcccaccccctacagacgggtgatggggagagagagaagggaaagagacaaaggaaaaaggaaggagagaatgggtcccacagaattttaaaattctaataccacacaaagtgatgtgttaacgccatgtaggacgaagattatatcaacaccgtcacgttgttgccacatcagcaaaacagtcctccaaaaccgcaaggaagttaaattgcacctgttttaatagttgatgagttaacatatccggtattatggttggatacgaatcagattcggccactggttaagggagtcaaagtgaacttatattccgaaatgaaatgaaggaaatcttgaccagcccaacttggacccagggacaggcccaaggcccggcccacaaatcctcgtatcattatctcttggaataagttcaccggtggtccctcaacttaacagcgagatttgttgaggtcccttaaccataaaaccagaaatgtgtactcctaaacttacacaaaccgtgcacacaagatcctatggcagtatacatggccccacaaaagtgcgtggggcccacctgtcggctgcacatctatttccttttccttttcttctcttttctctcttctctcctcccttcttcgggccggcggcgggcggaatcagcgagcgccgatgcgagcggcgggcgagcgcggcaccacaacggctgtgagccgcgggcggagcgggcggagcggacggcgggccagcgttggctgttggacgggtggaacgccacggcccaacacgctagcagagacgcccccgccatggccgccgtgaccaggcatgcgtcgacggcgccggtgccggccaccttgctgccacgagcgcctgccgccaccggtggcttctcgtcgtcgtccatgccgtgtacgtggaattaaaggtgacaggaaaaaagaga

SEQ ID NO: 75736 - DNA, 1116 bp, Oryza sativa
ggccgccaccgtactcgtatattcctctccacccgtgtgtcgcgtcgatcgccgtcggcggcgggcggcggcaacttctggtttatggagaggaacaactagggtgggccggtgattggtccagtttcgactaaacggcccaattggttcatggcccaggcgcatcttaggggttcggagatttcttctccgtaccccgtcgaaacatacgcattcgccgttgtggtgccctcgtatcgtattaccggacacctacgaggaatcatcttcgctgtgtgatgcttggcaactcgccggtgttctttccctcgagggtcggcgcgactacgatgttgtctaccgttcatatcgacgtcgatcatagctccacaatagattagggcactatgtgaaaaaagaaaagcaaaattatgccaaaattaagattaggccaaggattttgagtaagaggtgtgtacaattctcgagtcatgaattcgtgatcatgggcacttcacctcgtagaagttgagattacacactaggctgcgtttggatcctcggcaataaacatactagcctcgcttagtaaggtgagctgtttggcactgcagctaaaatgttgctaccgtgggcaagattacctcattttagctaaaatgtttattgggctttagctgcaatgggctagcccatgcttatcaggctaggaaagccgatcaagggatctgcgcgcgcatggcacgagtagacaccgacctgctcccatcaattccattgacccacggcccaggcaagcccactggcttagctagttagcttctccccaatcctgcagatcttctcgtcttcttcgacggctcaatccaacgcctggtggtctctcttcgtaggggttcgggacttgggaggtctgcgtcgtcgccgttgctggtcgacgaatcgcgtcacccatggcgcataaaggggtaagcctactgtttccatgtatctaaaaattaattgagaagttgtgtcagtattgggacgacctcaaggtgttcgatagaatgcccagaagactcaacatgccgctgcttcgtcctatgcgccaacacaagcttaccacgaacaccaaacacacgaattcaccactct

SEQ ID NO: 75737 - DNA, 712 bp, Oryza sativa
accgggactaaagatcccggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtaaagtttagttttagactatccttttacaactcttttcattttgaaaatgtgttgtagtttgaacatttctaactctcttatctatattaatatatgtctagcctcacctctgacaaaaaaaaatgtaatctaattagtacgtgtgcatgttttctttctaaggagggacccgttacgagccatccgatgttgtccgcatatatcagtggtggatgtatcggggccaggcgtgattccattcccaataattgagagtgtattctaatttcttaaggggaagtcccccgtatataatttttcccaattctatataaattgttgtgaaaaaattatgaaaaattcacaatattgaatattgtgatatttatctatccaccaaaaatcaagttcaaatctgacttacacatcaagaaaaaaaagataaattcagataacaatacgttactattcatatgcctaatttgtctttttttatatctcgacg

SEQ ID NO: 75738 - DNA, 5115 bp, Oryza sativa
tcctgcagcccggcaatttagccggtggcgttggtaccatcatttcaagtagagatgtctatggtgaattcttgccaaccctttgctgacatccacccaggagtgacggtctcttacactgacgccagagagatctattcctacctgcggtcgacgacgagaccggttgcaagaatcgagttccgtggcaccatgaatccatgatcagccaatcgccatctgctccgagggtcgcttccttctcgagccgtgggccaaaccgcatcgcggctgagatcctcaagccggatatgatagcacccggtgtcgacatcctcgcggcatggtcgggagaaaacccgccaagctccatcagagtcgacgacaggcgcgtcgagtttagcatcatctatggcacgtccatggcgtggcgtcgccgccatgctcaaggtggcacgaccaagctggagcccggcggcgatcaagtcggccctgatgacgacagcctacaacgtggacaacggtggcaacacccatcaagttcatgtccacgggccaaccggccgggccgttcgagctcggctccggccatgtcgaccccaattaaccgcgctctcgaccctggccttgtgtacgacgccaccgccgacgactacatcaccttcctctgcagcctcggctacacgcgcaggcagatctcgctcttcacgaacgacggctcggtgaccgactactcggcccggccgcagaggcgcgtgcgcgacctcaactacccggcattctcgttcgagtttatttcggtggccggctcacgcagcgccgcagcgtgaccaacgtcgggacgaacaccgacgccgtgtacagcgtgaacatcgcctccccacccggcaccgcgatcatgtcgccgatgaggctcgcgttcaccgcgcagcgcaagacactgaactactcgatcaccatgtcggcatcggcggccggcccgaacacgtacaggtggggatcgatcttctggagcgatggccagcacaccgtgaggagccccgtcgccgtcatctggcagtaaattgacgtgcgagtatgcgacatcgtttcctatgtcaaagtacgtaattaaggccatcttttcagatggttgggttgtgtacttgtgtgttgtaaagtgtaaacctaattattgtacttcctgtatcagcaggaatgcattaataaataaagtaggattattgtcaaattattgtacttgtgtgttgtaaacctaattgttgtcaaatttgtttgcttaatttgttcacgtttgccatgcacagacagaatcattctttcgacacgcagaatgcatgcaggattaatgcaggagggttgatgcaaattaaagaagatgtatgaaagtgcaacactattcaaaccccggcgtccgcgcgcacggcgccgacgagcgcggcgccctcgaggacgtccctgatggccttggcgtagcacgcgcgcagccgccgcagcgcccgcctgtacatcgccgccaccacccaccgcagccgcagcctccggagcgcccccataaaccgccgcggcctcctgctgccgtcgccgagccgcaccaccgccatcttcctcctcctcaccctgcagcttccgtgcagaatcgtcacagtccgccgcgtcgtcgcgcggaacgcagcgtctcgccgcggcgccacagcgtggccggccatctgctccggactcctcatgatctccagcttgttgaaacgcttgttaatttgctgcttgtgcttggtcgcctagccgtgtccagctgcagctgcgacgacattgcttagcatttaagcgtgatctccgtatgagttggtctacgagatcgtcgagatagatgtgtcatgctgatagaaggatagaacatgctgatcgttgagtagcagttggtgtagcacgtactgtgcaggtgtgactcgtgaggtcaggtatagttgaagcaccgagcagctgtgcatgaatcatgcgttcatgctccttctagctatctatagttgctgattttaatctgcttaaactttgaatttgccatttccgtcagacacgcggccggccgatcccggtgttgacgctggttggccgagctagccagctagcaaccgaaacctctaatgggcgatcgcctagccaatggggtagccatcgggtgccccctccctccctccacctggttttttttggtaccacattatttttctattttagtaaatttatgcatctaaagtttatacacctcaagtttacacatctaaagttcactttagagaccaaaagtttataagtcaaaagtttatatatccgattcaaatttgaatttgaattcgaatattttttatatatagtatttctatacatctaaagtttatagacctaaagtttataagtcaaaagtttatatacccgcttcaagtttgaatttgaattatatccgattcaaatttgaatttgaattcaaatattttatatatatagtatttctatacatctaaagtttatacacctaaagtttaaagatccaaagtttataagtaaaaagtttacatacccgattcaaatttgaatttgaattcaaatattttctatatatatagtatttctatacatctaaagtttatagacccaaagtttataagtcaaaagtttacatacccaattcaaatttgaatttgaattcaaatattttctatatatatagtatttctatacatctaaagtttatacacctaaagtttatagacccaaagtttataagtcaaaagtttacatacccgattcaaatttgaatttgaattcaaattttttatatatagtatttctatatataaatttttctaattttttatttttttttaaaaaaaaatggtttactatagtaataagagaagaaggggaggagaaagaggggagagagagggggagtagggggacggacgcgagcgatcacccgctcattaggtgtgcccgctagcaaccgcacgtcctgtgaccatggcagcagtggaggcccagctcgaaaattgttgttggcttggctggcggtgtaacgggctgcaggcctgtgctcgttttcagcaactgaaccaggaactgggccgtaaacacgccatgaaggaataagttcacttttactactactctaattcgtgtatctcaaccgccataccagatatcccctaaactacatatgaagccagtgtgcagcgccttctcaccggtgtgccggctggattggcgccgtctcttgggtggctgcccgaaccttcttcgaatgttggctgccaccggccggcagccgccgccggcgcacacgttggtgtgctcttccgatgcctctgtgtattctcttcatgggtagatggatctactcttcgttgccgctgtgttctgcatctgtgccccccggcccccgcctcctccggctgctggtgtcgatggccttatataggcgtaaggggaagccctaacgaacagcgcggaatccatggcgctgccctgactcgatccacgttgagttgttgcgatcttcactgcaatagataaagcctctttgactcatctggtggatggatatatttcacgtgatttctatccattggattgctgcacggttgggcctagcatggatggaggcccagtagtccacgtattcgtatacgtacgccaccaatatacggccgccactagcgagcgcatgcatgcacgatgagcccgtagcctgtatagcatcttggtttgcatggtttgcccatgcatgcatgaactatatatgcacacataattgttttgcttctatttcattgttttgctgctgattgattgaggcttaatcgtgcatatgcttgtccttgtccatattactgaaatatacggacgtaaatacgcgcatgcaggccagagttaattgaacacaggtctgcttcttgttggtttgccaaacatctatagccattcgctgagcttgaacgagtgcatatatacatgccaccaagtgcacgtgcttggttcgcccatatataaatttctgaataactggcttgctttgcttttcaagccaacacagttacccagatactcttgtgtgtacaaaataccgtcaaacaatatcattattacaatatacattggatatatagccgataaacatcggctggtatcggcatcgactaggattactgcatcagcttgtcagccgatcggctctttgaactgttatttacatatcttgtcagttgcaggatcaaactgactggcatatctgcatctcatcaatattttcaacctacactggagctaagcagatctctcagaccgttgtgttcgttgacttagttcgcaccaacacagatccgatactatcagccaagagcgaatttttggtcaacacttctacgttgtataaagttacttttaaatatatttaatattgaacatgtttttaagaaaatgttggtttgaatggatcttaaaaataatatcctatttaaaatatactttatttttagtacatgacacatttttgatatatttcatcattcatcgtatttaaaaaatttaaacatcatttattttgttatgacttgatttgatcagtaaggtttttttttacttttgtacgtttgtaaaaagaatttgaacttttgtatgtttgtaaaaagaatttaaataagataaatgattgaacatatgtaaaaaaaattaacaatgttatatattaatattaaaaaaagaaaagtacgaattaccccccaactatccccgaactatcacgatagttcggggggtaattcgtaatttttcctattaaaaaaagtactttgagttttcaaggaatatatacatggagattagagtagtactagccactagacatctcaattcactatcgtatgctcggcttagtcaaatcactcgcgcagtcacacctactccctccgtcccaaaaaaagacaaaccctggtttctgtgttcaacgtttgaccatccgtcttatttgaaagaattatgaaaaaaattaaaaagataagtcacgcataaaatattaatcatgttttatcatctaacaacaatgaaaatactaactataaaaaaatttcatataagacggac

SEQ ID NO: 75739 - DNA, 1651 bp, Oryza sativa
ttccgtccattccgtgccgttaagtcctataggatgaacaatgtatttaacggcacgaaccctaacagcgatggcatttttgagacaaaatcatttatacgatggcatttcttgaaactcacacttgtcaatggcatttttagaacttagatgcttgtcaatggcatttcatggattatctctaacaatattggtgcatgagaatgtgaaaggtatcaagcctacatgttttttaagcatggaaacgtggatcagtattggtttttgaatacgtatggcatctctcctctttgtttttcctatgcaaaaacttcataacatttaatgcttatatataaatcaccttcagttcctttcccagataagttcatcaacaacaattttatattaattcatgagaaatttgttcctggcttcctgcgaatctatatattcccttctaggaatgtttatatgtcttttcaaatggaacgcgtatccttgcaagatcgagagaaatgggaacgcgcatcgatcgatcagttagttgtgttatgagaattaatcaattaattaaggtctctaaaaaattaattatgaggtcattcccaacccaatgactaggatggtgtccatgcattaaactaggtgaaaccccgcgcattgctgcgggaatttagtatgataacaataaaaaaataacgtgtaagatagctagataacatcagattaagtaaattaatgtggtttatgataattttaatttaaatagtatgtagaatggtggttcaaacgtaaaatataaggtggtatgactttatggaaaaagaaaagtagggagatagtttggaccgtagattaatcatctaaagggtaaaaacaattgatgtgatatgacttaattagagggaaaaagaaaaaagataatttagaccatagattaatcatttaagcactaactaagtgaggatgaactatataaatatataggatatcataaaacatacattacattgaaatattatgtgaattatattggatgataacttaacatgtttgtatttgaaaagctcttaaattataaaaactataaagatatagcatgtttgcatgatgtttaaatgtgatgattgttagtggatgatgatgtgacatcttgttaattagtggatgatgttgtggcatctttgcaagttaagcttaagaagttagtgggggataactttagagtaagataggataagttgttatatagaataaaaaatgatgtgtcaaatgaatataaataagaaaagataagcaaactatgtcttgcatgagacatggtttctacacaacattcaagacatcatgtgagataagtattattaaatttaagtatgaaatagttgtgtttgtattgaaatagtagtatcttagtactagttttttttataatttagagtttatggaaactatgtttagtgtcttaggtttggaatggcacgaggggtttagagaacttcaccaacacggcacctctctctctataagaaccccgcttaatttgcattccatgcaagccatcgtcgtgcaagagcgagccagcagtgcagcatgagaacaagcaagagctcgccgtcgccggcgccggcgcgcggcaacatcgccgtcgatctccggccgttccttg

SEQ ID NO: 75740 - DNA, 2764 bp, Oryza sativa
atgtcgaacgaggtgaaccatgtagggaaggctcccatgtttaatggcacaaactattccacttggaaaattaaaatgtctactcacctcaaagctatgagcttccatatttggagtattgtggatgtaggctttgctatcaccggcacgcccttgacggagattgatcaccgcaacctccaactcaatgcgcaagccatgaatgctttgttcaactctttgagccaagaggagtttgatagagtgagcaaccttgagagcacatatgagatttggaacaagttggcagagatccatgagggcacaagcgagtacaaggatgccaagcttcatttcctcgagatccaatatgagacattctccatgttgcctcatgagagtgtgaatgacatgtatgggaggctcaatgtcattgtgaatgatctcaaggggcttggggcaaactacaatgttcttgaggttgcccaaaagatgcttagggctctaccggagaagtatgagacccttgtcaccatgctcatcaactccgacatgtcaaggatgacactcgcaagcctcttggggaagatcaacaccaatgacatgtacaagttgaagaagaaggagatggaggaagcctcaccttctaagaagtgcattgttctccaagccgaagttgaagacaagggcaagggcaaggtgaatgaagccaatgaggacttggaggaagagattgtccttcttgctagaaggttcaatgatctcttaggaaggagaaaggagagaagaaggggctccaactccaataggagaagaaatagaagacccaacaagactctctccaacttgaggtgctttgagtgtggtgagaagggacactttgcttccaagtgcccttccaaggatgatgatgctgacaagtcatccaagaagaagagtggaggctacaagctcatgaagaagctcaagaagaaaggcaagaagattgaggccttaatcggggaataggactcaaatgaggagagctccgcctcatccgggtccgaggaagaaggtggtgatgatgcaagctccaaaaagaagaagatggccgttgttgccatcaaggaggctccatcactcttcgctccactttgtctcatggcaaagggctcctctaaggtaacatctcttagtgatagtgagagtgatgatgattgtgatgatgttttctatgatgagcttgtgagtatgtttgaggagctccatgcttatagtgagaaggagattgtcaagttcaaggccctaaagaaggatcatgcttctttggaggtcttgtatgaggagctaaagacctctcatgagagactcaccatttctcatgagaagcttaaggaagctcatgacaacctcctttccactactcaacatggagctctcattgatgttggcatatcttgtgatttgcttgatgatagtgctacttgccatattgctcatgttgcatcatctagcatttctacctcttgtgatgatcttgtggatatgcctagctctagctctagcccttgtgtttctatttgtgatgcctcacttgttgagaacaatgagcttaaggagcaagtggctaagctcaacaagaatttggagaggtgcttcaagggtaagaacactcttgacaagattttgagtgagcaacggtgcatccttaacaaggagggacttggattcattccaaagaagggtaagaaaccttctcaccgtgccagtcgttttgtcaagaacaatggtaagtattgctccaagtgtcgtgaggttgggaatttggtgagtgattgccccggtggtaagccttccaagacttgcatgtttgattctcattatatgcttaggaaggcttatgatggtagcattgttgctagatatgtgggttcgcctatactcggtggtaaaaagaatgccatttaggtgcccaaagctttggtctctaacctccaaggacccaaacaagtttgggtacctaaaagagcttgatcttcttttgtaggtgaactactgcaccggtgggagccattgggtgcttgatagtggatgcactcaacacatgaccggtgatagggctatgttctccacatttgaagtagaagggaatgaacaagagaaagtgacatttggagacaatagcaaaggaaaggtaattgggttaggtaaaattgctatctccaatgatttgtcaattgataatgtctctcttgttaaatacctaaatttcaatttgctttcggttgcttaaatttgtgatcttggcttgtcatgtgctttcttcccgcaagaagttattgtttctagccttcttgacaagtcttgtgtgttcaaaggttttagatatggaaatctttatttgattgatttcaattgtagtgaagcaaatttgaaaacttgtttagttgcaaaaacttcattgagttggctttggcataggaggctagcccatattggcatgaatcaattgagcaaactttcaaaacgtgatctagttgtgggcttgaaagatgtgaagtttgagaaagataagctttgtagtgcttgtcaagccggcaagcaagttgcatgttctcatcctactaagagtatcatgtccacatctagaccattggagctcttgcatatggatttgtttggcccaacaacctataagagcattggtggtaatagtcattgtcttgtgattgttgatgattattctcgctatacttgggtgttctttttgcatgacaagtctattgttgccgagtctattcttttt

SEQ ID NO: 75741 - DNA, 13150 bp, Oryza sativa
accaacgggcatctcgaccttgatgagagaggtaaaccggtagatttaaagctttatcgttctatgattggtagcttgctttaccttaccgcatctaggccggatatcatgtttagtgttagaatgtgtgctcagtttcaagccgctcctaaggagtgtcacttaatggccgtgaaaaggattctaagatatttaaagcattcctcaactactggcttgtggtacccaaaaggtgctaagtttaagctagttggctattccgattcggattatgccggttgcaaagtggatagaaagagcacatccggtagttgccaaatgcttggtagatcccttgtgtcatggtcatccaagaaacaaaactccgtagccctctctaccaccgatgcggaatatgtttcggcgggtagttgttgtgcccaattgctttggatgaaacaaacattgttggactatggcatatccttcaccaaaaccccactcctatgtgacaatgatagtgccataaagatagccaataacccggtccaacattctagaaccaagcatatcgacatacaccatcacttcctaagagaccatgttgccaagtgacatagtcattagccacataagaaccgaggatcaactagccgacatctttaccaagcctcttgatgaaacccgcttttgcaaattgaggaatgagttaaatgtcgtagaattctccaatgtggcttgagatagtgcaccatggttgcttcttttgcatattgtatatttgctctcatttgctcttttgttttggatttgttgccatttggttcttcattgcgaaaatggagcatgtcacattaagggggagttttgcactcttgtatgtgctctacttccctttatatgtgagcaaatcaactagtggtgctagtagtattttcaaaatgcccaagtcaacataagtcaaaacttttgcaaaatcaatgtaatttgaaaactatctcttggaaaatatttcaaaaggtttcctatatgttttccaagcctcacattgcaagaaaaatgatttttgaatgaaaatgccagtttggccctcttttgaagaaactagattcttagttttggccaaaatgagatttatccccaaaatgagattgagaaggaatttgagaaaagtttcaaaacaaagttggtagagaagaagatttgaaatgtttttggtattcaaacctttttcaaaaaccaaatcattcaaaagttatttgaaaaccaatttggcccaaaaacccctatagaccataaaaggtcacctcctagcacttaagtgagttttgttgcaaatcatcgtaatcttcaaatattatgggtgtttagcaatatttaaactcacacatttcaaaaattgctccaaaaatcaattttttattgaattttattgtgtggaggttgccggcttgtgcaagggctgtgcacagccggcatggggcctggtggtctgaccggcgctatatgcacggtctgaccggccaggtgcggcggtctgaccggccacatagagccggtctgaccggccggcaggtgggcctaggatttttgtcctttttcttctctcttcttcccctacccgactccatctcctcccattcagccatcttcttccccaacttgaaaaaactcctcctctctcctctcccaaaccctagccacctccctccatcaaatccattcggtttgaccgcggatttctctccggttacaccgtaagtgattctcctccgcctcctctctctattccatggattagtttgtgtttttgttgagtttttgatctatggcatggaaccttaggtgaagcacgaggtgttcttcgatttgcaccaatagagggtagtttcttggtgtgattcaactcctccaacgggtaaatctctctccctcttgtacattgctctcaaatcggtctatttcaatatctagggtttagggtagtttccccatttattccaatcttgatgaaataggccataccctttgatgttctggttccaatcttgtgcaactttgtcctagcaatttttagaatcatttgtgtggattgtggaaggatttggttgtgctcctgtcaatggcggtctgaccggccccaaagcgtcggtctgaccgacttgaggccggcggtctgaccggctgggagccgtcggtctgaccagccttggccctcggtctgaccgcccttaacaggcagcaaccccctttcctcccacttcactatgtggtttctaaaatcattgcttatatatcctttgctcctatttttcagtgatgcctcccctcactcgtcatggtcatcgtgcgcccactccggatcccgtgagtaagcctgaggaatcaagtggagatgattacgctcaaagtgatgaagaggttgaggcaaatgttgagggggctagtggggaggctagtggagatgatgtcagtggaagtggagaggatgaggatgaaggaagtgatgatatgaacattgatccctccatccaatttgtggtgaacatgaggaatccattgcagtataccatcttgaggcatcatgatcagtttttgaggcctcgggacaccccggatccccgttttcacaccgctttccagaagtctgtgtatgagcaagtttatgcagggaaagcatttgcagagcataagtggatttcttggagagacatcaaagagactccagagtttgaaagcttgcaggatctcttcaagactgttggcattgaccggattgtgaccctcaagcaagactacaatgaagatttgatccggcagttttatgctatagtgtgggtggctggagactatagtgagatgaagtggatgtccgacaccctccagtgttctatctctaggaggcaattacggtggctcctcaatattcgcttggactttggagatggcttgcatgaggagcacactcacaattcgctctccatagactatctctgtcagttttatgaagatggagcgcggtacacacatgggaaggttgacggcttgaggactattcctagtgtggttaacaagattgtgagagctaccatcctccctcgccttggcaacaatgatgacattagaggggtggcttggcacgtcatcgatgcaatcatccagggtcgtcaattcgacattgtgtctctcatgatgcaagagattgccatctctaaggggattttcactcagggaatctactatgccccttacatcatgaggttgattcaagacaagcttggggctgctgggcaaaatttgaagaagcacaagcagtacaagccccgccttcagcttggagctccccgtgcacctaggacggtgccctcttctcatcctggagctagctcaagctcagcacctccttctcctcctgggtatgatccaaatgctttcttccatccatagtatgcttattttggaacgcaacctaatgaatacttcaacccggtacttggggctattaataccctaagtgaaagcattcaacgcttgtctatcgggcatgaagcattgcatgaggatgttcgtggcttgcgcaccaatgttggagacttgaatgcttccgtgggaagattgcatactcgagtgggtacattggattctcgagtccaaatgttggagagctctcaagcttttgtatatcatcgtcgtcgtgatgctcctcatccttcatcttcggctcgtcctccttctcctccgcaagaatgaagacctttttggtacttgatgccaaaagggggagaaaaagtccttaggtgtgctctatgtcttgtgggttgggattagtggtagtgaggttagtcatctcatatctaataggtttaggtgttttgggctatattatgtatgggtatgggctattactatatattgtgtgttctttatcgttttgttgaactctctatgtcatttggacccttcatggtcttgtaatagcctatgttcatttgtgagcccttttaggatgatttgtgacttatgtgagttgaatggttaagtgatgtgaacttgtgtgatgatagatggtgtatgtgatattgatatatatgtgaccatcttatgctcatggatgaatatttcttgaagttcacatttgagatattgctcttgtgtttgtgatatgttgaaatgtgaaattgaaatgtgcattgactccatatttgctagttgtaattgttatgcacatgtttaaggggagcttttgatttcctttgcaatatatgtccatatgttccatgtttgtttatatatatttgtggtgtttgtcatcaattaccaaaaagggggagattgaagcatctaggcccccattgttaattttggtaattaattgcaagcgctaattgtggactaaccgttgctattgagatatattttaagttaggcccacgtcatgtgtgcgcatggatgactatcgatggattaaaatttacggcgcaaagcaaagggaaagaagacggtaaaactagtgctttaatttagaattgatcgaggtgtagggcgatcaaatttgctagtttatttttagttttgtcgtactatcaagggggtaatgacctagcaataagatgattttaattgccacattaggtcattatgcatttagacttgtgctcacatttcatctctcacacacaatctctttatttttcactgggttcggcctgaccagggcggtcagaccggccacacagtggcggtctgaccggcgtgccttcgctggtctgaccggcgtgccctggctggtctgaccggcgccacaacggcggtctgaccggcccataaggccggtgtgccgccggtcagaccggccccctggaggccgggatggtgttgcttggggtggccgatacagagccgacggagccgtgttcggtcagaccgagccgatggcagtctgaccgagctgaggctggtctgaccggccactcaacctcggtctgaccggccaggccgatggggccctctgacagggctacaacggctagttttctagccgttgcagagtagcacggtctgacagaccggtcacatacctctggtcagaccggcagagcacagagttgggggatttcgcccccaacggctagttttggttggtgggagtataaatactccccctttagcagcaaggggactctcttggcacccaattcaattgcatacaccccttgcacctctctcacacccacttgagctttgtgttcatccatctagtgtgttagagggttaattagccaagagtcaagtgcattgcttccatttgtagagctagtgtggcacttgatttatcatctccacgccgggtcattgcttcttactcttggaggttgccgcctcctagacggcttgtggaggagttgcccggtgacctctctgagaagattgtggaggagacccagcgccggtttgtgagtggtttggagttcaccaccttcggagtgaaggaagaactacccaagtgatcaaggcttgggtagtcctctccgtgggccggctcccgccttgcccaccccttgacaaagggggcgtgcggtggcttcgtggttgagcggtggagttggcctcacctcaacggggagtaggaaaccggcgagtttccgaacctcggtgaaaaatctcttgtctccttgtctcatttgattgtcgcatttacatttgtgcaatttatatttctagagacttacttgagatcatatcaccctaggattgctaaacattgacataggagtgtgatttattttcctagagatataattgagccactatcaccctaggtttgcaaaacataacttagttgcttagttagagttgaccctcaccaagcctagcaacataggttagttttaattaggtgtcatttgtttttaaatcgcctattcacccccccctctagtcgacatctcgatcctacaaccagtagcaataattacttatttaacctcatgcaagcatatccaacaatcatccctcacattatttgcataatattttaataaaattataatatttaatgtatacttattaatatgtttcacattaaagtacgggtatcatttatttttttcgtaatactaagtactgataaagcttgatgtttcattattttttcctttttactcctaacttgattgtcggaaaaaatatattgagaattgcttagtaattcttgtagcaaagcgcgaggaatcacctatatttttaaatagccagcgacgtgtgctagtcatttcaaatcgttttttttcaaaatatttacaaatatttagaaggattcatgttattaagctatattatgttttaatataaacattaaatttttacttgactattttagtgtaactagtggttacaaaaattaaaacaataaagtcaaagttaatagtactagttatttgttcatttaaaaagggatgggggtaaaaaagaagagaaactgaaggcctgaggacgtggccagatgaaaagaaggccaaagatagaatgaaaagaaggccaaagataggaatatgatagcggcgaggtcatgtatactcacgagtcacggcctttggaaagcagcaagcaaagcaaagccttgttcctccttggcaccgtccccctctccatgagaatatgcagccgtctcctcgagaaaattgcatatgtaccactcataaaaacttgcttcgctataatgtcactctcaagatgggatttgcccaaacgccactcataacatgtgggcattcgctggtatgccactttcaggctttcttccatttcgaaaatattgttcatcaatttcaatttttctcggactattatgcccctgataaggcgagcgtgagaaggcgagaagagaagcggcagcgacaccggtgccgcccaccaccactgcgccaccgctacctctgctctagccgccgtgccgaggtcctccccagctgtgccgctcctcgcctcctcctggtccacgcagttgtgccgcctcctcggtgacatacaccatgagtccatgacacacaacctcacttcatgagttcatacatataacttgcaagcggtttaattttcatttaatttcgcatcaagcagagctaccgacttgtttaattttgtatgagcaagttcgttcgctttggttaacccaaacgaactttaaaaagaagttgcaaaatgtttttcgaagatacaagaagatactactagaatagaagtcgctttgtgcttgaaaattatacatagttgttgatttcagaatgtaaaatcggcacatcactaacacaaaaagtgaacaaaaatatctaccgggcaccagaggaaattacacaggaggcaaaaaaaaccactatgaattcagagaagagaagaaaaaaacgaaagctaagctcaggggtcctcggtgatgcacgagaggtgcggctgcaacggcgaggcatggctcctggtgctcatgcaccgacggtattggtggtggtgatgcttctgcgccctcatcatccttgtcttctccggcgacgcgctgcccgggctgcccaaccaatcggcgacggcggtgctgccctccgacttgctgcggacgtggtgcccgcgtcggcggcgccgccggtgctcgtcctcctcttggcgtcggggacggaggcggccgggatgaggaagtagatctcgccgcgctccagcttcgactccggcgacacgatgtgtatccggcctaccgcctcctgctgcgacaagcactgccggctcagcacgtggttggggtgcgccgccagcacctcgccggcggacacggcatggctgtacgcatcgatgcggccggctcggtgcctagggtttggctgaggataggcggcacgactggggaggagactcgccggggagaggcggcggcgcagctgttagggggcaggaccgatgaggcgcgccgcggcggctggaatagagaggcagtggcggcgatgcagtggtgtggtgggcggcgccggtgtcgctgcctcttctgttctcgacttcttgcgctcgctcgctagattgaaacgaagagaagaaagagtccgactgaatcagttgactcaggggcataatagtccaagaaaaattgaaattgatgaaaagtattttcaaaatggaaaaaaagactaaaagtggcattccagcgaatacccacgtgttaagagtggcatctggacgaatcctatctcgagagtggcgttacagcgaagccagtttttattagtggtacatattcaattttctccctctcctccctttatttttgctggagccgacaagggcagaggcgaggcaaggcaaggcaaggagggagagaggcggcctccggccatggatcccctcataaagctccttgacgacgacgtggtgcgcgaccccaaccccaacccctccctcctcattctcgaattcgtttgttttttggggggaaaggaaggaaggattcaaatggtggctctctcttgttgtggggttgcgcaggacgagaccatgcactcgggcgccgacgtcgaggccttcacggcggcgctcaaccgcgaggtggagggcagcggcggcgcgagcaccagcgccgcggcctcctcctcccagccgctggatcacggcgccggtgagtttccctgtccccaattaaccctaggaaactgtttcccttcctcggatcgaattcgtgtgatcctgtggagaaccgggggttgtaggaatcaacaaactgtactgcgagggggttggacaatgcgctacttggaatggggtaataatgaaatcaagaaacttttatgtacgtggcacctaggtttagtgttcgaattaacgttccgcaattttagatttagtgttggaagggattctgacaaatgagccttctatgattttttttttggtactgcaatgggttgggctttttctcattattctcatcatggagggccttcccctaatatccctaatattaaaatagagataaatattcttcatattgagacccaaatggaaaaaaaaaacaattcatcaagggaagaaaaattataggaaataagtgtccaagtactgaagggtgtgaacataacagcttgttaggaaaacaaaacttttctactggtttatctttgagtcccctaatactgactgcatgaaaataacaacagacgtttataagggtttgtcttaaagaatgtggttattgatttcgaaaaatcatgtagattcttgaattttaccctgcatataggggaatggagcagtaggccatgaattcatgacaatctggagtagaccacaacacttttttcttgcagaaatgattctcttagtgcttgatgacaaccaaacattgtgtaactcaaatagctgctgtgccattgaatccacttttcctttgccaggtctgtaaagtatgcctggatagaaagaactttatccagcgagcattattataccaatattctatgttgctttagtcaacaataattaagaggcatagataaatatgtttcttgaaattgagcaacttccaacttattctgtaaatatatggtacccactttgacaagagctggtgaaatttacactagtgttctacaagaaacgaagttcctaaacaatatttcttgagcttgaatataagttctgattgacttctgtaatcattatacagtgttctgtcttgaagtatcaacattacactttgctgtggaagtctctagtgttatggaagtaatgaaatttgcaagcaaagaaccaaagtaggaacatttacagtaaacatgaagcttgcatacccatcattctatgttttcttctgcccttattatcactgctcttgttctattttacactccactgaaaatagaatttcaaggaaaagcacaactaccttttgaggatagcacttatacctggtttgaaacttggccacttgcagcttacaaacttagaaacctttctttcatggttgtggactagcctctgtgcagccagccatgcccattcacgctagctgagacaagggttggcgggtttagttcaatgtgtatctatatttagatagcgttgaatattaatcctatctatagtttattggttcattagatttccttcttcagtgactggctacataagcacatgattgccatccctttggattaagcaataaaattgcattgtaagcactttcacccaaccaatgcgagtacttaaaagggttagttgtatgtgagttttagaaaaccccaggttctgtgcttcgcctcacttagcttggagaaaacattgtggcaataaataagtaaatcctatgttttgtcactccctgtgctgttaactcattgacatactgctaaagttactgaaagaggagaaagagagcacatatttcattgacttgtcgcacttaaaacagtctaaatgaattgcatgtaggttccattggtttctttctgttttgggacataacaagacagactttcaccactatattttcttaaaccttgggttaagttaaaatattttcacaacttctgtatgcgtgttttaaacgcaggtaaaaataccaatcggaaagataaatgactctattagtctctgacactgacagagatactgtagttcaagggtacaaaattttcatcccgcacatgcttctcacagtggcaaggcttttggaatgaagggtagcatgattagtctctcctgatgtccaactatttatgaactaaatatcatattgcttggagttagttctccatgttgctttcagattattatttttattattgaaatttgcagattgttttgtttgttgaatcaagcctgtttaaacatgcaataacttcagatctgcattcatcccttttgacaaatacaatagagagatacatttgtggaagctaaagctagaaaacttgccacataagtagcttgtttgcttatcagctgagtggcaaatagtttgtacaagctttagatgtttgcaatgtgtttttctttaatattgtgaactgggtagtggggtagagtatcattagaagagtgttctaagccttgtaaaacttactttctagatgtgcaatcaagtaaattatcagtgaaaattgcaaaatattttgcttcatcctgtctcaaagtacaatgcaaatatcacgaaaacttccaataacatttggtcatatgaatatgagggtaagacgcacatgatacactctatgttaaaatgctaaactgggggaaatgtgaccaaagtcctgtggtgcataatgaactgttactggaagcccacaattttgccatatcaaatacctcagcatattgtctttaaaaaacatctaagcaattcagtatatttctcttgaagtaaaagaattttagcatattcttggtaacctagttatgctatttctgtaaaaaaaaacctagttatgctacgattgtatttatcaagtattcactttatagtaatttatctcaaatgtaggtcttgtgcctcaggagagcaattcaatgttcacccacaatcatgaacagtggcagggttcagtaaagaatgaaattggaaaccaggagaaccaacaacaggaacagaaacatttgcatcattcaaatgagcagccatctaggcctgaactggtatctgggggtgctgataataaacaagaccagccaaaggttaagcaagagccaggaaacagttctcaacaaagtattctggtcagaagcagcctttgcaacagatgaggagtcaacaaacaccaagcacaaatcaaactaatagtgctcctacggtggggaaacctcctgttgttacatttcatatgttaataccaattttgagacggcaccttgacaaagacaaggatatgcaagttcagtccatttttacaaagttgcgggttggttcctgaactatgctgaattaaaaaaaaaacaaatagaatattattgcataactgattactcaactatacttatcgcataaagatatcctttattttcgatagaaaaatgaagttagcaaggaacactttctcaaagttgtaaggactattgttggcgataagttgctcaaacaagctgctgcacaatatcaagctcaggtaactaaagtttcaatttattagggttcatttgagacctctcccccattgcaggtaactgactgccactttacattgtgcagttagtgcgtaagttaggtcaatctatctattctttaagttaggtcaatctatctatcaccactttctgtactgctattgttgttcttaccatcacaatctgtttttcttgggagttattctggtcttgttagctgcaagctgctcatgggcaacggaatccacagacaaatccaagcaactattctttgttaagtcaagtttccaatcagcagaatgttcccagtggttctacgtcaggagttgagcacaaatcatatccgtcagctcattccattcctgcaaaccaagctagtgacagcccaagaccaccttttttccgaccttctttgtcaggccaaatgcaaagtaacatgggctatccatcttcagaaagcaatttgcaaaaggttaatgaatctagtaacatgtcagatgtgaaaggggggcatatgctcagccatccacacaatatacaatcagccccagggcaagcaacacagcatccacaaacatctttacctgtgcttgggtcaaataatattcatgctcgtccattgccacgaccagttggaggtccaattgtaccacttagaccacaaatggcagattccagtcaaagaggacaattagtccagggagctgttacctcagtgactgggagcatggcagcacgaccaacgttgcaaactaatatatctccatggcaacaagtaaacaaagagcagaaaactaaatctttccctccaacagaacacacaaataaggtaactgaaatctaatgctctgaatctacgtaagtgtttttttttttttgcgcctccatgcatgtaaatcaagttaacacagcctttggatgtaagggtgttggtgttcctgaaaaccaaccatcaacatcaggtacttctaaatctttcaacacaacaaactcaagtcagcctcatcgatctcatggcactcaagcagaaccaaacatgcaggta

SEQ ID NO: 75742 - DNA, 2456 bp, Oryza sativa
cacccatgtatactgctataggaccttgtgtgcacggtttacgtaagtttagaggtacacatttctgattttatggataaaagaccttaaaaaatctcgctgttaagctgaggtaccatcggtgaacttattccttatctcttgtacagtttctacgaagcaagcatgacaactgacaaagatgcaaaattgaactgaccttcgcttgtttgggcatacaggccgtgtttagattcaaatttttttcttcaaactttcaacttttccgtcacattaaatatttggatacatgcatggagcattaaatatggacgaaaaaaaaccaattacacaatttgcatgtaaatcgcgaaacaaatcttttgagcctaattacgctatgatttgacaatgtgatgctacaataaacatttactaatgacagattaattgggcttaatagattcgtctcgcagtttacaggcggaatctataattagttttattattagtttacgtttaatacttcaaatgtgtgtccgtacacttaaaaaaaaattgtcacacgaactaaacacaaccaaagaatccaaaagtatttcactagttcatgcgccaagaggcaagaggactagtgtgttgtaccatgaaaacaatatcataactttccatcccaagaattttttttagcagaactagaatctcacttcagatcaaacaacagcagcagcagcagaggcagcaagatagtagaaatgaaaagggaaatgcaggctattttgttactccttcgagcaaagctggtcaaacaacaatgataaatgccgaccctaaactacatatatagccactctcacttgttagcaacctctcctagattctacccctaccacagtccacagtgcattccaacccctaaagcatgttataacaagagaaaacttaacatatcaagcagaaaacttgagatgtttttagcatagatgaaccagctgttatatatagttaccacttaccaacaaaaaaagaacatgttaaaaatcccaggaaacttttcatgattctagctgcccaatgcccactatgccttttcgtcttaggttcatatttttgttagcaacgcttctttaagtgttataggatgaacaatctattaaacggtacgtcaaaggcaatagtatttctaggaaaaaatcgcttgtacaataacatttcatggaactcgtacttgtcgatgatattttttaaattggacacttataaatggtatttcttgaattttctctccacaaaagcaacttcgctgagattgatcatgatgcctaggtgctgccaaaccaattgaatggtaggcaggaagaccaaaaggatatgctttattggacaaagatggtggaaatgaaactaacagacagacactttatttctcaatgaccgtgcacctctttttattttttcttatgcaaactatgcacatcaattagtaggatcatcatggattattgtgatcagaggctacatcagtacagtacatcaccacctaatgttttgaatccttattgggagtaggttgcatagttggaattgtctgtacctagggacaggtaaatagcaaggtcagtactaaaagacacctaattcctaaccacaacagaaggagagcacatcctcactttcactgacaggtggcgctcatgaccacacatcttttgacaaaacatggtctatataactgccttttattgctaaaattatctctgttcaccctaaagattggcctaccttgtcttataaacctggcactagcctactaggtgtaaagcagatcagataaaaatcgattaccactcatgagtcatttgccaagacctgaagaccctacctaactaattccacattatactctgtaatctgcacatgtactcttgtagtaatcgacacataatctaagcctgcatctgacacatgttgcaaatttctgactaagaaatgctctgcatatgcattttgctagcaaggtggatgaccatgaacaacattcagacaaacactagagcattttcgggtaaacagcactagcttatgtcagtaggaaagtttcctgtgtgcatcagctcacaaggtcacaaggatggttagcaggtcaggacttcatacaaataactcaactagccaactaggcataaaggaaatattagaagtaatgaatgatccatgtgttctatagagccaatatcttactatcagatgacagcactttaactattgttaaaactatcatgcaagacaaaccgccaggagttggtacttctactcagaagcaattggccatcatacaccaaaaaattaacgataaagaaataatgtaatccaaaaggttgactttgactcatcatatactaagtcatccatgcaatcacaatcatttatatgacaatccaaacatatccaaagtcatccatgaaaaatcgcgtaca

SEQ ID NO: 75743 - DNA, 3252 bp, Oryza sativa
tagtggcaggtttacattgaagatgaatatatgtctatgtatatataccactttgagaattattataagaactaatatgaaagaaaaatcttactatcaatcttaatttgcattgatatatatcccagggtgaaaatttggcatggagatgtcaagtgctatttgttatgtatatctatatatcaaggcccagcctatatattaggcccatatagtccctgaggactctatatatattgtcatccagagagaaaaggattgtattgattctaatccccaaggtaagtaatatggtatcagagccatggattagggttaggtttgtaatcatctcctacccacgatccatcctgctcatcacggcaccatctcaccactgtcaagcctccttccggtcatcatcgaggctttgcatcctctgcatcatcctcacgtttgggagcccaacctctggtcttcatctaggaacacgctctgcaatctgctctggactgaggactgctctggtttggatttaattggtaactggtatctttcttgtttggcggctgcggcggctattattactactatactacatcttgcacctcatcgctgcatttattattattatccttcatggtcacaacaataatgagtggtctttttgtgtagagactagctttgaggggtgatggttgaccttttcatttaaccgacgatccacctgcgcctaaaactggtgataaaactaatgatactaatgcagctgaaattaaaagttggaaaattaatgatggtaaagtgatggctgccatttttaatagtgttaagcactccttgattatgagtctgtccaagtttcaaacagccaaggctatatggggttctctgaagcaacgttatgttcaagatagtggtgctcttttgcatactctcatgcagcagactcatgccattgagcaaaatggtatgtccattgatgagtactactctgcatttgatcatcttattgacttcaatggtgcctacctatacaactgctgcatgtccagcacaccaatttcttgaaaagtttcttacatattgctttgttatgggagtaagagaagattttgactttatccgtactcggctgcttcacagttcctctactctaaccatggcacaggcattgtctgatttacttgctgaggagacacgcctcaaatctctacctgcaccatctgtgtcagtttctcatggtgtgttagcagcttctcagaggtttggcgcatccagaggtacctcttcaatgccttgtaagcattgtggaaagacaggacatagtgcagagaattgttttgctcaacacccagagaagttggctgagtataactacaacaaaaccactgttataagacatttgacttaagacactctgtaagttgtctcaactttgagaattacgattaaaatagaggcgacttttgagacgctttacaagttggagacatagtttaagacactttacgattagcataagactacatcgtttagatatgaatattgagacgttttcagacgtctcatttctaagatgtgtttagatatgaatactgagacattttcagacgtctcatttctgagatgagtttagatatgaattttgagacatattatatgcatgtcattgacatcaaacaatacaattattatttacacagaaaaaaagaatatttgaatcatttagattccatcggaaaactacataattccttatcatcttcatcacataatattataattatttaatcatttaaatcatgagggtttccgagactaaaataatattataataatttttgaatcattcagactcaataaagtctctctcaaatgattaatattataatattatttgaatcatttggactgcattgaaaaacatgaaaaataatgtactcgtccacagaacgtacagattgcgataatggggcactaacaagattaacgtgaataattaagcagcaagaatgtgcttctttgttagataggataattacaaacatatacacgtacttggttgatagaagtgggctggacatgctgcaaaccactttatttgttgggcgcacgatttgctttgttgggtgcgtatttgtgagaattcttggacgatagtctccgcaacaacatcctgaacaataaccctcgtgaacaatccccttggtggcggcgacacaactcacgccaacagattgcgcctccgcatctcgcagcgcctcctccgtcgtcgggtgcggggttccgccgccgctcgcgacctgaggggcagggcctccaccggcagccgtgggcataggacctcctccgttcggcagttcaccaacaggtacagcttctccgccggctggcaagcccaacgcatacaatccattactccatcatcaccattcagcagccatttggtccttttcccttttaagtctttatttggattgggttttgttatgtgttttcccttgtcatttagatccgatgaattttagaattaaaatcttaatcgcttatctagcactagtagtactgctagtgcggctatactggtgcagattcatcagggtcactagtgaccaagcattggagtacattatccctgagaggcttgtgagcttgaatgcttgatagtactaacagattttggtgcatggaacctgtctgggatgtacgacttccagccacatcgctgactatgaatgcaaacaacccttaaacttatatagctattgaattgaacttgatatgcagaacaagtattattctaattatctctagtgatgtgatgtcatttggctaactctatttacattacatgcttacatatattttatgcattatgttttcgctctgtattttttattttttaaaatatatatagacgtatccccgtatcggtgtttttaagaaaatgacgtatcctcgtatccccgtaccgcgtatccgtatccgtattcgtatccccgtatcaaggtaacatagatattacgtagaaccaagttaagacaacttacgagagagtggatccacgcatcttatgaaattttgctgtgaaggtggttctgaatgctagatatcagttcccaaaagatgaaactacctttcaccagtggtattttaaattatggttatgaaatttgttaactattaacatagttatttctatgcgcatcttaatgtccttctcaaatcacccaatcaatttcacattcttttttgtataactcagaattg

SEQ ID NO: 75744 - DNA, 8912 bp, Oryza sativa
agcttcctgttgaaatatttacttgctttatatcttaaaaagagtgtatcggagtataagccgtacacgctagatctatctgatcggctatgctgtaaacgtctataatctcattgttaatatatattccgatctaagtgatttatattgtctcggcatggcgaccgatctatcccaatcacttgatttaagtatatatcgacataaagattatatactgttaatatctatagccaatcgagtagatttagttttaatttacttattaacaactgccgatcgattaacatatgacatcggctcaaatataaatgatatgtcatcggcgactggccgatcggctatcatttatggatttaaccgcggtttctttgtctattatttcttgttgattgcaggatcaaatcaactggcacgctgacaaacctaaaaggcaagattttggatctgcactggagttaagcagatctcccaggcctcgtatttttattatcaacacgcttttggcacgcccggtgggaccgagtttcgacaacatcttctgctgagaaagcaccacagtcactggcaacaaaaccggtgatccctcctcagagcaagattccaaagcccacaggaactagtgagtctgaggttaatgaaggaaacattattccgatcactgtagacaagctttcaccagaacaaaagaaggagtttgaattgatgatgaaacatacgcaacaacaattcatgaactcattaacagaaaccaaacaaggaaaagtcattcaaaagtataagctgaaactagtagctgatatgcctggaatgggttcgtcaaaagatggtgacactcaagcagctaaaggtagtacaaacgattcgggtgataaaggcacataccctaaggatggtgaagttggagttgtaggagatggcagtgaagaacaattgcagtttaacaacttccaggaccagattgactatgctgtgcaacatgctttgatcaaccaatctggagtacttgttaatactttaacaaatatggtgaagactgttgtcaatggtacaatagccgagcaccaagccacggggccagtttatctaccaggtggtgttttcccaaactacaggcctttggtcacaggtaactagcaggatgcttccaatataccgccagttcagccgacggcaccggtttcaacccctgcacaagctgcaccatcgtcggcacctaggcagatggttaatcctcgattgttgaccagggaacagccacagcatgttgggcaaaatatcaatcgactgactcaggagcatgttgctgcgatgtttttaccaactccgacaacagccgacccagtacagtcattgccgattcaacaaacaccacagaggcaacagacggttcagccgattcaatagcagaatgcaacatacatcagcaaggttgagaacacctgataatcggcaagtacagcacgtggtcaaccaggttgttcctgagcacttggttcataatgtgcagccagatcaatcggttgtagcccaagttattcctgagcatttggtacgtaatatacagccaaatttccagaactatcagggaggtaacttgaattatcagtatcagcctccatcgccccatgtccagcatcagcaaggtggatcacctcaactgcagacgttgccgcaatttaaccagtttgctcctcaacttaatcagttcgagccgattcagcagcatgtgcaaggagtacctcagcagaggccttgggctgatatgattgcagatgtgatgagggagcagtttggactcaagccaaaggacactggaaacttatatcgtcatccttaccctgagtggtttgaaagggttccattgcctagccgatacaaggtcccagatttctctaagttttcagggcaggataatgtttcaacttatgaacatatcagccgatttttggctcaatgtggtgaagcatcggctattgacaccttgagagttaggttgtttcctttatctttgtccggatcggcgttcacatggtttttcttctctaccatataactctgtcaatagttgggccgatttggagaaacagtttcacaactatttttacagtggaatacatgagatgaagttattagatctaacggcaataaggcaaagacatgatgagtctgtgcaagattatatccagagattcagggagatgaggaataggtgttatagtttgtctttgactaattctcagctagccgatctggcttttcagggtttgatagcaccgattaaggagaaattttcatcccaggatttcgagagtctatcacatcttgcacagaaggtaacttttcatgagcaacgatttgctgaagctaagaagaatttcaagaagatcaatcatgtatatccctatatatatgattctgaagaggatgatgattccgaagtatcagcagccgaatgggtcaggagcaagaaagtcataccatgccaatgggtgaggagttctggaaaagaggaaaggtttgactttgatattaccaaggctgacaagatttttgatttgttgcttcgggagaaatagattcaacttcctgctggtcatataattccatcggctgaggaactaggaaagagaaaatattgcaagtggcataattctggttctcattctactaatgattgcaaggttttcaggcagcaaatccaggcggccattgaagggggaaaggtcaaatttgatgactcaaagaagccgatgaaggttgatggtaatcctttccctattaacatggtacatacttctgggaggacagccgatggggggaagaatcaatgttttcagatgaattcagctagaattatcaacaagtatcaaagaaagtatgacaagcagcaggagaggtattgtgaagaagatgatggtggatttgatcctcattgggactgtgagtttttcagattctgttggaacaaaggcatgaggctaccatcaattgaagattgccctgggtgcagtgataatacaggaagttcaagccgatccaacaatagaggtaatcggctaggtcataaaagggtgtctgttcatcagaggttgggcccggttaatcaagattgctaccaggatgacgatgaggataggaagactcagtggtgtccttctggtattttcacaaagaatcaaaagagaagggttcaaaggttgaggaatagagaacgcttccaggaggtgcaacaagagattaatcatcagctgaggaaaacaaagaccaagcaggagtggcgtgttaagagcgcggttacaacagccgatgaagttgaagctaacaaggcgagaagattgcttaagggtaaggctactgcatctgcatcggtgaatatgatttttatgctacctgcagaatttgaagctaggcaagccgatgttgatgacgttgaagaagtttctgctagattggttttgtcaccagaacaagcgatttttgagaagccagaagggacagaaaatcggcatctcaagccattgtatatcaatggatttgttaatgggaagccgatgtccaagatgatggttgatggaggagctgctgtgaatttgatgccatatgctacattcagaaagttgggcagaaatccagataatcttaccaagactaacatggttctcaaggattttggtggcaattcgtcagagactaaaggagttttgaatgtggagctgacagtcgagtaaaactgttcctacaacatttttttgtcatcgatgggaagggttcctatagcctgttgcttggaagggattggattcacacaaattgttgtattccttcgaccatgcaccagtgcttgattcaatggcaaggtgacaaggttgagatcgtgccagccgacatgtcagttaacgttgctagtgccaatttagctctttgggagatggatggtattgattgcctgtctggaaaagtttgggatggagattttctaaaagtgtccgattgtgatatacagctaattgaagatggagagcccaaattattatgttgagggcgtcttggagggttcaaacgtctacaccaaggacacagtagatgatctcgatgacaagcaaggagagggtttcatgtcagctgatgatttggaggaaattgacattggtccaggagatagaccaaggccgacattcattagtaagaatttatctccagaattcagaaccaagttgatagagcttttaaaggagtacagagattgcttcgcttgggaatattttgagatgccaggactcagccgatcgattgtcgaacatcggcttcctatcaaaccaggggttagaccatatcagcagccaccaaagagatgtaaagccgatatgctcgatgctgtcaaggctgaggttgcacgattatatgatgctggcttcatacgtccatgctggtatgccgaatgggtttctaatatagttccagttatcaagaaaattggcaaagtcagggtgtgcattgattttcgggatttaaacaaggctaccctaaaggatgagtacccaatgccgattgctgatcagttggttgatgctgcttcagggcataagatattaagttttatggatggcaatgcaggttacaatcaaatctttatggcagaagaagatattcataagacagctttcaggtgtcttggtgcaatcggcttgtttgagtgggttgtgatgactttcagcttgaagagtgctggggctacatatcagcgggccatgaattacatattccatgatctgatcggctggttggttgaggtttatattgatgatgtggttgtcaagtcaaaggaaatagaaaatcacataaccgatttgaggaaggtttttgagagaactaggaagtatggcttgaagatgaacccaacaaaatgtgcttttggtgtatcagctggacagttcttgggatttcttgttcatgggagggggattgaggtaactcaaaggagtgttaatgcaattcagaagatttaacctccggaggacaagaagaagttgcaggagttgatcggcaagataaatttcattagaaggtttatctctaatttatctggaagattagagccttttacacctttgttgagattgaaagccgatcaaaagttcacttggggggcagagcaacagaaggctttggataatatcaagaaatatcttagttccccgccagttttgatatctccacaaaagggggcaccgttcaagttatatttgtcggctggtgagaagtcaatcggctcggttttgattcaagagctcaaagggaaggagagggctatattttatttaagccgaaggcttttggacgcagaaacgaggtattctcccgtggagaagttatgtttgtatttatatttctcctgtacaaaattaaggcattatctattatccaatgaatgcactgtggtatgtaaagccgatgtggttaagtacatgctgttggctccaattttgaaaggaagggttggaaagtggatatttgctttaacggaatttgattttcggtatgagtcaccgaaggcgattaaggggacaagctatagccgattttattgtagatcatcgtgatgactcaatcggctcagttgacattgtgccttagactttattttttgatggatcagtgtgcactcatggttgtggtatcggcttggttatcatttcccctcagggggcaagtttcaagtttgcctatactattaagccatatgcaactaacaatcaggctgagtatgaagcagttctcaaggggttgcaattgcttaaggaagctgaagccgatgctatcaaaattatgggtgattctttgttggtgatcagtcaattagcaggagaatatgaatgtaagaatgatacattgatggtctacaatgagaagtgccgagagtagatggatggatttcggctggtaactttaaagcatatgtctcgggagcagaatgttgaagctaatgatttggctcagggggcatcagggttcaagccaatggtgaaggatgtcaaagtagaagtcgccacaatatcagccgatgattggaggtatgatgtgtatcaatatttgcagaatccatctcaagtggtttctcggaaattgcgctataaagctttgaaatataccttgttggatgatgagttatatcatcgaacggttgatggggtgctgcttaagtgtttgagtaccgatcaagccaaggttgcgataggcgaggtaaatgaagggatttgtggtactcatcaatcagctcacaagatgaagtggttgcttcggcgtgcagggtatttttgatcgacaatgttggaagattgttttagatactacaagggatgtcaagattgtcagaaatttggagcaattcaaagagcaccaacgtcggctatgaatcctattatcaagccatggccattcagaggatggggtatggatatgatcggccaaattaatccaccctccagcaaggggcataagtttatattggttgtaactgattagttcaccaagtgggtagaagctattcccttgaagaaggttgattcaggagatgctgtacaatttgtcaaagagcacataatctaccgatttggtattcaccaaactattacaactgactagggatcaatctttgtatccgaatagtttgttcagtttgctgatagcatgggtatcaagttgttgaattcttctccatattatgcacaagctaatgggcaagccgaggcgtctaacaagagtttgatcaagttggttaaaagaaagatttctgattatcctcggtaatggcatacacgactggctgaagcattatggtcttatcggatgacttgtcatggatcaattcaagttcctccttataagctcgtttatggacatgaggcagttttaccttgggaaattagaatcagctcgagaaggacggagttacagaatgaattgacagctgatgaatattataacctcatggctgatgaaaaggaggacttggttcaatcaagattgagagctcttgcaaaggttaccagggataaggaaagggttgctcggcattataacaagaaagtggtgcctaaatctttttctgaaggggagcttgtttggaagttaactttgctgataggaactcgagataaaaaattcgacaagtggtcgccgaattgggaatgaccgtttcaaattcataaggttgtgtccaagggagcttacatgttgcaaggacttgatggtgaagtttatggatgagcacttaatggtaaatacttgaagaaatattacacaagtgtttggattaattcatgatcggctgagtttgccgatgcatgtaatgccgatgtagttgacatcgcctttagatggccgatacaaattgtatcgcccttagcagttttaaaacatgatcggttgtgtttttccacctatggtttttgtcttaaactcaaactggtttttggagttcagggtcattggattggccgaagaagtgatatctaaaccagtgatcatggtgatgtctagcagagtgtgggtcatcggcccttgattgaacatgaaggcattaagagtgttggaccagaaataagctgcagaagccatcagaggttcatctttagccgaattttctattgtgagagcaagcgcttggccgattcctagttcatcccaatgaacctgcttgctagccgatacacgcttgtaccatacgggtcataacgacaaccagtctcccgctcccggtcgagatcgaggacgagatcatcattcgacaagcaaggctcctcaaccaagcgacccctcgtcctcgtcatcatccttgtcagactagcctccccgacgatgtcagcatcgcgggctaccttttgctctagagggtggatgcagggcattcatgcccgaactccaggatgtacggtggcccgagaaattccgactgggagcaatagagaaatacgatggaagtacacacccagaagaatttctgcaagtctactctacggttttctatgccgctggtgcagatgatgttagcgaccaaatttggtaatttcagtatcggagatgaaaataaaaccgaagcggaatcaaagaggtagatcgttccagaaaaagagcaagattcggctgaagtccaaatcggctacgaccaaagtcggcagagttcgagtcggacaaggtagtcgattcagctgaatcagacaatgtgactcagtatacgtcatcgggctgagttaatgtgcttcatatggattgccacacacggattcggtcctgaaacgacaattgtatctattaattaggatattctatgtaatttccttagagataagtttgggcaaaagtttgccgcaaagacttatggtatcttagagtttgttagagataagagtcgtgtccaacatagacatattttgtaatctcgggtataaatagaccccgagccccatgtaatcaattaacacacgttcaatacaatctcggcgcatcaccaccttttactttcgttttgttttcaatgagttcttgcttttgggttgagctgcatcgggttcgatcttcaactataggtaaaacttgttatggcggcttgcgttctcgagattagtgcttccatctttatgacactctaatctcgtttatgtaagttgttgagttatcatatatcttatataatctctggcaatatcattatttaaccttctatcggctagcatatactcctagaagacagccgaataggttaaataccgatattgactttgattatataggatatttatcactctatgaagcttccaatggcttgattttctagatattgtctttcttttcatacttatggctgcatcagttaagtttgacctcataagtcgtgcttagaactataatct

SEQ ID NO: 75745 - DNA, 870 bp, Oryza sativa
cattaaaatggagaggtcaccttgtgtttatcctgacaccatattttaacaagaccacgccattgatatccattgacaccttttgggacatattttaatatatcgtttagagtcctcacatcaggattaaagtatcttccctttaaacggcttttgtaagatctccaccctttatcagctttcattagaatccagtctcttgtaagctgcttcgtctcagaagggtacacaaatttcatctttaccatgaataactaaaagttagatctgaaataagcatgataatatttgtttacattaattaaaaattcacctccacgtcagcgactatgctctcctttggtcccacaaataagtcatggtcccattttggaatgtccaatggtgcaaatgttgaattctgtgcaagcttaccaagatacgagcctagaacagaacctgatctatcatttggaataccatgttcatccgtctctacaattacctttccttgcttcagttggtccaagttttttacattaaaatttcctagaacccgtcgtacctccccatttggccctacatttaggaacagttcagctatgggtgataggaaaaatcatatatatagacatatataggaagaacagattatattaattggtcttttggctgcaagaggcaactccgtgattatgtcatcattctctgaaaggtcttgctcactatcttctgtgggttgtacattccctgcatcttgagcttcgagatgcaaattatcgtcattgaattgtgcatctgcttcatctagagcttcaaagttgtacagcaaattttcttcttcagcttgcacatgtcctgcgctctgtgcatctaggttcaacttccgta

SEQ ID NO: 75746 - DNA, 923 bp, Oryza sativa
tgattgcctgaaattaaggagagaaggcgatgtactaacctagatcgattcaatgcgcaacaaagaaacagcaagaagaatcagcagaggttaattgacccacctgtgtgcaaggaagaacggaggaacagcactgccgggcgccggcggcgggcagccgtcgtgtgcaaggaagaacggaggaacagcaccgccgggtgccggcggcgggcagccgtcgccagattgggttttccaattctgttacaggagagtactatggagatggagaggtttagggatgtggcgtggaaaagtaggtccgtgatatatatacagtaagctttccaaaaaaaaaatgccgccaaaaaaatcagcctaggcggcaaaacaaaatatatttaggaacggcagtcgatatatataccgcgaacgcttcgaaaaatatgccgccaaaagaaatccgccttaggcggcaaaacaggaacgctactactactactacacgtatctttacaaacatacgtgtagagaatctcaatacttgttgtggtctattggttaacaggtgtttttctgtgacatacatacattgttcgagctcaaaagttcgttgtatttttgctttttttactttgagctggatttgcatgactttgcttgagattttttttaaaaaaatagtaaataattttgtatgttcatctcagatatttttaaatatattcatgtcagattaacaatctgaaaatatatttttatttaatctgggtttgcatgactttgcttcagaattttttagtattaataaattaaagtccctgtccatctcagatgaataattccaaaatatattttctctaatctggatttgcataagttggcttgagattttttttggaattagcaaataatagtttgtattcggaattggtcaggggcgg

SEQ ID NO: 75747 - DNA, 21427 bp, Oryza sativa
ttcctaatctaacgtaagttttattcagtgtgttgaagagcggttacgaggattcataagcaatacaataagactttcaaaacaggtgtgatggcttaatttcatggatcttttccaaataaagaattctacttaagatactaattcattttgttctttcttttgtgtagagggttgatcttgaaaaatcaagacatcgaatttatcctttgtcttcagatgttcgtagtcacattttgagggtgaacagagaagctagagaacagtgggacaaaaagctggccgaagatgctgaaagaatcaggaaacagagtgatgttagttctgcatgctgtttcagctggaatttcagtatatcttttcacacgtagtataatacatagagactggctggcaggtggatcaaagatgtcaaaagttgtagcatgtaagggggttgacttaaatgtagatgtagcaatggcttgctattgtgcagcaaggtgctccagttcatttaatctccatcgtccatttgtgttctctctccttgtacaggttgctagagtgtatttgatttgatgtgataattagtcatccttcctttgcgtagtatgttgattggcataaattgggcctgagtttcacaatttagtactatgatttgtgcggtttgaatgaagatcatgtttttaaatgcagggagatgacaatgctgtggttgattcagagaaggacaagaatgagagtcgtagcacatcaaagcatgctaaggttagtgtctttcactactcaggcgatacttgcacagttgtataaacatagtatgctatagatattgatgattttcatgccttgcagacctataaggcggaagatgataaaacgagaacaacagctgcaaatgctgctgcacgagttgcagcaggcggagatgacatgctttcaaggtggcagttcatggctgaaaaaaagaagagcaaatgtgatggtgatggttcttctggttccatgccaggcaacatgttgcctcgtacgtcttcaccgaaacctggaaaaggttcaagagaacaacaggaaattgaaaagacaggttaattttcaatgcttggaccccgataaactgttgtatttttaccgttgtttattatatttgtagtaaccaatgtgcataagcgagtcagtcaattgaacaaaaccacttgatggttgagtgggatagttaatattttggttataagcatttagtaatgcatccatgcaaaaggttggtagatatctgtagttgtagaccctgagatttgtgtttggtgagttcttaagaggacaagatcaccttgtatccagttagtgtgaatgtttaatatgcgagtcattttctagtagaccaaagcctcatagagtagattacacaccacatgcattgtgacatgccttgtatttagacgtttgtccctaaagttttgtgcctctttcattaggtggtgttagaagatcatcacacgtaaaagtgacccggagcattacggtgaaggatgtgatcgcagcacttgagagggaacctcagatgttgaaatcctctttgctgttccagctatatgggagatcaccagcagaatcatctgcgaaatagttgcagtataaccattgcatttcgagttgcagtgttcaattttggttgtgctcttgggggcattgtattgagtagaatggttgatagaagatgagtctaataccaagcgatgggtttgattggttgataaatcatttttgcaggatttaacaatcactagtgaaccgacatcatcagccattttttttaacgagaatagtgtgcatatgtgttctttatctcatgaataatattgtaatcgcttcctatgtcaggcatgatataataaacagcatcaagctcattatgtagagctgatacctgattgtgtagttagctctttttttccactaagataattgaattactctcatgtattctgattcttttaacatgcaatgctggtatttcaaccgttggtgggactgggagaatgtacaatatgtacgttaattcgtgtcgctaggatttgcatcacctaaaaacacgactgcagtaaagcagcttgaaatttacatacatagtacctgtatcatgaatataagtaaaacttctctgaatacattctttgttcatgctgcctgggtacattaaccttccctctttagctctgcagctctgctgcatatgtgaactcacaacatacatgctagctttcctatttgtactactatattcttttccatttatcaacggacgacatgcattgctgtgctacttcaccaacatggagctcttaacatccaaagtcataaggaaccaaaccttgcagctctgggccgttgagcctgttgttgttctcaaagctgcagaataagatgagttagctgtcagtttatgtgaaaggtccagtggtaatgagggatacaaagggtgtgtttagttcaagccaaaattggaagtttggttgaaattggaacgatgtgatggaaaagttgaaagtttgtgtgtgtgggaaagttttgatgtgatggaaaaattggaagtttgaagaataagtttagaactaaactccgcgaaactagtagcaaaatagtgaccaaacttatttgactcaaaccattccaacaaacttaaccaatacaaatcacaaatgtcatgtcaatgggcaatgtaagaattaactgacatttgttttagtcaagcatcaaattcaacctaatgcatttcaatagtaaattaacttttaaggtataccttcgaagagggaaggttgagaagggaccgtcaacaggaatagttccacagaggtcattgttagacaagtcactacatttcacaagaacttagagcaatcagtattcagtaaccatagagagtcaaggaaataactaatttaaaataaatagttttatactcacatgactttcaggttggatagtttggccagctcccttggaattgatccagcaagcttgttattgttcaaccgcctgatatcacaaaccaaaagctttcagtggtagcatatgaaacactgtacaaatatgaataatgagttgaagcctacttccttagttcctgtttcttttgataaaagttactcctacttaaatgtgcattggtaacattatctaacaaaaaatgtgcattggtataagaaaaaactacttaaccatgcataaaaccaaatgaacagagatttgtggatttcatatcagttgaagaaattgtgatcacaagcgtcaggatatttggattcaccgatcatttatttgcactagacatgacatgacttcgtattaagcaagagctgtaatataatcaggtggtgatggtacatacatgaatctcagcgagccgagcttggaaagcgacttggggattgttccagtgagcttgttggcatacaaatccaagctgatcaaattcttgagattgcccaattcttttgggatctcaccgttaagattgttcctgtagagctccctgcaaatcaaaatttgatttttactgattaaatcatggtcatatatccctttctcgccatttgaacagaaaaaaacttgcacgtaatatgcccatacaggtattggaggttcacaagacggcctagctcagggccaatcgagccggagatgttggagtttcctaaatccctgaaacattaaccacaaataaaatagtcagaccattaaggatttagtgtgcgatccttctgaacacgcggattgctaccttctgaacacgatttttgctaccggagcagcaaaccaagaaattcgtgaacaagaagcaactcaattgaaagactaaattaaaggtcatttcttttgccagtccgcaaattataagttgacctgctattgcagaagagttggtgcgtcgagatcttgaaccaagtgttgatttttgacgagttcatcgaacaaatcaaaccagtaataactatacgtagctagcagcagatgatcacctaattgacttaatttagaatagacggaaactaagccccgaccattaatcacagcagcacgcacagttgacagattccaaattcgataagcaagagaagtggagaaccatcagcaatctttcgcacggtcggggaccaaacaatttgggcatcggagttggaaaatcttgaagaggcggcgggggggttcgggagggagaggaactcacaggcggacgacgcggctggcgtggtcgcaggtgacatggaaccaggtgcaggggttgacgagggtcgggtcccagctctgcagcacgccgttgggatccgacagcctcgtccgcagcgcgtacagcgcgtccccctcgtcgttggacgcccgcgccggcgcggcgagaagcaggaccacggccacggccacggcgccggcggcgagcagggacacgcggggcgccatccggccgcggatagtcgtaggtagaggctctggcagtcgggctggcctctcccgccggctatggctccggtgtgaaagggcgagaggaggaagaagactagtagaagagggtgaaggcccgctggtggtggtggtggtggtggctggtgggcggtggaaattttggaaaagtaggggattgcggtcaacacttcaactgcaaggtccacggtcaaacttggaccaggaacaaagaggatgcattttgcaaggctcacccagaggaggatttgtcgcccttggggaactgcgttcgaacgttacagatagtatgatccaatccactctgaatccgtctgatatggtatggacttttaaaaatccggttgatatggatgtggatgtagatagtatgatgcggatacggtatctataaaatccgaataggccgttttccagataattcgtaattatcaacacatgtaaccactctatctattgcatgtaacataagttggtccatccaatggcctaattcatcaattaacctagattttcttagtctaagtctttcaccgtgtcatgtcacacactcacacttgcgcagttgtatttttaaattatggacaacatgaaatgtattcatgttgtttaatgttgtttagcacttaagtatgtactccctccgtcccataatatagcaacctagaactggatgggacatttcatagtacaacgaatatggaaactttccgaaccgattctgcacaatttccggcatccgaaataatccgctccacatccgcatctggacactatctgcacccgctccgaatccacttgaaaatatggtttaggatatggtatgaccactatccgtctgaatccggtccgttttcacccctagtcacttagtttttcagcataaaaaatgagatagatcattattgtataattaattaagtattagttattgtacatttaaatttatttgatttattttaagaagcttctataatagttttgcaaaaaaaaatgtttagcaatttataaagcgtgttactgagaaacaagaaaattgtaattttgagttgaagattagaatggaacctaaatccttatacttaggaaatctattttatgctactgagtttattctggttcaacaatttaccattaacattgttttttttataatacaccgacaactttattaattattcttcaatacgtcattcaacttatctttttagaaaatacccaaaatacacttatggacataaaaggttaagattgatttatcttattagaagttttaaaaaatatgaaattttttaggtgacatccttatacattatggaagtttgtatataagtttcaagttttttcatttgtactttttttaaatatgtatatatataacctatatgttatatgctatgtaaaatacatttttgtgttatagtttttaatgtaaatcatctttcatatgctatataagatatttttgtgctactatcttttgtgtaagcaatttctctcttatataccccaaaaaatatttttttcaaaaaataaaaataccaaaaagaacttaaaacttatacacaaacttccatgttgtataagaaggccacataaatattttcatattattttagaatttctaatgagataaattatttgttaacattgtatgtctataagggttaagggtatttttgggtgtttcttttaaaaaaaaggtcagcccactggtatattgcaaaacaatcgacagtgtcaatggcaaatcgttgaactggaacaaacttagtacgaaccaagatgtcgagtgatgggttgggaaagatatattttcaggttataagcttggcttctgccgatagtgtacacaatcaataagtcgtaaggctcaagaactctctgaaatataacctttgccaactgggtattgggtaacatgagctggatattgtaattttctttttacacctatgatatgttgggttgatttatcttcataaccctacacatgactcaaggccaagggcaaagctagccgataatatcagcggggttagtttcattatatgccatagtaaaccttaatactagaaggtttttgtcggctaacctcaatgaaaagggctaactctaccatgacacaaatgaataatttctcaattatagtctattggaacatgtatgatcggatcaactcccctccctagcaagatgcctccagaagtggctctctctgccacaattctttccatgtatagcttagtactctctctcataaaaaaaccaacttctgtagaagttgatttttcatggagggtgtacataatttgagtggatgaatttatttttgaaaaacttttggattgatgaatttagatgtagagaaagggaaatgtgcagtcgatccgtggacagaacaatttgcggccagtgggtcccatagggccggcaagtgggtcccatggggcactcagtcgatttgccgtggtattggcgttctttgtccgggtgcatggtatggaccattacgtgggacccacacagaaaaattcaaagtcatcagctcgttttacatattccactccagataaaaacaaaatccttttagattctaacttttttcttccaacttctaattttttcgtcacatcaaatatttagacacatatatagagcatcaaatgtggataaaaaaaaactaattcacggtccgactgtaaatcacgagatgaatcttttgaacctaattacgtcatgattagccataagtgctacagtaacccacatgtgctaatgacggattaattaaactcaaaagattcgtctcgcagtttacagtcggaatctgtaatttgttttattattagtctatatttaatacttcaaatgtctgtctgtatacgtcaaaaaaaaatttaccaaatctttacagcatttaaacacggccttagtcccaaaatctcttgctcagtcgattttggttgtatgggacacatctaatactatgaatttggattcaactaaaatctcttaggagtatatttttggggtggagggagtattaggccattcatagtgcggtgaggtggcgttcgacctcagcttaccggcgcaggagattccgagccatgttagcgtggagcagtctccgccaaaaatgtggagctttatttgtccacccgaacctcgtcagaacttgtcatcagtaggaagccccatgacgcgcgaggagaggggcaaaaccgcgttggagaggctatgtcccaaaacgcgaagcaacggtcccctcatcatcattgtcatcgaggttgccctgccatcgcgtcaccattgaggctgtccctgccatggaggggttgcgggatgaccgtcgtcgtgccgctgctgtcgtcgagccgctcccgccacttcccaaggtcagatccggtgactttcaggctggatccggcgaaaccagctcggtcaagctatggagatagggagggagagaggtgccgccggtgggggagggagaggcgccggaggagggggaggcgcggcggctgaaaatggaggaaggaaagcgtgtggccagcggaggagttgcggtgatttgttgagctgagggagagatcccagagaaaaggaggaggtttaaatattttttttctagattttagggtgtttattgtaaattttggaccttcacataaattgaaaaaaaagactatgagaactgataaaaagtgtagtggctgaaatataaagtgaacaagattttagactcgtacgtctaggttaggtgacagctgaggctccacaaatacgtgggatacactcactgcgaatgcccttactgtgtgatgtacgtctccccgacacgcagaacgtgctgcgaagaaagagagcacgaaacgaaatatcagggcacctgccaaactaaagtacacacaacatgacttgacttgtgaaaggacataaaaaattttgcctttttatttatttatttatttatttatttatttgcaaaggagaacctattggttttgaatatgaatgaatttgctagttatgctttgtattattttccctcatgaccaaagtcaaccttttttacactaaatttcacgcatccctgagtatcgtgatctaagttgcacaaatcatatagattttgacccatgatatataatcctatgtattgtgaccataaaatttacaaaacaaaactattgattattttaactttattctactattcttttgagttctttccacaatgacatcctaaatttatgagttttttttatccatcatataaatgttacgtggaatctatgtgagtaaagatttttaaagttttgatataagagtatgtcaaattagttaatagagtggttttgagaaactttatgacaaattgacaataaaactagtgttatgtgtcacgtaccatttctacaactttatgacaataaaactattgttatgtgtcacaataggtgtgttttatgaaatgtagtctttttaaaaaaatatagattccaaacattcagtaactggtttccacctaataaaaatgtcttctttcttcaaaatatgctatgtttcttttctataatgcaggaatttcttttccacctaataactggtttctttacccctggctacctccgtaatgcaggaatttcttttcatccttaccttacctgaattaaagtaattgttttcttaaaataatcccgcaatggaattaatttcagcctttcaaagaagtccttcgttgtggttaaatattaaggttatatcaagtgggggacataaaaaagatttttcatggcactttcctttaactttttcaggcagactaaaaataatgccgctagtgaaagtcacgtttatttttactagcggataacataagcattcactagtgaaaatcacattatctttactggcaaacgacgacataagcatccgcaagtgaaaattgattttcactagcgggcgcttaagacgtttgttagtgaaaatcaattttacaaaaatatgtattcgtatctaacttttccataaaaagttggatgaaaataaaacttataccaaacttgtactatatctcaatgagatctacaacattttagtgaaaacttttccatttaagattatttagggttcaaaatattcattacaggattcaagatctgttttacaaaatttcagatatatgattcaaataacctccaatggacaaatgacatgtgtcaaactcttagagctctatgagatctataactttctatcatgactttttttatttggaagtcatttagagaggcaaataagtattttaattttgaacaatggaaatcaaaacaataacattctgaatatatagacatagacaacaagtgcttcattgtgagatgataatgtaacacatgtgtgtctgtgtggagagaatcttgtattcgaatccttcaaaaaaatcgcatacttgtgaatttaatccgaaagagtgtaaaaattgtcaattaggatttatagttgtgttatagatgcacggtaaaaatcaaaatatttttttatttttactttcccacctaaaaatcaaaatgaaattatggaaatcgattttcactaatggtcggatgccgctaacgaatatcattgattttcactgaacctttaattgcttgcggaatgtttggccgccaggaaaaatatggtttagtctccagaaaaaatgtgttttgtagtagtgggaaggcttatttccattatcgaaagaaatcaagtgtggttcaaaatttttgtacggagtaccccgacaggcacacaattgaacacgaacttacggttacttggttgttgtagtaacaatcctgttgtttgtcatgaccatcctacacgcatgcttatgagatgttgatgatcggcttaattgggaagatcatcaaacaatatttattaagagtgtgtgtgtgtgtgagtagggaaaataggagattatgaagatacgtaagataaagtaaatagtgtataatcaattaatataatttttgaagcactttttttataatttttttagaacaacatattatttagcagtttgagaaacgtgtagtccagaaaaaatcataattgtttgtttttttagaactataatttttttttgcttaatttgtctttctttggaatcccagctagctgaactgagtagtgaacagtcagttctctgaaggcatgcatatgttagagcatgagcaatgggtagcccctgggcataccctcactcacggccgtctggctccattgctttttaggccgcgttgtccccctacgagtaaacgcgaccctcggttgaaagacgcgtccctcggccacttttggctgagccacttcgccgggatccacgttgggcgcgtggtggctaggggtgtggcttgtggacacccctctcacctctagatttcccctttccacctctcggccaataagaagtagccgccgccgccaccgccgcccgagtaccgacgcctcctccgccggtgccgcgcccgtcactgccaccatctcctcgatgtggagcggccgacgccgctccatcatgatctgcccgcacagggctagatccacccacgacaacaccggatctaccgcctttggctagcgatggcgagaggcgaaggagccgccgctgccctggcctcgccggacattgtgctcgccgccgagggtgcggaagagagtggcgaagagagagagagagagaggagagagaggcgaccggcggcgatgacggatccgcgacggcaatgaacaaatccgcgcgccactctcgccgttgactgctcgccgatgaacatatctgtgacagccctcctcatcgccttcgcagctactagcgatgggagagagagggggagagagtgaggcgaccaatggcggcgcgtgaggagagagggagtcaggcggcgacgatgcgtgagcatggaggacgaggggcggcgaagaaaaagaggccggcgcaaagaaaaagagaagagagagggagaagagaggggtagcataggaaaatagccactatcggctttttgggttgggacatctattgtgggtttgagtaccttcacccaattgcttcaaattttgaaaagcccacctaggtgtagcctccaataggagatgagtactcctaagagtaccctcgattattgagggcactctatgtgtggctttgattgtagatgtccttagggcatgtacaatgtaagccactcctagagtgtcttcactaactgaagccgctctatgggacacccgtctcgtctcctaatgaaggacacaactaggtgggctctttaaaatatgaagcaactaggtagagagatactcagcccacaacgggtgtcctagcccacaaagccccatgcatatatttttactatcctacccctaatctctctctctctctcccccccacacctaatctctctttttttcgtcaccgcccctccttttctctttttcttcgcctctctcttcctcttgccgccgctaccgccgctcgcttctctctcccgtcatcggcggccgcgaggacgacggggagggccgctgttaacagtgaaaattgccagtgtgtgtttttcgcgtcaacagccgcctccctccctctctctcgtccccgctcccacccaccgccgtccgtctccgcactgacgacactctctccctttctcccgtcgccgcccgtcgcatcatgtcgtcgccgtcctccccagcctcctccacctcgcggtcgccggtcggaggtggcagaaccgatgctatcgtgggcagatctgcccccctcccccgcagccggatcgggatggagcggcgatgaccgcgctgcatcgaggagacaggggggcactcgcctttgacagtgatggcgccattgccttcttctctccctctcgccgccgtcgttcgcctctccctctccctctctctctctctccctctccctttccctctctctcccatcgctaatggtgattaggatttgcgccggtagtggcggcgcggcggatgaggacgaggagccgacgtctgctggctgtcggggtttcgaagcactagggcgagggtacaaggggaaattccggggtagctttgggcgccttggccacgagctccccacgcgctcaacacggcgcttagcttcaactccccacgaaaaagtaggctaggcgtggagagagccgcgtccacctgcgatgtgccgcgctcccctgctgggcgacgatgccgggtcaaaaagcaacggagctgaacggcgtgaatcggaggaacgacccagggacaccgattgtacatgctcttagaaccgcataatatttctggtagatcttttcatccttgggcgggccttggccattttgtattctcattcgtcacacgatgaacggctttatgcttaatttcctcatagacgtaagattattctattctaccgcaactgagttgcaagtcattcatatcatcatatgtatccatatcgcaagcaaattcaatgaactgggacaacgagaaaaaaaaagttaagtatgcgaatattacagctgctagctaaatgaacatacgatatggataaaaaatactctctccgtttcacaatataagtcattctagcatttcccatattcatattgatattaatgaatctagacatatatatctatctagattcattaatatcaatataaacgtagaaaatgctagaatgacttaaattgtgaaacgaaggaaatatattataatataacatagataaaatattgttattaaaaaatattaatatttgactatttcctaatactaaaaatatattgggctaatttatatagattttctagtgtcttacatagattttcctagtgtcttacatagattttcctctcggacgaagaacagtgtcacgtatgtctctatatataagccccatttgattcaaagaaaattcatataaattttagagaatttaattcctataggaactctttctacgtagtcctttggatcaaaggaatgaatcttacgaaatcccatgaaatccctatgaaatgcctcgttctatgtaagtttcgaaagaaatttaatataagatagaacctcatgggaaaaaaaatccttgaagtcttcatctcttctgcggcccaatcaaacggtcattcctgtaattttttctgtgttttacaattctctattttatacttgcatttctgtcaaaatcatatgttttttccattcctctattttttttctttaatttcccgtgattcaaatgggcctaagattacacctatccaaagttggtacaatagttcacacttgccactggatattgccctttggctaataatgcatgcacgatctgccagtgtagcaatatgtgtaattctagttttgtgaaagttacagcgactatagaaaggatacatcctcttttgtacaatttggaaaaggttggaattctgaacgcaccagtatctaactccccctggtgctctctgacgcagagatgctgtatactctctctgtcccaaaataataaatgtagttttagcactgttcatgttcaatatttgaccgttcgtcttaattgaaaattttttatgattactacttttattgttattagatgataaaacatgaatagtactttatgtgtgactaattttttaatattttttataaattttttaaataagacggatggtcaaaacaatgaacacagatatctatggctgcatttattttggaacaatgaacacggatatctatggctgtatttattttgggacggaggtagtatcaatcaagcatatttggttaacctaacccaacttttttatagctgacgatttgacccagcaatgtcgtttcacaactgcaaaaagatcatacatgcaaagaaattagcacttcttttgcctaatgcaaatagctaaatatatcttcatttcaagctgtacactcgtaggtctttttttatttgaaacacatatatattaaaagcaagaacataggttaggggataaatcccattacattgccagaagataaattaaagcaaagagccacccttttgaaaagggaggttaactctggactaaagaagtagacttcctaatgggactgagcagcagaaaaggagcaaatcgatagggagttggggcaataccgcgacgactgcttccttcctagagcctcataagacgtgcacaccgcttgacaaaccggtaatcctcatcggctgcctccacagaaacggcacaggacagaggtgtgatgctgagccgtagatattggtgtgagcttcaccggactcagcaaaggatctccacggagctcgtcattgaatctgaggaactctaacaataaccctgtcgactgaaatcgcgcaggtggtccgagctcaacccgaatgacaaactcagcatgttttctactaatcaggcaaaaaagagaagccagaaccaaagaccaatcaaccttcatcatgcaagagttgtagtggctgcaaagatcctcttgtcttgctgagacgacgaagttggctggggaagatgaaattgcatcaagagtctacaagagtccggcaagagcataaacccatccactgccgtctccagaactccaaacatgtcctcctccacaagggcacctagcaccagggccatcatcgacgaggtcaacaacagcaacagccagcgcaggtgagactgatgaaggggaactagaggaagaagtcaaggaggaggggccagcgaaggacacgagaagccaccgcagtcgactcaagggacagagcagcgacctcccggccaaagacagcgacgctgctgtcgacgccgccaccaggagccagctccaaccgacaatttgcccctagatctttggatctcgcacctccaccgccaccaatcatcatatcaccgcctccgaccactccgacacccatggagctcgccggcaaaagcacaaactagagacaaaccctaacaacaggaagaacctgacgacctaataacagacctaaccacacaatactagtagggggaggtggacggacctctcctccaaccctcgccggcggcaagccgccggaatcgaggaggaagaggggccggagagctggaggaagggggcggctactgtagaaagaggaaggggaaagaagactcgagaggacgcaccagcttaccccactcgtaggtcaacaaggcattcttcgtcagttaacatctgagtaatcatgtacaattgaatcatcagacaccacattcaccagctgcatgctagctactcatttactcattcgccatacccaaacaaagagcatagctctgatccagcattatttatcttgaggtacctataccaccgatctaaatccggccgttcatctatcgggggtaggatagggaacgaagcaacgcttggcatgctaagctcgcccacgatgctcctgtctatcgaattcatccccttctacggcagtggttgaagttgaatagtgtcgttatcatcccctcaaatggtgtcaggtgcaagggaaacggaggtgttgaatgctagggatggcggtaaagttgggtgcttgacgaggtggatgtggtggctccggatgagcgtggagatggaggtggcggcgccggcgccggtgcacggcaaggtgaacgcggtggcgcagaaggcatagcgggttgtgtcgtatttgggggatttggagttgatggcgaaccaaacaagagaacatggaaagccgttgccaccgcctattgtgaccacatccccctgccctttatttctgatggatcaacgacgggggcaaatgggcaatactgaattggccaagggaggcgggatgtagatcatggtgccggcatggaagaagacgctgctagccatgaaaatcgttgacaatcgtacgagagccaaccatgaaatcaaccgctcaaatcttcaccagcgtcgtgatgcatggatggaaggagcagcacactgggaaggaatccaatttactcttcggtttccggcccctcccaccgctccagcatcctactccactggcgaggctgccggcaagggcactgccatccgatggaggaaaaagaaaagaaagtgagaggagaaagagagataggtggtgtttcaaactcatgaaaatgaagattaagtgagcgaacgtaaaacaagaaagctattagcatataattaattaaatattaattattataatatgaaagttttcgtatgaaacacgttatttagtaaagcgtgcttactaccatgtaccaatttctcctaaccgttggatggaatggatcggattgcctagattgcaggtaccgagaaacctgaaggaccgtgaaaaaatctccctaactaaataagcataaggaataagcatgtatttccaagagacagcttgcagtttctcaaaaaaaaaaaaggcggcttgcagaaaaaaaatgtacaaattaattacaacaggtcgcaaattggtgtatgagcaaaacgcgtcattaagcagtgaatgttaaatgagaatatgcgtgaaatgagagcaagaaactaagttcaaagttactgaaaaaacctgctccctaaggtcaaaaggaaatattgctgtgaatgaacccctcgttctaccaaggagacagaaactaaacggctgaacaggaataactgaagggttcatcaagccatttctcgccttaacccctaaagaaacaatatgcccttctcaagtaaagggagaacaccatgggagtaaaaatacataaaatgcaaaatgaattcactcaagtcaggcacatgctcatgcaaattggcacagaattctcatgatcaggtagacaatcaatctggtttaacagcagacaatatcttagttggaaaccacatcactttcttatgtagagtaacataggacaggacgcatgatcagacggtagcaaacaacatgtaaggagctccatcagaagagagaaacctcaggactaatggcaactgacccaaacattaactttcaaatttttctggattccatgaccatgatacagcttgctggtacaatctttcatttcttgagatgggggaagcactggtacacatctgtctttggatgcttagcttctgcatgctcccggcatttcacttcagatgtggtgcacatgaatgtttgcatacacaccttgcactgcaatcatgaccatcaaaacaatcagtaaactagaaccagcttgcaacaacatgcaaatcattcatctgcacatagctattatgtttcgaaagctcaactatgaattcacaaattccaacaagcagtaatcaacaaggtaattgactagggccataagcaactacacttcagaaggaaaaccaatacacattcaagctcatagtactaacacacagaaggcatgatgcatcaaaatgagttactgaaggcctaaataactgtaaaccactggagccacacaggcgacccatttcatcgagtcacattcaatgccaagtgtgcatgatctgcatagcccaaggcaaattccacagatcaagaattatgaacagtgttatttgtcaaaatactttacagtttgttgtcgaaacgacaaccgcatacgtcgaaagacgtcgttactcaacagtggttggaaaagaaacgaagtgtattaaattttgaatttttcttgggatccccccattacatggccctaggggactatttatagccccattataggttcttactactagggtttaggttatacgggggaatttacatggttgcccttatgaaagggacgttcacagggttacataatgtcaagaggacttatgggcccttgatgggccgtcaggcgaccgccggccctatagcccctaagtttgatgggccgaaaaggcttcttcggcccttgcgggggcgaactggacatggcgaagccgtccttcttcgagctggatgccagggcgaactggacatggcgaagccgtccttcttcgctggatgccagggcgaactggctatggcgaagtcgtccttcttcggcaggtactcacgcgacccttcgcctcgcatcatccttggtttatagccttcgccacgggtttcggcaaatttggtcaaagggcctcatgccatccgagcccctcacaggcaagggtgagagtggagcttcggccgagaccgtgcaaaccatgtggtatgtatgtggcgccccctttcgaccgatgcttctgccgaaacctacactgttcctgcaaataaaatattcttatttgtaccgggccggaagggaacagtattgggccttttactgtgctgtttggatgatgagattttacctttacgcctacccttgcgctacgtggcgccttatgattggcgggtaggcgaaacgtcggcccggtgggctatatattcccacccctttctttttcaccgccgcactcgccatttttactgcatgcgctctcctctcccgttacttcctttcgctgtgtctcttgaactcgtaggtgctttgcctaccctcttgttccgccaccgcccacacacctttcgccatggcccctcgcaaaccaaaccctgttcaggcggttggaccggaccctggccgggtcgacgacaacacctcctttttgggggtctctcttatggacgacgaggagctggcgaagctggtcagctctggggcgttggttgaggggcaggctttcgccccagggaaagccgtggtgccgaaacctgcagagaatcggacggtggtttttgctgtctttttcgaggctgggctacggtttccatgcaacatgctgttgccggagatccttcgcctcttctaggtggaactcccacagttgagcccgtcggcgctggttctgatctcggtcttcgactgggcatgccggacttccgggttcgaacccagcgctaccctcttcggcgccatattctttgccgccgtgaactcgaagacgctggttactccggctggaacgaagaagacggtgttcgggagcgtgaactttaacgtttgcccctaggaagcgtagggctcctgcttcgtcggactctgatgctgatgacgaggaggatgccgaagaacatgacggcgaagaggaggaggggaagaagaggaggtggagatcgtggtcgagaaggccacgggcgaggcagtcgggggccgcgctgagactcccggctatacccccactccgagtcctggccataacgagaccggggtggagtcgaatagctccccccttcgccagaaagacttagagggggcgaaggccctggttgcattctcttcgggcacagcggcgaagggaggtcctgtaaaaaaggtggctaagaagaaaggactcatcgatgtcgctcgcgtttttagcgacgatgagtcctctgacgggactccgacttcgcccgctggccgcatcttggatctttcggccgcccctgttcctccactcggcgccgctagagcgggcggtagtaccgccgctgaggcttcggcctctgcagaaagaatcgtgacggccgcggcgaaagtattcggcagtcctccgcgtcagccggttgcatcgccgctgattgatgcgaagggaaagagagccgtcgttgagacgtccgcttcgaaatattcgctctcgttaccccgcttcgcccctggcgatttcgagacgcgggcggacccccttccttttgtggagggggtaagcaatcttgtactgcccgccagtgccccgagcttgttcaccgaactgaatgagttcgatgaggggtgctctgctataaaaagcctggctgttcgggtatgtttttcccccttttttttatttttactctccctctctttttttttacaactgacacttgttctcttcgccgctcctattttgcacccagatcctcgcggctcactgttcgatggagcgaaccgtgcgagcccgccttgacgggttcaaaagccgtcttcgggtcaaggatgatgaattaggccgcaaaaatttggagatggaggcccttgccaacacccttaaggaggtgaaggtcgaaaacaagcggctccaatcggaactggagaaagggaaggaagctagggccgaagtcgatcgcttaaaggccgatctggagaaagagaaggcccactccgccatgctcatagattattacaacctcaccgagccaaagatggaggctcttcggcaggaggttcacaaggccgaagcaagcgctgcggaggagtcacggcggttttcgcgggagatggtgaaaaccaccgagtccgggcggacagcgtgccaaacgcttcgcctcacccttactaatatgggcgcgaaagtgcggggtgtcccctctgaaggtgcctcagccttcgacttctccgaatggacccgacaggctggtggttcgatttcggactgcgccaccgcatacggcgactgctgtgcgcgcgtgtcagcggcctttaccatgggcctcctgcagcagttcggctacgagcacatcgccgagttccccaagtacgcgaaggaggattgggaaatcagcgcgcaagacatttcgcccgcacttcgtgcgtggcgaaaacaattctggcagaaggacggccgctccaccgctaaggcgcgccttttggagcagctggcgaaagcagaggcggcggacctttgtgaagaggaaggcgcggcggccggagggggtggaggcgatgcccaggaccacccagaggtgtgaggccctccgcccttctcttagattttcatagttttcttttggtgttcgctagatgtggcgaaccgttgtatattcggcaatctgccgctaacccttttgttgtaaccgaaacaggtggccgttgggcgttttttaaaatatgtataacagacctacttttcgccacttactgtcggtccaagtctttgacat

SEQ ID NO: 75748 - DNA, 7511 bp, Oryza sativa
tctgttataccgtaccaggtccgatatcctcaaaccttccttggggatcaagatgatccatggtttaaaagggaccccctgagagaggttcaggggatcgaattccatcgccaacacacccaccaaagttacgaagccggagtacgtggagccaactcgccgggagatctcgtcgaatccctcgactacgatctcgtctgtaccatctgttttgactactctctttgtaatttgttctcgtcagcatcaatctcatataaactggactagggttattacctgataaggggcctgaaccagtataatccttgtcttttatctgcttgatgtcgtactacatagaccctcattccaatgtaccccaatactctacttatccggtccgcgagtatcactcgtcgacagtggcgcgctaggtagggagacttggtgctcaaggatataccggtatgacttcaagactttccgacaacagtaccaacaccggcgtcgatcaaggagcctctacctcgacatcgctggtattgactcaagtcggatctatcgtctttccggtctataccgttacaccgatctcgactggaccaatcactatcgggaacgagaaaggcacggttaagactccgagaaacgatgccccgccgacaattcctcccacccaagtggagaacggaacatcgacggtcccaacacctgggaggaatcctcaagcggccgaattttgtcctttgtacaaaaaatcagagccgacaatgactaccaccctaaagctgagaccttggtttcctgtgcataagacatccaaacatattctcgaggactgcccggtgatactccacgtgaaagctgaactctacgcctgctgggagcgtgagattcagcgcacttcaccgacaagaatcacctactgcccaattcacaaatctaggtctcacgacatcacaagctgcaggattttcctcagaactctgaaaccaccgcatcatcgcgtccaacaatcgcgagttcaaactccgtgtgttgccaaggagcgagatgcagtgatgacatcaaatcggttcgtaggatatgttggtactaatccaaatgagccatctgtgctacacctcctagaagactacgaatcctcctcggagttgccatgagatgtaaacgtggtcgacaacactgaaacaagtgcgtccgcagcagtgagaatgcccgctcaacagttgcgaaacctggatgcgatattgagtgaaagtccttttgatccggtcacaaaccccgacgtcaaccaatgggcgacgcgactgtgggagaccgtgactaacctcaacgccgcatttgccgaagcagcggtcaacccggaacaacatgaggatgaagggccaactgcaggagatgcggacggagaaaatcccaacggaacgcgtccctccggtgaccagtcacctcgagagagacgagaccctactccaccgcgtcccgagaactgtgatcttcgcgatcacttagacaaccggtggagggacagaagagatcgtgacaacaatgatcgccatcgacatcgctctccttcacaccgcggggataacgctgctgcccgacgacatcgtcaccgcactcctccacgacagagaagggacgatggtcggggaggtgcacctaatgaagatcgggaccgacgggcccacagcggtcgccgcggcgacgccaataacgacttccagcgagaccaagcagctaatcgtcgagatcaggagcggaacggcggcaaccgacgagatcggaattcccagtctcattctcccggtcgaggtcgaggacgagatcatcgttcgagaagctaggctcctcaaccaagcgaccccttgtcctcgtcatcatcctcgtcagaccagcttccccgatgacatcagcatcgcgggctaccttttgctccagggggtggatgcagggcattcacgcccgaactctgagatgtacggtggcccgagaaattccgactgggagcaatagagaaatacgatggaagtacacacctagaagaatttctgcaagtctactctacgattctctatgccactggtgcagatgatgttaacgaccaaatttggtaatttcagtatcggagatgaaaataaaaccgaagcggaatccaagaggtagatcgttccggaaacagagcaagattcggctgaagtccaaatctgctacgaccaaagtcggcagagttcgagtcggacaaggtagtcgattcagctgaatccgacaatgtgactcagtatacgtcatcgggctgagttaatgtgcttcatatggattgccacacacggattcggtcctgaaacgacaattgtatctattaattaggatattctatgtaatttcctaagagataagtttgggcaaaagtctgccgcaaagacttatggtatcttagagtttgttagagataagagtcgtgtccaacatagacatattttgtaatctcaggtataaatagaccccgagccccatgtaatcaattaacgcacgttcaatacaatctaggcgcatcgccaccttttacttttgttttgttttcaacgagttcttgctttcgggttgagctgcattgggtttcgatcttcaactagaggtaaaacttgttatggcggcttgcgttctcgagattagtgcttccatctttatgacactctaatctggtttatgtaagttgtcgagttatcatatatcttatataatctttggcaatatcgttatttaaccttctatcggctagcatctagtcctagaagacagccgaataggttaaataccgatattgacttagattatataggatatttaccactatatgaagcttccaatggcttgattgtctagatattgtctttcttttcatacttatggctgcatcagttaagtttgacctcataagtcgtgcttagaactataatctctagcctgcgtcttggttgttgattagggtagtatcagggtttcagccgatcttacctgatttagctttatgttttatatgcttaattgtcatgctagatccgccctttacgttaagattctattgcatttaggtgtattaagcttcctgtttgatatattttacttgctttaatatcttaatatagagtggtatcggagtattagccggtacacgctagatctatctgatcagctatgctgtaaacgtctataatctcattgttaatatatattgcgatctaagtgatttatactgtctcgacatggtgaccgatctatcccaatcacttgatttaagtatatatcgacataaagattatatactgttaatatctacagccgatcgagcagatttagttttaatttacttattaacaactgccgatcgattaacatatgacattggctcaaatataaatgatatgtcatcggcgactggccgatcggctatcgtttatggatttaacggcggtttctttgtctattatttcttgttgattgtaggatcaaatcaactggcacgctcatgaacctaaaaggcaagattttggacctgcactggagttaagcagatctcccaggcctcgtgtttttagcatcaacagatgataacgcgctagcaaactacataccagctgcgttgaagggatctgctcgatcatggctagtccatctcctgccacgctcgatctcatcatgggaagtcttgtggcaacagttcgttgccaacttccagggaacctacaaatgccacacaatcgaggacgaccttcacgctctaactcagaacccaggcgaatcattgagggactatattcagcgcttcaacgtgcgcaggaatacaatccccgagatcaccgatgcttctattatccgtgcgttcaagtcaggtctccgagatcgatacaccacccaagagctggcaacacgacgagtcacctctgcttgaaaactgttcgagatcatcgacagatgcgcccatgcagatgatgcattaacaagcaaagacggaaaaagcaagacgggtgaggagaagagatcaagcaacaaggacgcaccagagtcaagcaaaaagagaagtcataaaagtgggaagcgcaaaccctcgggagaagtcctcgccgctgagcaaatggacccacctaggcgccccaatccccagaacgatgactcacacaagcaatggtgcccaatacacaagaccaacaaccacgccatggagaactgtctcatcttcaagaaggagctcgcgagacaactggcgattgagagagggaagcgagttcgtgttgttgagacagctgaggaagccgctaccctcaattccgactttgccttcccagaatatgacctccatgtctcccacatcttcggcggctctacatcgtacagcttgaaaagggagtacaaaaaggtggaacgtgaagtctgctccacttcgcaagcgactacctccaagatgaagtggtcccagcacaagattgagggcctgtttggttcgctgccgttggtatccagccaggttgtggcgctgccacagttctgtggcgaaggaaaagctcgccgcacttgtggcgaaaactatcacagaaatgaactgtaacgttgtgtggctggctcaacttacgtgggaaccaaacaatagcctgttttgcgtggctgccgcattcaaggtgtggcgaattctggcggggaaccaaacagcccctgagttctcggaggcagatcaccccaagatcgcgactacgcctggcagatatccgatcgtggctgaacccaccattcggaacatcaaggtggctagagtcctcatcgatggcgggagctcaatcaacctactttttgccagcactttagaggcgatagagatacgtcgaagcgagctgacacctacagatcagcccttccatggaattaccccagaatcgtcatctaaacctgtaggcaacatcacgctacccgtcacttttgggcaggccaataacttccgaacatagcaaatcacctttgatgtcgcggagtttgacaccgcatacaatgccatcattgggagaactggactcgctaagtttatggcagcatctcactacgcttatcaggtactcaaaatgccaggaccaaaagggacaatcaccatccagggcaacgctaagttggcagtacagtgtgacaagcggagcctcgacatcgagcatactctcaacccacccgccacaactgagcagcccaagaaagtgagcaagcccagcaaaaaggcaaagccagacggtgctatcaagataatcccgttgtctagctccaaccccgacaagacggtcaggataggggctacgctgatgacaaataggaactcgcgctcatcaccttcctctgcgacaatgcagacgtattcgcttggcaaccgtcagacatgccgagaaatcctagagaggtgattgagcacaaattgatggtgcgacccgatggcaagccagttaaacaaaaactacagagattcgcacccgagcgaaaacaagccatacgagaagaattcgacaaacttctcaaagctggcttcatcagggaagtcctccaccccgagtggctcgctaacccagtaatggtacgcaggtgtcacgaccggaaataacccaacgggtgttcctgacgtgcgtgcattaatccttgtcccaggaggcaaggtacaccaaaagttgatacaattcagagtttaacaagcggaagcgtaaatagaattattacatgggcaacgaaggcccagcacactcaaagacaacgaaaaacagcggaagactagggcgacgaccacaggcgcttgacggcaggcacgagctagacaccaaagccttcatcttccaggaactcctcatctgggcttgggaaaatttagcaagactgagtacaaccaccgtactcaacaagacacacccacaaatgcagaataaatgcaagggagtacaaaggaattataacatagaggggttagggttgcagtaaacagcatttaaagacatttagttgctcagggctagttgtaaacacgatcctagaactaaacaatgttattaatcaaggccgtgaacccgcacgaacctgccttaacccaaggcctatgatgattcagaccgaactggcaacccgaccctgggtcccagctcgtcctaagccaacccaggccaaccattccatattttagttgttaagcaggttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcaggcaagactgagcccctagcagtagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttaaacggccgaggtgctactatcaaaaccatgcaccccgagcccagcctaaaaccattttaggggattttgaatagagggggcggtgtgaagccaattccacaataaaccaacaattccatagtgtccaggtgatatgaatatttcccaaggtctatagttgtaaaaccacctaatgttacctaattaaagcaaagcatctacctaaaatcatactagtgataccacgagtagagtgtccactagttggggttttgtttgatctagggtgaacaaggtaataatagcaataacaataataataaggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaagcaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaaaaactatttattgcgtcagccgagggagccgggcgcgcggaccgggtccacgggaagtggggcccacgcgtcagccgctcggtccacggtggacc

SEQ ID NO: 75749 - DNA, 8418 bp, Oryza sativa
ccccacaccaatattacaacttcatcattcatcaatattcataatcacaatattcacaatctcaattcataaatgcccattttaaccggattcctaagtttgtaaagatgtttgaataataaaccacataaaatgatctcaaatatgtctttcaataatattatgtaatcatgcttaaaagcatttaacatctacccacgagatgttaaaagagtaagacatcatgcatcaaaatttaatatgaagattatatcaagttttctatatgatcaaaattttagttatgtcttgccttgcgccttaagattttccgcggcttcagcgtagccatctgggtccacgtcagctccttagattcgatagtcgaactagttgtacgatctaacttacggatatgaaaagatagcaaataaagcctataagcaaattgctacaaagaaacgatagaaccaaggaacaaataaaattggagctaggcgagaggagaaatgaatggttcaaaataaattttgatttaaaaataaaataaaagagaggtgatggtttctataggttggaaattgaataaaatcgaagaaaggataattttggataggtggggtttatttggtggattcggtttctagtcggtgctagagtaaagtagcacaatggctagatatttggattggttagccgatgctaaggatggacagcataacggctaaatatcggctcgtatagtcgatgctacaattaagcagcacaacgactagggagttgagagattggtgcaggtttacggaatagtgatactctacaatcgtgagtgatagcagagcggttaggattgcacagagccaaaagctagggtgcggcgtgctgtggaggtcgagggagtagtgaggctccgaccattgtatgcgtcgaagcgtagggtgcgaagagcaacacttcgaccttgggattaggttatgccgaggtttatgaccaacggtttgacgctggggattatgaccacgcgaacgtctccacagaaggtgtaaagtttccacgacggctgtttagtggctatgggatgaaatagttgaaggttttagaaataaaaggggataaataaatcaaagaaatttaaattcaaaagggggttttaaaatagattaaagaaataaaatttaaaatgatattttaaaagaaataaagaaaaggtaattaaataaataaagagaagatatttaaagaaatcaaatggataatttaatatttaaaggaatcaaaaggataaactaattcgaaaaggctttttaagtaaaacaagaaatttaaaattaaagggatttaagataaatcaaataggtttaaattaaaaaggtatttaaataaagaaatttaaataaaattttaaaataggaaatttggtatcaaaataaagggtttgaaattggatgaatttagatcaaagaatttctggaattggatttgtggtttggaatatatgggctcctagagattgaaaaacaattaaatgaaaaaggaagttactattcagtggggcccacttgtcagggtcttcttcttcctctatttcttcttcttcttctctcctcccgtcttcttcacaggcacagagaggagagggaccggggcgcggcaagggggcgcgtggaggagggagatggcttcggtggccgggctcgacggcgacggcggccgaaggcggcactaggagtggaaaggcgaccggtggtgtagggcaaagggattggcagctgggtgaggaggatgttgggaagagagagagagtttggggctcgggtttggatggggaaaatggaggagttcgccggtttatataggcagaggaggtgggttgtgggagagagattgaggggttgtttggttcttaactaacattgccataactcactttaggcactgttaggcaagtttgccacactttttgtggcctacaaattgtaagccacacttgtggcaaagttaggcaaagaattaagtctatgacatgtgaggtaagatggtaagaaagtgtggcttgccataactatggcaatgaaccaaacacaaggctaaggaggtgtggcaagttgaagtaatgaaccaaacagccctgaatacggcacggctcggcgtcgaatggaataaaaatggcggcgccgggtgtcgagctccgattggcgacaaaggggcggctcggtagtcggcgtcggcttgcggtggcgcgtggctagtgatgcggcgcggcgttgtgcggcggcggtgaagacggtgggcgacggcggctgagcagcggcggccgcggaatggcgctggcagcggtggctgtgggggagacatgaggtgcccccggtttcggtaaggtggcgacgtggcggcagcgggtggctgggcgggcgcaaaacggcagcggcatcgggaattggcgagacggcgacggcgccgtggttgtagacggcggcggcggcacgtccacagctaggaaaggaaggaaggaagggaaacagactttcctgattgggctaaaagagggaacttcggcccaaattaaacagtagcctttaggaattttacaaggagggttttaaaagattttattggagataaaatttaaaagagaaaagtttggggtcctttgaactttataaaaataatttaaatataaagtttttaaagcaaaaaggagtttgaaaaattttaaaataaaatcaaagatatttatttttgatatatagattttaaaaaggacaaaaataaagatgctccaattttaaaagaattcaataagaaccaaaagtaaaaccttcgcaaaagattttctctaatattttaaaatagtaaaatgagaaggaaaggaaatacaaataatttaatttctaactttggataaatttttgggatagtggcaatatagatgaaagggataaataggactttagcccccaatatatgtggtacgggtttctggtgatttattggtgtgctaaaggaaattcggaatttttaaatggaagggattgtaaataggtttcttagcacaagagcaatcattctaggaatatattattctttgtgccaaggatatgatcaagtcataagaatcaaattggtggatggatcaaaataggaacttgatcacaggataatttggatcgattaaaaggaaataaagttttttggggataggtttagatagaggtctgatccaaaataaattacaacaaaaggagagttatattggtttaaccccaaggataaaaatggttaatgggatataacaaagagtcgggtcaatcgggaaaatattggcccaagtagactgtggaatcttgaatggataatttggaggaacgagatttcaagggaatatatttgtgggagtatagatttggactcggaagtatatgtggatgggaatttctacaggaataggattggtggtagattgataaattctaaaggttgggtatgttgactcaaagggggattgaaaaggatattttatggactctgggaatatttaggtggggatccaaaggaaaggtatcgacatttcatgtactctagagatatttgggtagagttcaaagagagagtattaactttgaggaaaatggaaattgtactctagggaggttagaggatgacatttcatgtattctggaggtagttgagtggagatcaaaaggaaagtattggttttggggaaaaataagaattggtatttcatgtgtttgggtagagatcaaaggggaagtatttgatgcaagataaaactggatttggaggtagtgttgtaagctctagatgaaaaggtattaactctagagagattgatatttcatgtgctctagagatggttgaacgggaattgaaagggtatttgttggagatgttcgggaatagattcaaaggataatttagagccaaagttagagattaaagaaaataaacagagaggttttgtaaaatttaaaaagagcgattaactttgcaattaaagtttaagtccagaataaaagaaaatattaaaagcaagatcactctaatgcaagaatcgagaagagcatgacttaaaataattcgcaaaaatttttcctgaaattttgagtccgttacactttccgagacatcagactatctgatgttaaatcggagtatccaatattttagaagaaaaacttcgtcctcaaacagagactcaagttccatgaaatttcggagtctctgtgtcatcggactatctaatccggcatctcatactccgatacttagaaaaactcactcgataggattttttcaaatcaagatagagagtgaagttctgtgaaaaatcagatagtccgatacatcggatagcctgatttcaaatcggatagtctgatgttgctcaagtaaaaatgctataactttttactccaaactccgatttcaaagatcttggactctatagaaagctagttttgtgggctatcaaacccaacataaaacatggtccaaaatcttcaagagattttaaaaaaattgcaaagaaacccggtgtaagtgttgtgacaagtgaaacaactcaggatttaaattttggcttaggtttttcaactcacacaaagatgaagcattttgagcactagtattcaaccaattatatgcatgtggtatccccttaatagtacggcatcctaaactcaaatgtaaaaggaaagttataccaataggaataccttcacaccaatttatttcttcacttggaggattaccaatgtcaaggtcatttgatcatcgggaagatctcatcttcttgatctttggcatttcatctttcatttctcaaatgattgatgcagataattcatatcttcaaatggcctcgcacggttcatcacgacacagtcttcactcgcccttcaccaccggtttcggttcgtcggcgccaagccccttgcttgcccttcaccaccgcatggtccatcgcagctgagcagcgcttgcgcttcaccgtgttgccataggtagtcacttcatacccacatcttcaatatcttctctttaattctcatccatcgataagtccatttcctagcttcttcatcggactaatcacttgcttatacacttaataagtgcattagtcccttaatcgtttgtcatcaataaacaaaaacccactaggagcatagatgctctttcagttacatatatattttataaaaactaagaattgctaatctaattgtataattcaaatatgtttcataaaacaataattgcaaaaaagaagtacatgtaattcttgtgatgctcgtgactttcattgagttcgggtagaatcatcgagagtttccacagtattcggtgcatcgtactaccgtactctcagggttatttgctcagtgaattatagtcgaaaatacccattgttgctcatagttcttgttctatgagtgatagcgtgcaccataataatcaaaaactgcttccttgtgccaccaaaagagtgttaattcgtgcatccacttagcatactctttcattagagtagcttggaggtaccaacgagagatagaaatgcttgctcaatcacatcgagttagtgattagaacactgatttgacggtgtcatggagcttctaggtccattataatttctacattgaatgtatatgtcagatatactctagatttagcaaacttctagttcacgatgtcagtcatctttaattaaaattcccgcaaataattccaatatattttatgcaattctatatattttaccgcaaagatattaattaaaaataataaaagcattacaaataataaataatcataaatgtgataaataaatttcataatcataaataacagaaatataatttcagtggattttgcaaatttacaatgccattcaaacaaatattccaaatacatagggtgatttgtgtattttctagaaatttcagggtttaaaatgcaaagtttccaatgcagaggaatatgcgattaattttcggaaaccacaggggcctttttgcaaatcctctagagattctttctttaccttcttttctttccttctcgcttgtctttccttttctttccccttcctcccctgatggcgccggcgggtgtactggccgatcaggcggccggtggcggcgcggcgggtgcagagactagtgaggcactgcggccagccgtgggcgtcgcggccgggcgacggcgaggacaaggtcgtgcggcggctcggtgcgatgcggaggttggcatggcatggtggggctatgcggcagcgcggggctcggtcgtgcggcggccaggggtcacctcccccctcctctccacctgtctcttgtcactgcctccacaggttcaaagattaggctatttttagggaatttttggatttgctttttatcttgagttcttgtttttcccttgttttgttatgcatccgatttgattgtattgaagctgtgaaacactgattttaaaaggtgcttgtgtaaggttggattcttatgctgattcttttgttatgacttggtttccattgtccgattctgaggatgcaaagtaacgattaggtggagcgactggtgcaacccctaacgggtgaacgcgaaagtgacaaacaaaaaatggacggtgacggttggaaaattacgaatcttttaattagttaagattaggatatttaaattacatttaataacgaaacaagttataataaatggtacgtacataatttttcagattaagacaaatcgttaagaattatgatattctttaaacctaatttatactaatttaaataattccgtatatttaaactatagaattagtaattcattataaggatcattaagatacttaccaaggcctccttcaggatgtgagtgtaggatcgaatataagaaccaaccctaccagagagatgaatggtaggaacaccaaagcacagtattagatctttttatggagaaataattccaatcttttttggaattaaaatattaccctaaacttgacgaagttgcgccgatcacactattagatcgctgttggtttgaccgcagtactctcgccggtctgactccctgcacatcgccgatctgaccgccaattggaccacctccatgtcaccagttagaccgcataaaaactccggtaaaaccaactctcttccggagtttgctaggtcagaccgatcacacccctacagtctgactggcctcccagtccgatcacgcatcgtagtctgaaatcactactcatcgtattttcaaataaacacccacctttaacaattgtatattaaatcaacatcttgattctacagtgggattagaggaattttaagaaaattgaactaattcaaatgaaaatccttgctataaaattcatgcgttcaaggaggcataaactaaagataccctcgtcaacgtggtctggccattgtactcatgttcaaaggaggaaatttaactatttgccactcttatgacatggcaattaacgatttgccacaccctatcaatgacacgtaggtcctcatgtgtctatgacatatgggtctagtggaaaatcattaagcaccattcgtaagagtggcaaatagttaaaagccccgttaaaaggagcttgtgtactagctaatggttacacttaaaaaaaaaattggctcgcaggattggtaagcccatgcggtacattatctttacgaaacggatagctctacaaacaacaaaactatcagctatgatctattgtttccacaacgtccaagttacaaaccaaacacccctaaacagggtaaatcgatgaaaccataaaaatgaaaccataaaaacaggtaaatcgtgactgtgcgcgggcatcacatacaagataaaacattctccactgctagacaacaaaattacatggctctagccagtatctcaggagaaatattacattttgtcttctcttgttcacacgaatcacaaaattacacccaatcttaagatgtgcacaaaggaaggtatgatgaagtcagtaagtaaagaggtgcctctaagaacaaagagaaagaaaaaggagcagctacaaggcgtatttcccagggtattgcgtgcttgcactctttaatgttcaaaccgcttgatcgaacaagcaggcataaaatctgcagctcatgtttttatgcgcacaacaaaagaacctgcaatatttcacataatagtcatagctgcaaaaggcagagggaatttatggtacaaaactacaaatggagaaatgtgttataattctcaaaactgcaatcatcaacgaatagtttaacctagagtcatgtactccctccattccatactactataagacattttagttttgttataagtcaaacttctcaaaccttgaccaagtttatagaaaaatatgggc

SEQ ID NO: 75750 - DNA, 792 bp, Oryza sativa
  unsure (1)..(792): unsure at all n locations
cggctgcntatgtatgctggtgcaccgcccggcggncgatcttaactagtggatcccccatcaagcatatagccactagctcaaaaccctatacaggtctggtggtatcggattccgtaggaattactctcatctgctatggggcccatcagctcatccgattctttatatgaatatctcgacacttgcaagatcaaacccaagcccgcatctcatcaaccttaagacctacatcggagctaataaaatcgcccaggacgtcgagttcgtcgacttagttcgcgccaccacagttcctgtaccatgggccaaacgcggatacctcgtcatactgtgtcttactccacaaacagggacctgcatgtgctgactactacagaactgtcatgacaagggtgagcctagtaaacatggttgcggagatcatggtccagcctctatattatcctgcccatcatcacgtaagcggccctataacacgcatgcttgaaggggccacctattgctatcaccaccatcgcctgtagaacggtatgaatgttttaaacctccaagtgaacctatcctgccaactcgacatacgtccgactggtagaactactactgatgccgtaccggaagaaaggtgatgacctatagtctctaatctagtccatgcagcttaaaatagatcgactgttgggtgttgacgacaagaaaatacccttactctcctcacactgatgaatctagcagttaaaggcaaaccaatgatgtagacctccaagaacaatttattcttgagtcgaagac

SEQ ID NO: 75751 - DNA, 6965 bp, Oryza sativa
atacacatgatcacatatccgcatctttcaaacgaatcctcatggaacttgtctgtattacacatttctcccttattacatgaatgcaaggccttgccttaaacaaaaagggaaggtgcttaacatcagtacattgcatcctcaacatgaatcttccataaacataacaaactcattgtttataatcatgaatgtatttatttattacatgattgctgcaaactcccgattacacaatgataagtagcgaactgaaaaccacaaacgtggctgctcattttgattctggagagatatagctggcattgttctagtgactgcatcatccttgattggttctgtgatgatgtgttaggactgcatattgctataattcacaggagaagcttccttctgattgctatttgaagcagagaacgatcttctgcttggtatcgccctcctgagattgattgcccttcgcttgacctggagtaggtcggggagagaaacaacttcttccatcgacgacaattcattgctgaggctgtcggtgccgagaatggttggtgctgaaggtattatcgctatgatttactgcagaatcaggtgcagcaagaggagcattggtgttgtggatgatatcgtcgatgttgctgttggagctgactagctgatgagacaatcgtagagttgttcgttggatttctgcggtcttggtcaacaacacactgagttggcaatccttgggcacatggtttgtaccttcgcacagaaaacatatgaccttgcgggtgggacactcccctggtggatggtcttcttcgcaataagcgcagagtgtgagacacatgctagcaatgtgtccaatttctccacaacgggtgcatgcctttgattccatctcttcctcgccgagatgtcggggagactcatcttcatcatccgaggagacttgatctgacccttcactatcagatactctgccaccatggcttagaaggtgctgggtcaactgtcgtgcacctcggaaagtatttcctttctgacgtctaggaatagttatccctgctggaggccattcggtgctggtaatagtcatcttacgtacttcttcttcagttcgcatcggtgcttttctcttctgattcttactcttcttgcctttggcttgcttagtatgcgaccccacgtggtacgagaggctagggggaaagcatttcccgggattcaatgggttctctccgttgagctctctactttgcacactaggctgcaagcttgacttggtgtgaggaggctggtttagcgatgcctgccctgttaaaccaaaggaaggggcttctttggcatatacccatggacaattcagggcatagtgtccttgctctctacaatcatgacaaaaggggacatcctctcctggcattggaagctcattgacctgggtggcaaatgctcgatcaaacacatactgattttggtcttgacttccaaccaatggtagctgtgaactaagcagcgtgcttggaatggaccaagggtgtgcccttgttaactctcttgaggccagtggtggattgagttgaaaacttgagttacttggggcatacccgctgacattctttcctttttctctgttaaacatctgttacagggattgaggtgagagaggaaacaagccaggaaagaatagaccagaactagggacaggaccttaaaggaactaactcttcttgctgatgtgttgtttgtttcacttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcgctcctgcttcacagctggcttcactgcttccttcgcttcgctagcggatcctgcagtcttccggagcttcggcaaacaactgacgatgtcttcttcttcgcaaagctgaccatctagtactagttgaaaatccgaagaaggaagaacggagtaaaccttttgcaaatagcattaggggaaggagaaaaaggaactttcgcaaataattttattcataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgacaatatttacattattacaaaggcgcttcaggcctggcaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagacacacccacaaatgcagaataaatgcaagggagtacaagggaataataatatagggattaagttttgcagtaaacagcatttaaaagtcacttagttgcccaaagctattttgtaaagacgatcctagagctatacaatattattaatcaaggccgtgaaccctcacgaacctgccttaacccaaggcctacgatgattcggaccgaactggcaacctgacctgggttccagctcgtcccaagccaacccaggccaaccattccatattttagttgttgagcaaattttaagaattaaaacactgacttgggtacattgctaggcttgcccatatccgagggctcggctattcgaatagattatactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccaaagtgtccaaatgatatgagaattcccaaagtctaaagttataaaaccacctaatgttgtcctatttaatcagcgaagcatctacctaaattcatactagtggaaccaggaatagagtacccactagttggggttttgtttattctagggtgaacaaggaaataataacaataacaataataataaggtcataacaaaggtaaataggtatggctagataaaacagtgataacgcgggaatttaaataaagcgataatgcattaatttaaatcaaaataattttataaactgggattcaatatgctcaaggatgatgtgacttgccttgctcgctttcccaaacgccggcttcaacttccacgaagagcggatcttccgaagctgcagcgtctacacgaccaacggaaaagaaaaggcttttactctaataaactccaaacaacaagcaggaacaaagcacaaaaatgggttctttacttcttaaggaaaaattagagacttgaacggtccaattccgagttcaaatggccaagatatggccatttgaagtttatatgctctttaaatggatatttacgaatttcttcatttaaattttaattaaaaaaacctatttattgcgtcagccgagggagcgggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcacccgagggcggcctcgccggcgcggccgacgggagtggcgcgcacccgcgccccgatggtcgccgccggcgaccaccggcgcggcggagcggcgcccgagagagaggagggaagggggaaacgaaggggacggtccacggctcaccccgggacaacgacgacgacgaaaacggcggccggagcggaggaagacggcggcgcggttcgggatgacgatgacgacggtgctccggcggtcggcgggcgaagcggaggcgcggacggagtcggcaaccactcggcgaagcggacggaggggtcgccgagtcggaaggaggaccggagcgacgtcggcggcgaaccgaaggtcgacggcgacggcggagagagaggagcacggcgcgagcacgaaaccgacggcgagagcgagcggcgagcggcggaaacggaagagcgaagcacggggatcgaatatatagcaacgggagggggagagcgcggccggggagagaggaaaccgcgcgcggagatctcgggcgccattgaagacgccggcgaacttcgcgggatgaatccggacgaatccgagggagagagagagggaaaagagggggaatcgggagagggaaacgcggggagtaattcccccctcattaaggcgcgcggggaaggcgggatgcggcggattcagcggcggcggcggcgctagggcacgggcgggcggcgggagcggcgggaggaaggcgatgacaggtgggccccacccgtcagcgagagtggcgggcgggcccgcctgtcagcggcgcgcgcgcgcgcggggagccgatgggccgcgggagaggagagagagagagggagagggagaagtgggccgagccggcccaagagggaagggggggaaaaagaacttcttttaagattttctttttataaacctttttaactttgtttatttcttctcaattattatttgtgctctgaaaattccactaaaatttgagggctccttttagaccaaggagaatttaacaaaaattctccgggccacatttgaatttttcttgtacgtattttagggtttgccaattcttttcgaattttaattaattctattattccttttagaagatgatttttattttgggatgaatttatcaggacgtgacaaatccaccccccttacaagaatctcgtccccgagattcgaggaggctagcaagaagatgggttgggcggtcttctcttcttgtctgacttcttccgttgcgtcttgacgaacttccagcaaaactttaccactcggaactgcttggcttgacctcctgttgcggatggaatcttctcttcacctgacttggaccaggatgcaccttttggctgactcagactaggttgcggtagttcagtgatgcttccgttccagaacttctcatgattcatatcttcggagtcaacctcggacaagttatcaacttcatgtcatgcgtcgtaacctgcttgtcattactaggataccatgcttgttatttgcttctaactcgccaccaactgcctcatattagcttccctggtctccgggtgatagctacttctgctatttgatgcaagggtcgataactttacctttgaattatgcttcccaagagagccaacttatcctacttgttatactttgacgtcttcccaaatggctttactgctggatttgttattgtctaatcattaccctgtcaaatctgaggcttcgttgtgagaggtgattttaatctgacctctatagactatcttcgaacgtatcactggttctataactgggaatggctctcacgaacaagcagctcggattcactttctttacattcagtttacttcccattattatcttcaggttatcctcagttagcattcaacgtattcctttacacttttaaccttgatgtgttctttcccattggatcatctcccaagacttggcattacctggtaaccggtgcttgcacttttcacttcgtgtagcatctgataccgagttgaagatttcactccttgccttcatagaaacacttttacctaggtcatcttgcttacttaatgacaaggtgactgttgcggggcaattacaatcaggggtcttccttgagcgatgcagagcatgtttctgtttatcaatcacctttcggcctacttcttttatgctagagaacatctttgccaatttcttttatcaatcatctttcggcttatctctaacaggtggtattctttaatgtggattgcggacgcttctggggatgatgaggtcctttggcttgctgcctttcagtggaaccttgatgtggttcgtcaaaagctgtactgactgccttcagggaaatacattgcttgctatctgtatccatgccactagggtttgattgccgatgatcatctttagtgcttcctcgagatggggagcatccaaattgttcttctgccacatcacctttgacatttttctgataccaaataaactaattaccaaccatcgactattatgttctcaaatattgatatctcctggatctccttaactgttggcaggtatacccggtcttatcaatgtagaggcatggcgggtacccttaggggtttcctccaacaatccttatcttgatctgtaaaaggcgtatccaaactcctatcctcaactactgtctcgttggcttttttaacccaacacagtttaattgtttttcttttccatccccaggttggttattaactcgaggttagaatatag

SEQ ID NO: 75752 - DNA, 3490 bp, Oryza sativa
agtggataaatcgtaatagcaaatatatgacttataattaataaaaattccaatatatatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacttgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattcatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgtcctggcgcgaattagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgaagaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacacagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatatttcgtgcgtcctttccaaattctttaaattttctgtcgatgtttcgccactgcgaaccatcagcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgcacgttgtctcgggcaatttgtttccccccg

SEQ ID NO: 75753 - DNA, 2193 bp, Oryza sativa
tattgatcttcatattatcatcccgcaccttttggcctgtccattccaactgcaacccacatatttctcttgcacacgtagtaaataaattactctctgttaatatctttttattagtaaataaattactcggaatccaattcattacttctttctgtaaatggattactctcgagttgttttcagccgttctcaattggttccttctctcagtaaatgaattactgtcgggttgttctcattcattctcttagtaaataaattactattacaccaatctcaacataacatattgatattgccaaaaaaatctcttagaaaccaagttactattacaccgatgattctcaatgtctcttagtaactaaattactattacatgcacgaatccaacaaacaagacggcgctagtgccacatatcgatgttgagccgacaaagcactatagatccttaggtctcccatcgacagatatccatcacccacgaacatctagagaggcatcccacagccacctggatatagacaaaaacgattacatcatctaagagaagtctttaatttacactcataaatgactctaaatgaaatatgattcgccgaagaagaaataaaatgcttcataaaaaattgagctaccagtttaggttccttcatgcctacttttagccaacagatcattttttattcagactagcatggaggtcacattatgttttcttaacggtagttcctgggcttgcctagtcccgatctgtaatcgatgacattgtgcaaaaaacaaaattaagaatgcagttggctgaaaaatgtagaataggtaattgggatgcttcaggctaaaatatccagatatctctgattaataacatacaagttaaaagctacacaaaacctgccatcttttcagatgaaaaacgatttcaagaataaaaatggaccgaatgttcttaatgaaaagaataatcataaattcagaatgatctagcattcactacaaattgatctacaatggatcgatggaacatgcatgtatgttatacagcgcatcaacgaacacaagcaatcaccacatatctggagcccgcaaataagctgcaattaactgatcaaacatggcagctatgcttcctcaaagaaaaacaagtagctattgcctatagagattgattgagtagatagaacatggagagaaaataaaacaaattaagcatcctgactttcattggaacacatacgaattgaacatccatccatccatcgatcctgaccgccatccccatgcctgctttgcgtggccagggtctccagcgcctgctgccgaccggcacgagtgcagactgcagaatgtgaaggaatcagaatacaggagcaaattagcagaactgcagcagcaaatcggtaaaacaacaaagatgcaaagtaaaaagttcaaaattgcatggactcagctgcttaccctcattatcatcgtgcatcacagatcatgacgccaccgctgtgggagggaggcagcgatgggaggcctgatccgtgccagatccttcgagggaggaatcagggtgtggtcaacgcagccggaagctcctccccgcatcccgccgtcaaccgccccctcctcctcaagagatcctgtcgatgtcgacgccgattcatgggcggggtggggaagggagcaccagatcgagcgaggacctcaactcacctgtcgatgtcgacgccgattcatgggcggggtggggaagggagcacctcacctctccatggctcggcgcaaaggacgtcggcgacccgcgaccatcgccgcctccgaccgatttcacccgtcgttaaccgatttcgcccatcgtccgccgcccgtcgctggaggacacttccaccgcccacgctttcgtccatgagctttgtccacgctaccacgcaggatcatgcgtggaagatagtcgtgcgcagcaggaccagctgcatgcacacgctaggagctggatggttttgttcaaattactgtgtttcagatagggttaatgattctggactgatattcttgatagtgttttgggtatatacgtacctagtatatgtgcgtttaaataggtatatagacaattagaaatgatacttacccaaaatacgagttttaattcaataaaaaaatagttttactgggtatatacctagtatgtgtaaataggg

SEQ ID NO: 75754 - DNA, 2655 bp, Oryza sativa
tttcaccggatatgtgttttttcttcttgccaagaaacggatttggcttttgtctttatcaaatgccatgcacattctcgaacgatgattatgaaggttaacttgtcattcttgcatgtaatcgattgagtgcgatgacaagttaatatatatacttagattccaaattttcatgtacttaattatattccgaaatttcgatgtatattactcgtataacccaatcgtatcattatataccttattaatgtgtaccaatcacattccatgcatagctaaacaccagtgcaaaatgctaaaatgtattggtcaaattttttaaatatataaattctgtaatttgaaagtgcaacgcgctaatttagatacgtgtacataagcctaccgtactactacacattactcctacttggtactgaaaatttcaaataatcggtttccacgtaatatactttgcatgtgtgtatccacgtaaaactacaattttcacaacccgaactgattatatacctactttacacataacccagcggatttgctataattatgtcgatagatttttttcgttgattacagttgattctctggccgttggatctgtgtttaagatccgtgcttccatattgactttttcctcgcaaagagacctgaaagcatatgctattgctagctaatctctaaagtcatgcaaatccaagtgaaacgtcacctaatttcgttctatatgtatgcatccttttctttaacacaaatttacaccccgcttacatcctacttacacatgtaattactatgtaattttgagacttacatctgtaattttaaaacttacattataaatacactaaatttacatatgtaatttagagacttacaatgtaaatacaagctgaccatttttgggtgaaaaatatggcgccataaatctagctacaccctaacccagaattgattatttatacctagaaaacattaataaatactcaccttttttttgcatcttggccggatgtgaaaattgacatacccgaaacccaaaattaatgaccttaaatttgctatttacctttgtcaaaaataatataaaatatcccactttccaattatacggaattgattttccataaattatggatgtaaacaaggacattaattacagcttaattacggtatagttgatacaggatcatgcatgcggcaattttttgaccagccgttgcactttctaaatcaggaatttaatacgggcagacccgttaatcttcagtccgcatcaatctcttgatcaagttctcatccaacggtttatacccatggagcccatacaccatggtgccccaaatggccatcctatatgtatatgtatatgtatatgtgtatatgtatgtgtatatatatatatatatgtgtgtgtgtgtatgtatgtatatgtatgtatatgtgtatatatatgtatatatatatatatatgtatatgtatatgtatatatatatatatatatattcatgtttgtaatatttaatacttaattagtcctgcgttgataacctacgtcgtctttcatgccctgcctaaattcaaccaattagattgaatgtagcctaagtaggagatagattagattatttactataaaatttaaaattaaagaatcaagttaactacattattaaaagattctgcttaagctcaaccaattagatcaaatttagcctaagtaggagataaattagattatttactataaaatttaaaattaaagaatcaagttaacttcattattaaaagattcattactttggatcatatatattctatggactagcttttgttaactaattcatacatttttaagaaaaaagcaaataagttttgttgtctttctcgctatttcttagctattaaactaaagtagaaacaatcaataatattggatttttttagaaacacgacacacgaacaccctactcctttgagtacctctaaaagactgatccaacacgttttgagattgaggatgtcaccacgggcgtctcgctgtcgacgggtatgccacctaccactgaaagaatatttagccgtaaatgcgagcacccgtatcaagtctaggacttgaaccaggtagacaagttacaccacaggaaacctaaccaattgaattgtgctcacttcgcaataacattggataataaaacaaccataatttttaagctacataactggaatacttttatgccttttaaaccggtgaacaatttgttataactgttagatctatcttatataaaagttaagcatgtatttatggtacatgacatttccaaaatattactacgcaattatatttcgtcattatcgtattcatattaggttgcatggagcctttcacccaccctacatgaaatgttcatagatggatcacctctcaaactatatcaatcatattagcttatataaacccatacatttagtggagcttcatgtcccacccaattcatctctaattgaactattataatagatatgtaattaaaaaacaccttactttactttcgttgacatgttttccaaaaaatatatgtttaccttattttcaaatgataaagaagattataaataattgcttatagatattccttaaatatgatataata

SEQ ID NO: 75755 - DNA, 4023 bp, Oryza sativa
caatgggaatacaaaattaagtgatgtcagctagcataacttgagtgatagaacaatttaatggaacgctaaggctgtgttcgatggtgggtgttgggaacccatcacccacgcacggaaaacggaacggtccattagcgcgtgattaattaagtattagctatttttttaaaaaatagattaatatgattttttaagcaattttcgtatagaaacattttgtaaaaaaaacaccgtttagcagtttgaaaagcttgcgcgtggaatacgagggagaggggttagaaacccagggcaacgaacagagcctaagatagtttaatggtataattcaacgctatgacttgatttgatcagtaaaggttttttttttacttttgtacgtttgtaaaaagaatttgaactattgtaagtttgtaaatataatttgaataagataaatgattgaacatatataaaaaatttaataatgttatatattaaaaaggaaatgtaggaattaccacccctaaactatcgcgatagttcggaagggtaattcgtacattttcctattaaaaaaaaggtagtttgagttttcaaggaatatatacatggagattacactattactggccactagacatctcaattcactatcgtatgctcggcttagtcaaatcactcgcacaatcacacctactccctatcccatccaaaaaaaagtcaatctaggaggggatgcgacccctcctacatacaacgaatctctggacaaagggctatctagattcattgtactaggaggggatgtcccatcccctcctaggttggcttgtttttggaacgaagggagtaaggttcaaatggtagttagtgcagcagaaagatagcatatatgacagggacggatctaggatttggccaatgggaatacaaaattaagtgatgtcagctagcataacttgagtgatagaacaattcaatggaacactaaggcagcgttcgtttagaggacattgagggggaaagcacctcgttttccacacgcatgcttcccaaactactaaacggtgcgttttttgcaaaaatttctataggaaagttgctttaaaaaatcatattaatccatttttaaaatttaaaataattaatactcaattaatcatgagctaatggctcacctcgttttgcgtatcttctcaatctcctcaatcccctttttctcaaacacaccctaagatagtttaatggtataattcaacgttatgacttgatttgatcagtaaaggttttttttttacttttgtacgtttgtaaaaagaatttgaacttttgtatgtttgtaaatagaatttgaataagataaatgattgaacatatataaataatttaacaatgttatatattaaaaaggaaaaagtaggaattaccactctccaaactatcgcgatagttcggagagtaattcgtacttttttctattaaaaaaaagtagtttgagttttcaaggaatatatacatggagattacactagtactagccactagaacgtctcaattcactatcgtatgcttggcttagtcatggctcagtcaaatcactcgtgcagtcacacctaaggggttcaaacggtagttagtgcggcggaaaatcaacagatagcatatatgccaggaacggatccaggatttggtcaatgggaatacaaattaagtgatgtcagctagcataacgagtgatagaacaattcaatggaacactaagatagtttaatggtataattcaacgctaaaataaatgtagaaatttctattgcaagcttacacaaggtcgatcactgccaatctatctatctatctatctattatatatactaaaagtacattaaacttcctacaaacactcccaatacgtcacgtgacattcctataaacgcttctaaactgctatgtggcactatttaatctaccgttgattttcattcaaatctattatatactaaaagtttattaaacttcctacaaacactcccaaggtgccgcgtgatgttcttataaacgcttctaaaccgccatgtggcactatttaatctcactgtcgattttcattcaaattggtggacccattatttaagaccattagattaaatctatatgtgtaccgttgattttcacttgaattgatggacccattattttgatcattagattacgtgtagtggatattttaatgtattaatgatgtattaagcttattttattggtatattatgtagttcatttatgaatagatacttggcttttaaaccgttataataggttgaaatgacaacaagtaaatttatatgtaaccggaggcaaagtgattttatttattctaggagaaaaccttattacttaaatatattaaagtctacaatctatttcacggtttataaatggtgagatatgacttttttttagcattgttttcataaaactgtcgggcttccttcctagttatacactaaaagtacattaaacttccataaaacactcttgagctaccacatgacgctctaataaattagatgaaatcttaaaaattctgagaaaaaaaatcaagatatctatctattaatttttacttaaattgatgggtacaatattctgaaccgttagattattacacctcttctccgcccctacagtcccgtaggtaagcagccaatgcccaagttcaacaccggttccgattcccagataatcttttatgcatgcatgtcaagttagttacgtgtatatatatatatatatacacctcggtacgtgacaccggaccagacgatttcggcatatctcagtggcacctcgacgctcgacaccacacgtttctcgtagcgattctggcgtcggcacctcatcggcacatcttcagcactccacacagtcagatattggtacctaacatcacaatcaggtactctctctgtttcacaatgtaattcattctagcatttttcatatttatattgatgtctatctagattcattaacatcaatatgaatatgaaaaatgctagaataacttatattataaaacggaggaagtaactgtcattaagactgctgcatggctgctcgggggagaatatatagccccctgcgaagggaggaaccgaggaagtgggcgttccctgctagggaagggcattcactgataacagtgaattactcagctctacaaatgctattgcagtactgaatgcactgcaaataatttgttaatggacgggtagtcgatgttgtcatcaaaactaaaacagttgtagatatcggcggctcagaaaatggaatgagtcattagcacataattaatcgtatattaattactataaacttaaaaaaataggtttatttattttgaaatatacttctatataaaatgttttgtcaaaaaacatgccgttgagcagtttgagaaacgttaaatagctaatggtaaacgacgaatttgttactaccaaatgcccaaacaaacgggccctaaatgaatagtgccaaattaggagatgtaggtttcgctgaacttacaaagacaagttatattcaacaatacagatgcataaaaaaagacaaacaatcaaatatagcatctacaacatgagcaatcagatcagtgtttaccctgtttgaatgctataatgtttaacatacgggacctctatatatagaatatagatgatattcctttttttgggtgattataggtgatatttaatccttcaatttcacacattattccccacaaaacaacaatttaacacccattataatataccgttagatatgtaaaatataattaaatattatttcataagaaaacctaaaattaaagataaaaaattttgcggcaacaaaatttatgaaaattaaaacaatatttttagaacttttaaaaagatgctcttaatttcttatagaacaaatgataacttcaatctttattgtatatggtatatataaaaagaagttttgcactacacatatttcaccaaaaaa

SEQ ID NO: 75756 - DNA, 5801 bp, Oryza sativa
cacggttggggtcgacgtggccagacccaagctcgaacgggctggctgcctggcccgtggccatgtccttgatggcattgccatcattgtccacattgtaggccgtcgtcatcatggccgacttgattgccgctgggctccaactcggttgtgccaccttaagcatagcggcgatgccgctcatgtgcaggcacgccatggacgtgccggagatgatgttgaactcgacgcgcctattgtcgatgacattggccatggtaggcgacatttctccggtccatgcagcgaggatgtcgacaccgggggcaatcatgtcgggcttgaggatctctggagcaaagcggttcggtccacgacttgagaaggctgcgacccttggagcagacggtgattggttgatcacagtgcctaagaagtcgattcttgcaaccgggtcggccaccgactgtgtgtacgaatggatcgtttcggtgtccttgaaggtaatcgtcgacgttggcaagatatcagcgaagctctgtaagaaatcaccatattctggagcaattgaaatgatggcaccaacaccaccggcttgttggacagcagcttcttgcactatggggttggtagtattttttgtgccatagcagaggacaatctttccggtgaccatgttgctggaaagcatcccgtattcacacagagcagaaccagcatcaccaccgtacactagaggtagaaatgaaccggctgtgttttggccgaaatacagcgaggtgccgatgtaggttccgcgattatgtccaaggacaacgtgagctgggaaccgacggtcaatgcttgatgcgccaaccgttatcacccatggtgcgaggttattagcagtatacgtgccagggccatcatttccagcggaggtggacacgactatgcctctacggatggcattgaatgcgccaagggaggtgggttcgttgtagagttgtggctttagaccacccaaggaaagggatatgacatctactccatctgcaattgcctcattcattccggcgagaatgtcagaggtagcgcacgatgcatttccatcatctctccagcatactttgtaggatgcaatgtgtgcacgtatagccatgccttgggcggtgccattggcatagccaacaaagttagcgccagggaccgctgaaccagcggcggtagatgcagtgtgcgtgccgtggccttcggtgtcgagaggtgacttggactcttgtgtctcattgatcaggtgacccatcttggcctcgtgccctttatagaaaaactttgcgccgacgagcttgttgttgcagtaggcggtggcattaaacgagcgagtggagacacaatgaccacggaaggtgcgaggtggtggaggaaacgacgagtcagcggtgaaggatttgcggcccttgggataaatgccagtgtccaagatcgcgatcaccgcgcccgtgccgccgccgtttgatgcctgtacgaggccaacggacggtgagagacggaggaaggagggagactgagtggtgtgcagttggagatgctcgtcggggtagatggcgaggacaccagggtggtccgcgatgtgcgcggcctggtgcttcgtcatgcatgccgcgaagcccgtggcggcatgggagtaggcatagacgagcctaggtgctgacctgtcacgcccagaagtttccccctttttccttgctttaaatatttgttaaataaatcgtccgaagaaattatcttaattaacctagagctaattccataattaataaatgcaattaataatcggaaatagcgtggtggaatttttcttgagttccccatgctccaatgcattaacaagatttttagtggaattttcagagccttggaaataattttaaccaattaaaaatcaccaaagtgcaatatttaatcccaggaaaatccttctcctctttttcttttcttttccttcctttttctctagatgggccgtcggcccatctctctcatcgcgctcggcacccctttcctgggccggcccgctcctcctttcccctccccgaagtcctccctccctccctttctctttcgggcgccgacaggtggggcccacctgtcggtcgtcccctacctccggtcgttggagccggagctccacccgcccgcgccgccgccttctccactccacgtcgcgcctccactccgcgcccgcacctcgcgcccacgtcgccgccctctcccccgcatctcccgcgcgcgcgcgcccgcaagtggtgggggatttgaaatcccccaacaccctctctctctcctccacctctccacgtcaccggccaaataggggccatccccggccgtttccgcccctccctcgcccataaaaaccctcactcgagctctctctctcatttcccccattcaccgtcctctcccacgccctctaccgccgtcgcgccgcgctcgccgagctccgccgccaccgcccatctccggccgcgtgccgtcgccactagggccgccgccgtgccaagccgccgccgccgctagctccgccgccgtgtgggccatctctgccaccgcctcgcgtcgccggaaccccaccggaaccccatctgcctatcgagccggagagctatccattcccctccgtctccggccagccactttggtcgtcgcggttgccttcttcatccctaactcctctcctcccctcctctaggtgtcgccgccgctcgtccgcccctcctctcgtcgggtcgtcgtcgccgccttcgttttccgctccggccgccgtgtcgccggtgagtcctccctccccctcctttcctcaccttcccgcgagcgccggccacgccgctgctccggccatgcgccgcctcctttcggccgtcgccgccgcttcccgcaccgccggtcaccgccgtcggtggtcgtgcctcgccgccgcctcgccttggtcggccggtcggccttgaggccgagccgagcccggccagcgcctccctcgcctcccctttgagccaccgcctggtggggcccacctgccaggcgccacctccctccctttggagccgctgacccgtggggcccacgtgccggcgccccccccttcgctgacgtcagccctgggtattattgcgcaataattaattaaggactttttctttattagtaaaaacacagtttatcttctaaaatttataagtaattcatccgagctccgtttaagtccattcaagtctcagtaaatcaagaaaaatgcaaaaaatccattaaaaatagttttgtttcctgtttcagcagtcttatagcatgttttgcttgtgtgctttgtttgtcgcgtaggtttcggccgtttcgtcgatccgcagttcctcgaagacgttgccgaggtctcatcagttcgagagcaaggcaagtcatgcaatacgtttgatcatactgtacccaatttacaaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactaggacacaaatggggatcacattattacatagactctgactattggcatagctttagattggtgccaccgcaagggtgtcagttaattaaaatattctgaatggcgggctgtgggtgcatggttttgctggtcgcacccatggcagttaaggaccggttcacgggaaaccctgggagacttatcgtgcttaccacaagcgggagtgggtaactgcttgatctgaagcatagctcgaccctttcctaggcaccggtggcgagggtgggcgtgatggagttgggtcggccgaggtgttcggttgtccagctgccggattcaccgcggcgcaagaggggaccgcccactgccttttgaggggtggggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagtttaggtggttggttgggcctattgcaacgtggtgtagcgttggacagtgattggttaatattgattaattactacagctgttttactgctttcaactactgctttgaaatgcctgctttatgcaaaagaacccctagcttcctttggttatatcctgcatcatacctcctcttccggtatgacttgctgagtacagtgggtagtactcagtcttgctctcttttcccccacaccagagttgaagttcttctccgttggagccgtctcagagaggttggtttcgttgctgccgtcaaggtttgcctgtggagtggagtcgcccgctgctgaagtcaagcttcccggtttagctcgctttaatctttcccgctgcatttgtaatcttttatatttttctaagacgtgggtctgtatgtcaacaattgtcgtttgtgtaccctggctggtcctggacagggatttaatgcacattcagcttagaaattctggtttgagaatttctaggtgtgacatgacccgctatgcatgtgggaaggaagaatcctttgaaggaaggacgtatagtgggcatgagcaaggtgtgccgtgtttgctgcatgggcgtgcacgacgtgcacgatgtaggtggatacttcgtctgattgctccgcgcctacggatgtcgccaccaatgcggcatttagcaagcttaacacaatcaggaagtttttgcccatggtgacaaatgagatggacggattgattgaatagatgcgtgctgtgaatgatggagcgtatatcgaagacatgaagggccggggtatatatacaatgaaaatattcctactctggtcacataatgaccttgaaaagtaaatttcatgcatgcttaggatgcacttgcatcttctcttctctctgtgtagtttgttcttcctaattgaggaagcgagaaaatttcaaactttgcgcgtgcaccctcctccgttcaaagatatggttgcagcattgcctggattactgccacactactagtctactacagccagcttccacaaggtgccaagtcacatttttgagccccactctggtcctccactggaaaataatatgaaccattgatctcatttcatcgatgggttaagatctatttatattaccaccctacttagtgatagtagaaatgtggagatgtattattgtaaaaaaaagtgttgaggggtataatcgtcttagcagtgacttaaatatttttttctttttctttttgctttttcgatgaaatatgagcgatgtcagtggattgaatgatcacagattgataaaaaaaccgtaaataacaaagttacccctaatcattgtattagtaaattactaatttacccttaattctacttagtagtttataatattgcaagtagagagcttccgagcattgctcttcttcctaattagctgcgtgcttccgataagagccattatttgtttttaaatttcacataagatgcataaccctacacatgtacacacatatataccaacaaatatatcttctaacacacgttcaaagatatagtgatcaatgataatcct

SEQ ID NO: 75757 - DNA, 4850 bp, Oryza sativa
ttattgtaacaaccccaatagtattttagttttttaattgatctacctacttcgtggatcagcgtggaagaaattttctactagtatattattttaggagggagggaatagaaagtttcttgtataatggaagtcaccaatattaagcgaaccggcgtgacgaaatcccattattgacactgattaagtgtcgtgtcatggaattaacagtcgcattgacgaagtccctaatctagaatcagaagctaattccggcccccggttctcatgtattagctattcgctgataaaaagtttatcgcgcgctatgaattttgaatattcctcgatcaactgattattctcatgtttgaatgagtgatttctagagccaagaatagtacgattccgtgtgtaatcggaaaaaaaagaaagaggaaattatatttgagctatcgtttattgctaacactggtggagaaactctttgtagtcccggtttgtaaccccctttagtcccggtttccaaaccgggagtatcaatccgggactaaagatcgctatctttagtcccgggtgaaataaccgggagtaaagatcgatctttagtcccggttggtgttaccaaccgggactaaagatagagctgacctttttttttttttgcatgcccctgttgctgcatggtttatatatatatatatatatatatatatatatatatatatatatatataaaccatgcatatatatgtttcaatacatatatatgcatacatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacggtttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttatatgtatttgaatcggagaaatataaatgtagagcatgtgtactcacaggaaatttgaacttccgcctaagtctttctctccatttgccgcggaccaaatgacggaaccgataccaagccctacatggagtttaaagctatgatttgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgtttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaatgtattaggataaatgcgaagtaacatatatatatatatatatatatatatatatatatacatgtatatatatatatatattgcatttcacgttaacgttcgtcctcgttcgttcgctcgttcacgttccctagctcgttcacgttcgttcgatcgttctcgttctcgttcacgttgtcgcggcaacgtacgttgacgggttcgttctcgctctcgttcgttcgatcgttctcgttctcgttcgttaacggcggtgtggcggcatcggggcggcggttggcgcggcggcgtggcgacggcggcggcagcgtggcgttgtggggccgtggcggcggcggcgtggcgtggcggcggtggcgtggcgtggcgtggcggcggcggcgtggcgacggcggcggcggcgtggcgttggcatgcggcggcggcgttgcgcggcgtcgaaggcggtggcgtcgaaggcgacggcgtcgaaggcgacggagagagatcgagatcggagagatcgagatgcatgaagggagatgcggcggctctcaccccagagatgcggcggcagcggaggaggcggaggcggcggcgaggacgacgagctcgagacgacggcgagatacggcggcgtcggcgcggggatttgccctaggcagtggcggcggaggagagaggccgagagagatcgatcggccgaaaacttttaagtgttggtgaagaagacgagggcgcaccgggaatatatatacccctggatctttactcccggttgttctcaacaaccgggagtaaatatcttttcccgctatttcgaaattctttttaaacccggttagggttaagaaccgggactaaagattaagcactgcatatgattttcgcttacatatgtgtttataaaatag

SEQ ID NO: 75758 - DNA, 12983 bp, Oryza sativa
aaaaaggagggatggaaattagacttattttagctatacatatgtaacaacccaaagagaagggacggaaaatatacttatttaaaaaaggcccgatgggccacccgtgccttcgggccggcacggcccgatagctggtgggccgtgcctgggcgggaggtgcagcccatgggccggcgcggcccggcacgaagtgccgatcgggccgtgccggcccgttggctggtgggccgtgcctgggctgggccatgacgagcaaaccttttggccatctatattttatacccagtgttctcggatgttgtgcccacgtctacggggggagtccctgcccggtgggccaggctttagatgtctggtccatcatacgggggaagaaaattatacccatctagaaagacttttcatctggagtgtcatgtgtccgcacgaatcttgatgtagtcatcttctatatgagctcaagtgcagagtgccaaactttccctttaggtcctgtataattttcttcccatcagaggggtcctcacttccttccgaaaatgcttacctccagacgccggacacgtggtaaaacgttagaagttctcagcacacatcatatttatctatctatgcatgcaacatctctctgttcaatttttatcccacttatattttaggatggagtagaaaataaaaggtagcaacgatggacaggtaaggcctaagggcgcgagttagctagcgtgtcttcctttcgtcgacggagtcggtgaggccgtgagggtgggcagctgccagccgagcggtgcgccgtcaatgggtggtgcagtggggacaagcgaggtggagctactgggcggtgtgggcactccaccactcggctagaccggtgcaccggtcgaagatagagatggatgtgatgccaatgcgctcaggcagccgccgcagcgattggatgggctaggccaccctcgagttgttttgcacccctgcaaatattcggcttggttggaacctagaacgagataaacatcatctcgcttgtaagaagttcaaataggccaacggagtctatatgggtcaggatgccaggctaggtgtgcatatccggagtacgtcccttcgggtgcgtttgtttctcacgtgtggttgagattttcagccgcacgcgaaaaatgggatttaatttgcacagataaaggacagagtagaccgcttgtatccctacatgcttaggtttgcttaaactccaatttcaaacttgtacctagaggtggtaatgggttagaatttatgggatgttcacaaaccaactcatcccttaaatacttttacctcgaaagtttaaaatttcaaaccacgctttttagattaaccctttgaattttatagattaaaaagttaggcccattacacccctacttgtacctaagttagcacggattgattggtccccaattttacctagtacggtgacatcgagtgggaaagtcattgcaaatttcagaatgtgtcgtatcaagtaccttaatgaagtacaaacttcgtttgacgtcgttatttctaaggtatttttttctcgaaggacatgaagaatccgatcaatcgtaccaacggaccacgatgtgataatctagaaactatcaacatcacaatctacaagaactagatcgaaaagctggttttagaacatgcccttgaatcgaacgatgttctggtgcgccacctaaagcactcttataggccattcatacgaattttgcgtaattctggttagaattatagacagttacagtttatagcacaaaggatatagccctgacttctcttatctaaaagaaagtatacatgcataggcaccatagtccatagctaaagctctccaaaacaattgatgtattagcttgtccgtaattaataacttatcagcaacaaagcaacaattcaataacatctagggatttaattcagctagttgctctacaaacctaaataatcattaaggaatggaaaacgctgaacaagtgaacaatatgttcgttaaagtcggcatagcaagcatcatcgaaagcgttacgcaattagatatgtataagagctcaattctgcgttacaaaaatattgaaaccacaatagaagaacagaaatgagtggtggattcctataagaacccaacatgcttgccgttaattccacatttgattggaagtattaattctataggagtatttaattgttttcggaactttatagaatttaatttggtcatatgaccaaaaactcactggtggagaaatgctttttagtcccggttcgtaaccccctgtagtcccggttttccaaccgggactacgaatccgggacaaaagatcgctatatttagtcccggttcaaataaccgggactaaaaatcaatttttagtcccggttggtgttaccaaccgggactaaagatggagcatcaccaaccgggactaaagatattttttcttttttttttctgtttttaatattgaatattgatttcacaccatcccctcccatatccaaatcatcacatattacagaacatctccaaattctcaaacaaatcttctccaaatacatcacaaactcttaaaaaaaattacatcacagggttctaaaaaattcatcacagattcacatctcacataaaaatacatcacagattcacatctcaaaaaaaaaaagaaaaaaaaatccggccggcggccactgccgcctcccctcctcccctccgcgccggccagccggcgctgcgccggacgctgccgagcggccgcccaccgcagccgccgcctccgcgcggcccccggcgccgccgcgccggccgcccgccgccgccgccgcgcaggccgcctccgcgccgtcccccgcgtcaccgcctccgcgccggccgcttgcacttggtgaaggaaaaaaggaaggagaggaggggagttagagataaggaaagagataagaagttagagttaaaaaagagatagagggaggagtttgttgtgtggacgggaaaagaggatcggtactatagattatatagtgtgttttgatttttattcccggttagtaacaccaaccgggactaaaaacctaaagatcatagggccctaacacagcctgacatggaatcaaccgggactaaagtttccaaccgggactaaagatgatttttagtcccggttggtaacaacaaccgggactaaagatcttcctcttattaaccgggactaaaaatcatttttagtcccggtttttaatggaaccgagactattgtggatttgggtcgaccgaccaaagatgatttctctaccagtgactgaactatttgattggaagtattaattctataggagtatttaattgtttttggaactttatagaatttaatttggtcatatatatagttcagtttttggtcatgaccaaattaaatataaaatatgaagtaatatttagatttatttcagccatacaatgatttactataacggggtgtctggtctcactcgaaaataccaaagagatttcagtgacttttgaatggctcatatcgtgtcaagattcatgcatcatggatattttacctgatctgtttccccttccaccctgcaatgcatgcgagcttgactgctcgtttcctcacgcgacgttgcctctcccacctcatcccccctcccgacctcattggcgctgcgccaccgaatgccgctgatatgtgaccagccgtgcgtgcgcagccgcacggtcggttggtcttataggtatatattcatatgtatatattttgtatacatatgtataaattttgcatgcacgaatgtatgcaaagtatatacgtataaaatctgtatatttatctaaaaatattgtgtgtaaaaattttatgcgtggcatataaattacatgaaaaatatacatacacgtacaaaactttatatgtatactacaaagtttgtatgtatacaaacaaaatttatatgtatacatatgaaaatttgtatatatatatatacactttttttatgcatattccgtacgtatagaaactgattgcgtgatcaatgcacattagcatttttgggcgccaccaagtgctggcaaggtttgccaaattgggctcttcccgctccctcctctaaaccaacaacgccgatgctacctcgtcgcttaccgtgtcatgggaaaccgtccctccagccggtctctctccgctcttccaacccttcctcccgtaactcctactccaaactctaaaccctgccccacactaacacgaaatcgttaacgttgtcgctatcattgatgagttaccccttttctctcccttctcctcctcatccggaacttggttccctggccattggattgaaatccaatggaaatggatgaggtgacggagattgagagaaatctcagtcacatgaaaactagcaattccctctataaatatcaagtttgactaattacttttttaagactcattgtgccatgcttcaattcatagacaaattgcattcataatatcttaaaatttaatccaaataaaatattaaagctaagtcaggggcgtagctaggggtagtccctgtgggctcgggactaccccaaaatctggcccagagacccccacccccccccccaaaaaaaaaatttaggcccaaatagcccagaaacatctagggttggaggattcccctccctcagcgtctcagccaccagccagcgcccagcagcgccagttcgcccgagaccctgagcccgacgccgctagccgccagcctcctcgagacctcgactccgcgccggcgcccggtgccgtcctcagctggccggctccctgctgtccgcgccggcgccgccaccgccgtccgcgccgagtcaccgacgctgcgccatgccgccgtcccctcccctccgtggctcagccctggtaagaaatagctgcctaaatggctagatttgtgaattgtgattagagaattaatgagtctgtgaagtgtgaataactaagaaagtgagaatgcaatttataaattgttagattaatgaatgtgtgctaaatgctaattgctattgtttgtaggatttataatttgttatattagtggctttttaattttttatttatgtgtaagatctatgttgattgttgaactctctatgttgtaatatttgcacattttgaacttgcttgttaagtaagccgcttatggatcttggaagacattatttctatagtattttcactaaatttgtatttgtatatcagttttatggtgcaataaaattttaccatgtgacatgaatgtgtgaactaggactacccaaggaaaaattcctggctacgccactgatagctaagtattcattcactcatatgattaattttattcttatcaatatgttgatgactaaaaattcaattgactgtgtgaatcataggttaaagactctaacaaaaggcaaaattttgaaaaacttttccacctaaaatgatcaagtatctatattacggagagtgcacatgcaaagtttgaaaattttccctccctcgttaggaagtacaaaatacaaacagatgaaagtccatctaatctatctatgaagtgttctcaaagtcattatgtagctagaatagtactattttgcttgtatatataccccttgatgcctttatcataagattcaccaattcacaacacacaccatgcatctcaaacaaatttctatggtccatccggacatctcatttgtctccatggggctgggcaagacactcttggtcgtctttagcttgctacatgccttagtgttagcaacatcagtaggtgttgagcatgcaacagatgatgtatccacctacatcatacatgttgcacatgtgcatgcgacacctccaactcatgcctcgcaatgcatggaccagcacgccattgcacactacacctcctttctccaagggatcctcccttctcacttaagcgagccaacaccacgccttgtctatgcatactcccacgcggccacaggctttgccgcgaagctagcgaagcaccaggctacacacatcgtgcaccatcccagcatccttgccatcttccccgacaagcgcaatgagttgcagaccactctgtctccctccttcctcggcctctcaccgtccaacggcctcgtacaggcatcgaacgatggtggcactggtgcagtgatcgcagtggtagacactggtgtttatcctaagaaccgtaggtcctttaccgttgacccatcactgcctccgccgccgagcaccttccgtggccactgcatctcaaccccttccttcaacgcgactgcctactgcaacaacaagctcgtcggtgcaaagtatttctgtagagggtacgaggctgcattaggccaccccatcgatgagacgcaagagtcaaagtcaccacttgacaccgaaggccatggcacgcacaccgcttctactgccgcaggatctgcggtccctggcgccaacctatttggctatgccaatggcaccgcccaaggcatggctgtgcgtgcgcatattgccatctacaaggtgtgctgggcaaaaggatgttatgattctgacatcctcgcgggcatggatgaggcgattgcagatagagtaaatgtcatatctctttccctgggtggtcggagtgaacaactctacaatgaacccacgtccgttggtgcattcaatgccatccgcagaggcatatttgtctctgctgccgccgggaacgacggccctgacatgtctactgctaataaccttgcaccatggatggtcacggttggtgcgtcaagcataaaccgtcggttcccagcaaacattatcctcggaaatggcgaaacttatgtcggcacctccctctactcaggtcggaacatagctgcttctttgataccactagtatacagtggtgatgctggctctagattgtgtgaacctgggaagctctctcgcaacatagtcattggcaagatagttctttgcgagatcggctatgcccccgcacaagaagctgctgtccaacaagccggtggtgttggtgccatcgttccaagtagaaatgtctatggtcagttcttcctgagttcacccgacttgatcccggcatcaacagtgactttcgctgacgccaatgcaatctattcgtacacgcaatcggcggcgaacccggttgcaagaattgaatttcgcggcaccatgatcagccaatcaccatatgctccgagggtcgcggccttctcgagccgtggacctaaccgctttgtggctgagatactcaagccggacataatcgcccctggcgtcgacatcctcgccgcatggacaggagaaaactcgccaagctccctcagcatcgacacgaggcgtgtcgagttcaacatcatctctggcacgtccatggcgtgccctcacgtgagcggcatcgctgctatgctcaaggtggcacgaccagactggagccctacggcgatcaaatcggccatgatgaccacggcttatgaggtggacaacggcggcaacgccatcatgtcgtcagtgaatgggcgggcggctgggccatttgagctcggttctggtcacgttgaccccaacaacgctctcgaccctggccttgtgtacaacgccaccaccgacgactacatcgccttcctctgcggccttggctacacaccaaaccagatagcgattttcacaagggacagcacgacgacctactgctcacgtcggccgcccatcggggacctgaactacccggcattctccatggtgtttgcgaggtccggtggtcaggtaacgcaacgccgcaccgtgaccaacgtcggggcgaacaccaacgccgtgtacgacgtgaccatcaccgcgccgcctggcactaggctcacggtggcaccaatgaggctcacgttcaacgcgcagcgcaagacgcttgactatgcgatcaccttgtcggcagggtcaagcaactcgccatacaacgcgtggggagatatcgtctggagcgatggccagcacatggtgaggagccccgtcgtggccacctggaaataaatcaccacttgtgacattgtatcgtacgtttatagtaattgaaggccatcatctcagatggtgccatgatgtaaacgtaacatacgtagtactgtatggatgaacccgggaaaaacgcgttgtcatcgttgttcctgctaccgctagcacttgctgcttggctgctactgtataatcagcacgtatgcattaataaataaatctgaagtaaattgtcctcaaatttgtcaatgcatgaagagataaggacgattgtgcaaggttagatgtacgtgagtcatgaaagtacctattggaacaaagtccaacagatatgtctgccaaagaatcaaatatctgccccttcctcaacatggcggttactgtattttatagagggctaagtacatggaagattacaaccatagccctatggctatgggcagcatataggcatttctaggcctactggctgaccggtgggcccctctagaggggtactatagagggatttcttggagggccgccgagcagcccatgccggctcgcaagccgacagtaatcctgggaatcttgggtctggaccatccataataagactgagattaccggcctcgactacagcaagcaatgcgggcaaccagagtttgaccacataggtgggaaaattcaatgctcccattcatcttcctatctctacctctccaaggccacagccccgggtccagatccacttgctcctctaaagacgaggtagacggtcctggcttggttaggggtggcctgaaggctccacatcccttcgggggtggggtggaacccctctgacaaagagaaagtgagcatgataaatgcccgtttgggtgagccgatggacccagagggtccttcagagcccatcccccaatagtacaatggagcatatccaacgtcaatcgatttatttgatgtacggccacgtttaagtttaataatatatgatggtgggacccatgggccaacatcaccgatcaggagaagtgatctttgcccgaatgacaaaaatcacattagtgccttttcaaataggaacagggactaaagaatatctttagccccagttcaaaagtccaatggtactttatgatctttagtcatcatttttagtcccggttcaatagctgttaggccgtgtcaggccccaaacgatctttactcctagttggtatcaccaaccgggactaaagatccagttgatatcaccaaccgagactaaatttctctctcccactttcttatcctctcttgcctcgtctctctcgatctgcccacacgaccttttatttattatctctctcccacgctcgcttgctctctctgtctgctgcctctctctgtcttgctcgctttctcgagaagcggcaatggcagccgggcggcggaagcggcggcggcggcctcgccctcccctccgttagatccagcgagaggagaggccacgcagcggtggagctacggtggctcgacggcgtcggcgcagccgtgcggtaggcggaggattttttttttttagaatttgtgatgtgtttgatctgtgatgtgaatctatgatgttatctgtgatatatttgtgatgtattttttttagaatttatgatgtatttgatctacgatgttatcttatatgtgattgggggatgtagggagcaacttgatttgggaaaatcaatatgcaagaggtaaaaaacaaagaaaataaactcatttagtcccagttggtaacacaaggcgctaccatctttagtcccggttgttgttaccatttttattcttggttatttcaatcaggactaaagatgagcatctttagtactggattgggtgttccggtatgtaacccagaactaaatgaggttgcaaaccgaaattatgagttccccagcatgactccattacacatggatttatgtagtgggtcagtaaacatgcattttctatgtctttggttcgaaccaagaaatttgtttgattttacgtgtcagacagacaacgggctaacgggcttgtttggtaggtgacctgactgacaatctatgcatgtgtaatagaaaagctggtgtttcattgtgcctgaccaggcatgtctatgttttattgtttggttgaaaacctacgcatgagtgaatatatatattatatataaacattacgcttgcttgagtgagatgttgacaagtgttaatagcagtcacatcaatgaagaatcaatggggaaggatcagacacataaacacgcccgactcaggcgtttcagaatattacattcttggtcataattaaatattggactgccgaaaccttcaaccccaaaattaagttgccctttttacggtctgccttttatcatactctacatccttcttaattgatcagtatagctcttgcccttaccttaaacataaggtttccctttgaatatgcaaatttcatcatgaatccctgatcatggcgacgatagcttggttgacaccacacgatagtaatatctacggatcatattgcttgcacaagcacactataacttttgcttaaacttgaatttcaaacttgtactaaaattactacggaatattcatatctagatcggtaataatgaatgtggaaatcgttgcaaatttcaaaatgtaatttctatgcgagtactatcggccacaaaattcatctggccttgttgtttctaaggaggacgaggaaaaacagctcctggctccatttttttcaaagaaagaatccaatcagttgtacccaattgggcagacaatgagataagaacaacataatctacaatagctcgaagattttggtttcagaatatatagggcttggatgatgtgtcagcccaccacctaaaagcagtctacagggaataaaaaacacgaaaatgctatacgtccgaccgacgcgtacaaacagcgtacgactacgtcattggccatccgccgtccgtaacttctgcaacgatcgctaattcaattgggtttacgccgtgtatttcgccgttgagtcgtacgctggtcgtacacgtccgtcggatgtatagcagcgttgaataaaaaattaaacccccttgatgatggccaaaaggcacaatttcgtgcatggttgctgtctatggcatagactggaaaacctttcgattattatccaaaaggaagttgatctgcgtagccaatatatgctaccctgaaacaacagacggcttagatttgttagtaacagagcaactgcaataattgaacaaccctataggctatagctagtagttaattcatgccgtggccttacgaacgtctatacgtacctggacaacaactcatcggggcatggacagcgaccgaacaacatggattaattaaaattccaaataaaaagttaataaaataagcaatttgattacaatacaaatcccaaaagtaacataaagttttcactaaaattcgaaattgaaaaaaatacagtaattgtccatgtaaaatatcagagtacaagcaattaaatatctgaaatttggaatagtaaaattatatgtatattggaagctttcctaaactaattaaactaataataaagatgaagatgagtatttgtaatcttaaaagttagtgttgatagcgagagatgtttcttaattatttggaacgagaactatcatgaatatacaatcccatctttggtggtgaaagaatgtcccaagagatggtgaaaaaaaattccaatattagtctgaaagtgttggaatgagagaaacaaaataccttagatttttatatctttgagctattgtttgtgtttgctttatggacacagaaattaccatgctaattaaccagaatatagatgtaaaccgtttgatcacactggagcagacggtcagagttcaaaattattatcattttcattttttttctttcacaattaaatacgaagtctttctacctttttttcaaacactaaagtataaccactattatatgaaaaactatgcgatgatatatgctagtagactgcacgcaatgtgtatgagccaccccgctagttcattggaaaccttacaaaattggatttgcatgtaagctcaaatccacatttaaaaagggtagaaatcatttaaaaaatgtaaaccaacaacaggtttatataataaattggtatcacttcacggatatggtgaaattatacataatataaattaaaatttaattaaaagggtttatctcattgccaaacattggtatcttatactaacatgtacaatcaaatttatcaaaagaaaacatgtttaagtctaaatatagcataaaactataaatttagcaataaatgtataataaaaacatactttagatgtttattaaggcgacggatcagactgataaaaagaacgaagagattgagttgagagcaaaggagaaaaagaacaaatgagcggaggtagggtagcatcctttgattttaaaatagcttgtcggtgcgtggtggactcgtgtgactggattgactcaaaaccaccaactgaaaaaaataggtctatttttatgagcaaatctactaaggctgtgttcttttcttcaagttcccaatccatctccttcgtttttcgcccgcacacttttcaaactgctaaacggtgcgttttttgcaaaaagtttctatacgaaagttgcttaaaaaaatcaaattaatccatttttttttaaaatagctaatacttaattaatcatgtaataatgcgtgctccgttttacatgccggggatccctcctcccgaacgcagccttaagacaaccttaaccggaggagtcttatgtattttttaaagcagatcttcatttagcctgttcgtaaaaatgatgggttatctgcaagaatggtttt

SEQ ID NO: 75759 - DNA, 2981 bp, Oryza sativa
ctcatagttgaagagaagggcaacataaatcgtagataggtggatgtcatacaagaaaaacttgtttgcacccatggatcaagggtataagagttgctggttctacctgaaaaaagaaggggatatgccaaacttcagaatttcaacataacagaaagtcagaaactcataaaataccattatctaaatctgagagtggctaaatgctccatcgtgtaacaatctgtataagcaaacactcacagcttgtgcagcttcatcaattataacaacatcaaaagcacgagccatcctgctgaaaatggatgatccactaaaacttagcgtagaaaacacctacaaattttgcttgacagtcagaatcaaatattaaatgattcctggaatactgaaataagcaaaagaatgtgaaataagaaaatgaatgtacgatggctgcttcatcaagaatggaagatctaattcgatcatattcaccagcccctcgtctcccaccatctgatgagcgatccacaccagaaagtttttgttgtatctgcaaagatatcaacttatcaactcactgtaattgagttggacagaaaatacttagcaactaaaatcacgtacaaggtaatccatggaaactgctttaacagagtgatgcgccttcagtccaattcgcacaatcttaggattataggtgttgttattttcatcgcgtattcctgaaaggaagaagaataataatttagatgattgattttccgatcaataaattagtgaccagatgagcctaagaaatgttgtttagtttgtagcacatggatgcaattgaaagagtatttttattgtcagaacatttttctgaattggatcagtcagcacagaaacccctttacctgtttgcagaactcgcagcacaatctcatcaagtgctgagttggatggagcacagaccaagacatgggcccgatacttgcgattggaacttacgacctcaggtttctatcaagacaggtgtttaccatgtaacaaaaatacaaaattcatacaggcatcatggcaaatatagcaaagtacagagcacagaagcttactagctcattcccagtaggataaaaaccatcatcgccgtcaacaggcataattaaatctcgaggatttacaccaatcagccacggggaggccttcatccagtgtgcatgcctatcacatgagctctgcagtaagatagtgcaacagatatttgcagcagtattatgtagcaaataaaggaactgcataattccacagagtaagaaaagaaaaaaatacactgaaaagaatttctttatcagttcccatactacatataaaatccacatgctgagtgatcactaaatatgatagtacaaatgtaaaaatagctacaatcttctccctctaacaaacactaagagaagtaccataaagtaaggtgaatttgttatttccaaacaccatagagaacttgtttaaaggaggaaaaaagcaagcagaagaaatggacaaaacaagaaaattagctgaggatgaagcaattgaaaagagtccaattcattaacatacttgccctcaatatcaagctctggaccgtgttttttaacatcaaaaccacctctgcatgacaagaacgtaaatcatgtcagatacatgtagcttttggaaactgtattgaacacttatatttatgttttagcttctaatatctctttttttatatatcaaggtttctcctctccataacagaaagatactagtctacatttcactcagtaataaatatacacaggtgaagatattacttggtttgcattcttgcaggagcagaatggagaacagcactgaggagtccaaggatagtttgtgtttttcctgttcctgggggcccctacaaatatacattggagttctatatgaatggcatgtgacaacaagtagagcacatgtagctgcatatactctagttctcaaggcactagcatttctctaaaataggttaatgataaataatactgaaaaataaacaaatataactggaaataagcaaacaaacctggataagaacaaaggatctgcgagaaagacctgcctgcaagagataatgcattgatcaatcagacatctgatttttcttagaactaaattgagcaacaaaaaaggatattaagaataatgctcacgttgactgcatctagttgtgaatcattaaggtttgttttaagataatccataagtggctcagggacattccaagcacggttttgatcattcccaccactgttcttctcactagctgaaagaatcagatccttaaaaggaagtgatgctacagagtgcatgcccgagaattctcgcattatggtagacaagctgcaaatctgacaattttaaccataaaagaaaatagcatattcatatgtgttgtcaatgaattatgcaagcatgaaaactcaggcattctttattagcagttgaaactcacctttaaaatccagaggaagctctctgtagttgaaaaaatggaagcaatacgctgcagcctagaacagctcacaggctttgctacattaagattttttatttcacctgccacaaatgtccttagagaaatcgtttctctgccaccccgctgttccactaaggcaaaggcatatgcactgggggtcactccctcttcaaactacaaaagtgcagatatatatcaatgtgatgaattttcaatcataacttctttcttgaagagatatcgcatagaatcgatggagcattttgctagcctggcatattatctaaaaccatggaaagcactttttctggtgaaattatgtctcaagttccccatagcccttccaaatgtaggagcgcagataagtaactaacattgtcttgagttcttgacacgctatatgttccactaaattctgtagccatctataccttttgaaacatttcctatcacaccactaaggtgctaaagc

SEQ ID NO: 75760 - DNA, 2238 bp, Oryza sativa
gccatatagaaaaaaaattcaaaggtggtgccggtgattgcaaagcgagcgctcggggcggggcggggaggggcgtaccttggagtccgcgacgaggcggacgtagtcccacctgaggacgatcttgtggaagcggtccatggtgcaggcggcgacgcccgacgaggaggagcaggcgccgcctccgcctccgccgccgccggatttgtccaccgccattggggcggcggcgcggcggcgcggcggcgagagaagggggttctggggtttagtgagccgccggcgctgcagcggcaaacagcctcgctctggaaagaaggaaaaggaacgagatgagagcaaacagagagaaagtgcgatgctaatggttatggccatgtaatgggcctgagcccatttctgaagtacccccaacgaacatggggcaactccgatgcaaatccacaaacgaaagtttgatgaaatggggcttcaattacttgtgctgtggttagcgcattaatcattgtatacaaaatacaaaaattcgctgctggacaccgtatctattaaaatatttatttctaatttaatagaagagagaaatcataaaaaatttattgctggacaccacacttattagaatatttatttacaattgaatagaagagataaatcacgtataagtctccatctcctctctctctttctctcagctttctctctcgttctcggtaggataaattagcctaaagtatataagtcacatttaaggtttctttaataataaaatatgtcacagtaaaataaatgatatcctatatacctatacaaatcatcctcactgttagaattctctgcttcctggtgcttccatgtcaccctttttgtcctcaccgttggatccgcatcggccgttcctcccgcatcgctcctctcctctcatctcccgcatcttgctacggcgccagccccacgcgcatcgctccccacctctcctctctcgcatctcgctgcttcgctggccccacgcgcatcgactcccctctcccgcatcgctctcctcctcgatcgtggcgggcagccaggaagcgcgaccaccgcgcaaacgtcgtgcctcttccattcaccgcgccgcttgctttgctgattttatggcgactctcctcctcccagcgctgttgtgcgtagtagttgagggatcacgacatcctgtcgttccctccccattcacccagatcccttcgtttacacttcgatctccttcctctcacatctgtatatcattggcaataagcataaaagccatcgaatccgtttcctccgactatcaaatcgtcgcccatcttctcaaacttcccctccactttcatctccctcacatgtatgtatgtcggggcaccaggttgagtccagctgcacatcgcctactcctcttcgggctaaagaacgcacttttttttatcaagggtggcccttgctgtgcccagcgccatggaggtaagcaccaccaccgcctttctaatccatgaaggtaagcaccatcatcgtcaattttgcagcccaaatacagaacagaaggaggtcgctggcactgggcaaaattgctcaacttgccgattattcagagccgattattcagagctgaaggagcacgccaatagcaggatgatgccttctgattcatcactatatctatgtgaccaggtctgaccgtctgaggcattgtccaactttcatatgtaatttttgcatactacaaatggattcagaattgaagacactattcctaacacaaaggtaaccatatcttccagcgtttaaacacttatttacatggatgcttctgttaagaaaaaaataccataggtacaaattcaattgctggttgattccaaaaatatatcatggaaaaaacattctcttccataaaattttcaggctgcaaaactgcaatgctaatcttctctttgtaactcatgacacatgaacaacctaccaacaacggttcttctcctcctagattgtaacccatgtgtttatcctccagatgtgttccctttcatattattgaccctttatatgaccatcatgttatcccttctcctaacacaaaagttgcactaccgcatctggaggatcctaacataaaacatcatgacactaacaaccaaatttagtatcctcatactattaattgccaattttgtttgatttacgaaaaaaaatcctcatagacatagcactcttgaaacaaca

SEQ ID NO: 75761 - DNA, 10615 bp, Oryza sativa
ccgacccggcccaagaggaaagggggggaaaaagaccttcttttaagattttctttttataaacctttttaactttgtttatttcttctcaattattatttgtgctctgaaaattccactaaaatttgagggctccttttagaccaaggagaatttaacaaaaattctccgggccacatttgaatttttcttgtacgtattttagggtttgccaattcttttcgaattttaattaattctattattccttttagaagatgatttttattttgggatgaatttatcaggacgtgacacaagctcataaggttacgtcgtctcttccttccctttgggggaggttgtcagaaacaaagacgtcgtcggccgaatcactaaatggtagtcgagctaagccagttagatgtacacttcgtaccaaggatagccatcaaatctcaagtcctagccgatttcgtagccgactggactatcccagaggatagaccggccagccaactagacaacgaaacttggaccatggcgttcgacagcgcgctcaacagccaaggagcaggagcaggagcagggttcatcttgacatccccttccggagatcaattcaagcatgcaatccacctcaatttcaggcaacaaaaaacacggccgagtacgaaggcctactcgaggagataagagcagcagctgcactcggtgctaagcgactaatcgtgaaaggagatttcgaactagttgcaaaccaagtacatagactacaagtgctctaaccccgagttagcaaaatacctcgccgaagtttgaaagctggaacgtagatttgacgggatcgaggtctgacacgtctaccgaaaagacaatgtcgagccagacctcgcacgccgtgcttctagatgagaaccactcgagcccggaacatttctggacatcttgatgaagccctccgtcaaagacacgcacgacaaaagcatcatagccaacaccgacattccgtcgggggttgcagaagttgcatacgtcgttgcaaacattgagataacagacgactggcgtattccgctaataaaagtcctggaatcagacgagctaccggacgacgacacggaggcagagaagctatcccgtcaggccaagatatattgcatgatcggcagagatctatataagaaggccccgaacggtatcctcctcaagtgcgtctcatccgatgacggaaaagctctcctcgtcgacatccatgaaggcatttgcggatcacaagccggcggacgtaccttggtcggcaaagcttttagacaaggctttttctggccaacagtcttaaaagacacctgtgacattgtgcaacgatgtgaagcttgccagttctttagcaaacacaccaagttgccagcacaggtgctccagattatccctttgacatggccgttctcgtgttgggggctcgatatactagggccattcccacgaggacaagggggctacagattccagttcgcggcaatcgacaaattcgctaagtggattgaagcagagccaacacgagaaatcaaagtcgacaacgccataaaattcatcaaggggatattctgcagatatggattgcctcaccgcatcctcacagacaatggctcccagttcactagcggccagattactgcattgagctaggagtcaagatctgcttcgcctcagtatcccatcctcaaagcaacggacaagtcgagcgtgccaacggaatagtactccaagggatcaaaacctgcgtgtacgataggctcatggcctacgacacaaaatgggtagaagaactcccgtcagtccaatgagccgtacgaaccacgccgacaacatccaacaaggaaaaacctttcttcctcgtgtacggatcagaagccatgctctccacggaggtacggcatcagagcacacgagtacataaatattccgatgaggaacaagatgaaagacgaagtgacgatgtgaatctactgaacaacatcgtgaaccaacaagccctacgccgatatcatgagaggcgcatcagagctcgcacacttgccatcggcgactacatcctccgacgagttcaaaaccaggaaggtcggaataaactctcgttcaaatgggaaggaccgtacacggtggtgcgagtcttacgaccaggtgcgttcaagaatgcagatggtgagcaccttgagttatccaactcttggaacattgatcaactacgtaaattctatgtatagaatcaatgtatctcagtaatatcaagtaaatttcccaaaggtattttttgaatacttcatgagatagttttctacccagagatcccttaccacgacaatacctactattgaaatcgaacctaatgtccctttatgccagtccgacaagcctccgagaaacctatgggaatttcggctggggacgcccagagcagataaggccttgtcggaccctaagagccaaacgaccatgtcaaacctagtcatgtaagagtgctcaatgatggcgcattaaccaagccgtgtaatcggaaattgacttttccaacctcacggctaggggctaggtaatcgcgttttcaaataggcaagtttcgggtcatcgagcgttctcctcggataacagatttctccgaggagaaggctgggggctagggagagtacccgactcaacaataggcaaaaatagcctgaataacgagtagtactcgcacatttcatacaccattcaaacacttagtaaatagatttctgttctatttacaaaaacttaacatttatattacagacactcctctagatattttttttctacagggaatgacgtctaccaagagggccattgccaaaccatcgacaaaaagaccttctcggcaaggggagcaagagaacgagccagatggtcaacttcactcgccgacagtcgagaacgggcaaatccctcacgcaagaacccgagattcatatgcggacgtggatctcggatgcaggcgagtacgtgacccccggcataacggctagcgcggcggcactcctcctttaggcagttgtcgatccgccgtctgacatcctctagctgggcacacgcacccctcatccaggatagatacccaactgtcgtctcctcgggctctgcacgatcaatcttgagctgccggtagatctccaacatggagatacaacagctcttcaggtacgagttcaaccagaccttgcgccctcagagcgtttcaatagcctgatccttcttcacgaccacgacggatcgttcgagctctgccaccttaaacttcgtcctccagtagagaacttgtcgatctcgctcgccaagcgtgttcctgagatctacaaagggcaagggttcagggagttttgccccgtaacaagtaaagcttcaggagcaaaaatcctaagatatcccacctgagatctctcggaggagcgaggccacgtcgagatctgacaagccagatgcggcatttacatccacagacgcgccgatgaccccaccaatgtccgacgaaggcattccactcaatgaaaattggttcgtcgcatcgacatcaggatgtccgccttgctggacgtcctcaggatcaacatttctatgagaaggaaaacatgctacaaataaacgaatcaagaacatcaagaaaaggaaattgttccaccaaagacaacacaaaagaatctacacagaaggagcacaaagcagagaattactcctcgaaaagtgggaggacggtctccccaagatccgccacaacggacatcacgtcctcacgcgtggcatcgtcagcccccttagacaagatccccttaagatcggcgttagggagagcgagcttcacgcaagcgaggacatgacaggcccccgtgtggatcccgttggagatctcctccgagaccttggcggcatgcttagacgggatgacctccatcttcgtcgccagctctcctagcgccgatgtcagggaggtctcgttggggtgcgcagggatagaagacttcacgctgcactccagggctagctggtgtaggctggtgaagctcttccgaagctagtcgccaatggagaagatatgatctagcagatcgctcatcctcttctccaagccaagacgttgcatctcgttgccggccacgatctccatcttctgaaggtcgtcatgggcgacttcgagttctgtctccagctgtgccaccctcccgtccgatgacatagcatgggccgtcaagcggtccatctgagcccctacctcccgagaagtgttctcaaagaggcggcggcactcggacatcatgtcagaccagtcctatggccctgaagacggcaccacagtcgtagtcacgacagcaggctcggcggactcggcagcagcaggtgcagacttcgcacgaggagaggtgacaacgggagtcccgctagtcaccacctcatcgccgctctgcgcggaggtcgttgaagctttcctgcaagtacaagaaaacatccctgataagctcacagacgcgataatgaagaaggtcaagagattcacttacttatcggcggccctcttcactaacctcctcttcagaggaggggggaggccaccagtatcctgagtaaaacagcagatcacggctttacttcatcatccaacgaaagagaaaaagacaacggaccgagaacgatgggccttaccttagatccgcggacttctgtcgagatccggcggaggcgcttgaccgagcccacggcttcctcttggtcccactcccccatgcggtgacagggacagagggagcagcggcgacctcctccacaaccttctccttgagggaagcggaggcctagtgatcgacaaggggaccgatgacgtccatcaatggcaggacctgcaggagttgaggtcaactcgatccttcgttgaacaaagaagcaagaggcgttcgttctcactcacattgatggcggcgaccttctccacttccggccggtcgcagataggagtcgggatctcctcggccttggaggcggaggtaatcaccacattccccactcgctgcaccacggcgtcgtcggagagcgctgcggaaagggcaagtgattcaagttaggtcagaataccaagataatatttatgcgagggtgagcaacgatgacacaagaacgagtaccccgtgacgagatccgcgtcacgtcttccgtccccgtgtagccgaaaatgggatgagcgcgagcttgcagcagctggatccgacggctgacaaagtcttgagtgacctcatagccggtcagcccatgctctcaaaggtcgctcacgatgacaacaaaggctaggagggaaggagttagaaggggtttggaggtctagctatcagaacggtcaggttgattctcgggcacaacaagaactggatcaagttccttacgcttgatgtaaaaccacttggaccgccattggccccgagatgagtggttctggaaaggaatatatctcgccttcatgccgtcacgaaggcggaacccacaacatccagacactcgggtgccctccatccaacggagttcgtaaaagaagcgaaaaaggtagatgaaaggcactaccccaatgtaggcctcacaaaggtgagcgaagatgcttaggaaggcgatggagttggggttgagatgcaagagagaaagaccatagaagttcaatatcaacaaaagaaattccgaagggggaggtaaaaaaccacaacggacgaaatcctctaccactaccatgcggcctagaccaggagagggttcagtacctccttgttctctcgccatggtttgcttgggagggatagccccgtctatatagagcttcttcagggaagccgtatcggaggaagacttgctgaggtccgccatcggatgaggatcaccaggggaggacgaaggaacctagggaattttggggaagacgaaaggtttgagactattggagaattggaagattttttggcaaacggacttgaaatggatcccaaaaatccctttaataagcgcactacctggcggtcagaattttaaggagagagattgccgctgaaaaatcctgaggcctgttaagggcagttgttcagacttcaattcaaattcatgtttaagctgtcggacttccatatgtgttgtcggtagcttctaaccttcccggctccgcaccgagaacgaccaagtgagcacgacaagccactaacaagagaagtcatggatgacaacatgaattcatttgagttgaagtcaggggctactgtcagggttacggataaggcatacctcctatcctacgacttatggaatataccgataaggtataccttcacgtatacgggttgtttctgtatatgttgcgtggaaaccatttcaaattataagaaatatctctacgagtcaagtgatttccaaagtcctactcggaaggtatagagtttatgttataccgtactaggtccgatatcctcaaaccttccttggggatcaggatgatcgacagtataaaagggaccccctgggagaggttctagggatcgaattccatcgccaacacacccaccaaagttatgaagccagagtacgtggagccaactcgccgggagatcacgtcgaatccctcgactacgatctcgtctgtaccatctgttttgactactgtctttgtaatttgttctcgtcagcatcaatcccatataaactggactagggctattatctgataaggggactgaaccagtataatccttgccttttatctacttgatgtcgtactacgtaaaccctcgttccaacataccccaatcctctacttatccggtccacgagtatcactcgtcgacaaatacatgcacaaatttatttgcgaagtggctgatttctatataggtttgcatattgctttttgatatttgatcagtatacctgaatgaaatggttcactgtgcccaaaaatgtgttcattggtgctgacatggttaataagttcttatatcccctgtagatagacttgtgaatatgaatgtatcagaatagctatgacactgacaggtcacttcgatcgtcctgtttacagtacttttctttaccatggctgtgtttagttccatgccaaaattggaagtttgaagaaattggaacgatgtgacggaaaagttggaaatttatgtgtgtaggaaagttcaatgtgatggaaaagttgaaagtttgaagaaaaaagttggaatctaaacagggcccatgtatgagtagcaatatctatgaactgagggaagatcaaatataatggcaaatcaaatgagtcacaaggacacagataagataaaaaaacaccaagtcaccaactagagctgctctcaactaggtgtgaaaatgtatgttttgaatttagtcttgatcaattcaggtaattctagattataagccccaagaaaatatgaattttaaattactctaatttttttcacacacactatttttcatataaaagtcaagttatttttctccacttccctccctctgctaatttttcacttcgtatattgatcattagcagaagaaaatattcagctgtcgggtcccgaaactaatgatttgaaaaccgacttatttaactgtatcaagccctgtatcgttagattgatacaggttcaacgatctggatcttcatcgcgtatatttggtcaaggctccaaaagagatgttattacataaaataatagggtatttataaggttgtggctaactactacagcagaagctatagaatgatttaactctaatgtttggctataaacttaaaccatctatctaatctctacttgagaattaagttagaataaaactaacttatgtgattgaactcccagcttcgacaaaaactccaaatagactctgaaaaagaggggttgaagcaagggtgagtacaacatactcagcaagctattatatcaaatatgaatgcatgaaatagtagtatttgagtagggctatgaatacttgcagaaagcagaaaatgtagaagtacaaagcctgtaatgattttaatgcaacagtatctaataaaatcttgaattatatttctaaccaagatgccattgcgagtcccgatgctcaatattcgtgagcatagctattcgaatagtttcaagaatattcatactgcagtagatgtacgctttacccgcaatccatgacatgccaatattcattagcttagtcatggcaaaacttttcggttactaacatcagtggcacctgttccataaactataatccccatgcgctctgaacgtaacgttatcagtagcgagaggagttctggcgttcccggggtttttagacagaactggttgagagacccccggcatctcaaccaggttttcacaattatatataaatataaataaatatatatatatatatatatatatatatatatatatatatatatatatatatatatatatatatatatatatatatatatatatataaagcgctgtgcgccacgaaactaaatggcgcaacagacatggctgtggagtaatggccgcggggccattcccaccatctcaagtggaaccgtaagtaatattttagagcaattctatggtccttgaggacgtaccatgaggtaccactttttctattgtaaatttagtatctcttgatactttggtaccatgaggtaccaaattttacactaaatttttggtacctcatggtacctcctcaaggaccgtaaaattgctcaatattttaactaatttgagaggtgtgcacgattaattaactcaatccatgtggtagatgaagcatgggtgggcacggagggatgttacatagttaaaatttgactcgaaacgacgtgttgatgatctcggatgacacgtgacacgcctgtaggctaaaattgatgtgtacggagtaaaattttgactcataaagtggtgtaggtagtggcggattggattgactcccgtgataaatgaagttaaaaaatagagcatttttactgtccttgaggctgtgcagtaccaaatcgtgaccgttgatcaggcctcatcggacggtcaaaaatcatctgtacctcatggtaccgcacctctgccttgaagcggtaccgtgggtgggagggtagttatgtactttcgcgtctattccgcatcacgcacgcagcatcccttccttctctgtttccttctctgtttggcgagagaacagaagccgcgtattcgacgggctagagcagcgagagaaagaaaccctagaatgcatggcagcgatagatggcggcgggagcaggttggactggcgacccgatggtggcctagatcgggtagccccggcgaatcgtcaacggcggcgggcgcggcagtctggatgcgacggctgcgctgcattggcggcggcggcgattcgtcggcgacggcgggtatggctgtctggatgcgacggctgtgctgcatcggtggcggtggcgattcgtcagggtcggagggcaacggcctcgatgcgacggcggcgctgcatcggcgggaggccggcgatggttggatgccgatgaaactgatgaaattcaaggataagcgagcaaccctcacaactggatggaatgctttggttggagccaatcttttcgagcaagctgatgtttgtgtgtttctgttcactgaagttccgatgtaatatgtctatcagtcaattctagtggtatggtttgcataattgatgcccctgtttgtgtgcattttgtatggatgcttcttgcgagatttattactggtgcatgcttgctgattatttgttactggtggatgctgtctgcggaacttaagttggtgttgctgagatgaaatacacatatatgctgctgaattgactgtgtcacaattgcagtttgcctgaacttattgctcctcttgctggaattactgctacaaatttaaatttgctgcttggtactgctttttgatgctgaaaactgaaaattgctggcactgctgcttcttgaacagagatcaaacttagaccaacaagattcaagtacttactttatgaaagttgtacaagatacaaacaacaatggttgaaacaaattatgcacacggcatacaacgtaaattcagctcaaacttagacaaacaacaacatcatacagcatatttgttctgctaccaacaccttccactgtacacggcacagtgaacctgccaaataatttaccaccttcatcacttcttcaaccataaaatgtatcaacaaataacaaatccagatgaagcacatttcaaatttagttcttattacgacagagtccacaccagatggtggaaaagatgccggagtcttcggggtggctacgacggtggatgggacggggtggaggcggcgatgttgatgcgcctgcgacggcggatgcggcgggtggagacggcgacgtctatgcggcggcgttgaagccacggcggccgtggcgtggtcgatgcgacggctgctcggcggcctcgatgcgacggcggctgcggcggcctcgatatgacagcggcagacgcgtgtgcgacgcatagccgcggcggcctcgatgcgacggaggctg

SEQ ID NO: 75762 - DNA, 6884 bp, Oryza sativa
acggggtgcatggagttcaaggtgacggtgctcaggggctgtagcgaggaaatcttaatagtgacgtggcacaggactttttcaataacttccaagatcgggttgattacgctgtacatcatgctttgatcaatcagtctggggtgttagtcaataccctgtcaaacatgatgaagtcaatagccgatggttcaatagctgaacatcaggctgcaggcctggtctatttgcaaggaggtgtttttccaaattatcagtctttgattaccgacgttcagtcatctactcagccagttccctccgttacacccacaacttagccgacggcaccggcatcaactcccctacctgctacatcagctatagcgccaggccagccaatgaaccctcggctattaatgagagagcatccacagcatagtgggcaggttgcgaatcggccaacccaaggtcaagttgctgcaatgtttttgccgcctcaacatgcggttgatctaatacagcaacagccgattcagcaacagtcgattcagcagacaccccaaattcagcaggttgtgcaaccaatccagcaacagatcatgcaaccagcacaaccaatccagcaactggtcatacaaccagttcagcaaacaccaccaaggcagcagtctctgcagccgattcagcaaacgacgttgaaacagcagatcgtccagccgatccagcaccaaggttcagtgagcgcatcggccgggtttgtagcgcctggtggtcagcctgtacaacaacttttaaaccaagttgtcccagaacatttggttcaccacgtacagctggatagcacagtaatgcctcaggttgttcctgagcacttgctgcgtaatatccagccagaccctcacaattactaagggggcaacctgagttatcaatatcaacctccttccccgcaagcccaatatcggccagggggattggctcaacctcagtttgcatcccaatacggtcagttcgagcccatgcagcgacagtcacaaggcgcaactcagcaacgaccgtgggccgatgtaattgctgacgtaatgagggaacagtttgggcttaaaccaaaagagactagaaacttgtatcggcagccttaccctgagtggtttgaaagagttcctcctcccaatcggttcaaagttctggacttcttcaaattttcaggacaagatggtgtgtcgacttatgagcacattagccaattcctggctcagtgtggtgaagcatcggcggtagacgctctgaaagttaggttattccagttatctctgtctgaatcggcttttacttggttttcctccttgccatatggtttgatcaacagttgggccgatttggagaagcaattccacagctatttctacagtggggttcatgagatgaagttatctgacttgacggcgattaagcagcggcatgataaacctgtgcacgagtatattcagagattcagggagataaggaacaaatgcttcagcttgagtttaactgatgcccagttagccgatttggcctttcagggtatgattgctccgattagggagaagttctcgtctgaagactttgatagcattatagccgatgacggggggagatggcccacctccgttggggatcagtcctggggcatacttgatatccctgccgctgttgctttggtgagggggagaagattctgttgtctgcaaatcaggaggaaagttagctaagggctaatcaaccaagtagttattcaaataaaatcaagtgagttaggacttacttgggggacaatatctggaaagagatctatcatatacatagaagccaattgatggaataagtgtagcttccattcaccccaccatctgtcaaatactttgctcctaaaggttgccagctttatggtgtcaatgctgcctagaggaggtccttggagattgagcagccgatccatcattaaagatgatgagatttctcctcggcattggatcttatcggcaaagaataagccgattgggagttggcccattccaaattgtctcgcagaactcattggatgataaaactcgtaggaaacttggatgtttctcccttgatgaatgccgactggaaggatgcatggggtgattgcagataagaagatttctctgggcttctgatatctgtcattgttgatgtcttcgaatctgaagtcccatggattttccagaagtgttgagtcccatggacggccgtccgatcaaatggacggccaagatttcgccttcaccgctgaaattgctgcacgagtcaaaccctaaccctaatccccatttctcatttcatcttcctcccttttcctcgttctcttctccggcgagccagagtgcgagtaagagcgaagcaatacggcgggaatggcaatacggcggtccggcgaagcaagagcacgcaaggggcgtcgagcgccgagcggctccggaccttgccggctggggggcggagcacatggcagcgccaagccgtgttgcttttgcttcccgtccccgacagcaagcggcggtgacggtccagcgagcagcgcgcgtacgagcagaagggactccgccaggcgccccgtgctcgtcggctaggggggcgcgcccgagggcggcgccaagccgatgcttcccgttcccggcgagggacggtgacgaggtcctccaagacgacgcggatgcgacggcgaggaggtgaaggagcggcggcgccgcttcccggagggctccgacgagcttaggatttcgaatccggtaaataacccaaactcgaattaattggcttgccaagatttggaattttggttctttagggttcttctcaattttggggatttcgggtggattaatacaatccggcttatctagagttctacacccgaaattagggttcttagcttcgagattttaggccgatttgatcgggctgattgggtatttttgggaaattagggtttcgcaaaaccgtggcttaattccctcttgcttaacagtggggaatttcaatctagtttatccccaccttcttgattgctaagtgcttcccgaaaccatagctttggtctaggaaaatctaaatgcgagaattgggaatttcaatcttgtttatcccaatccttttcttctcttaaaaacaatgaaattaaactcttcaataattttgcttcttctactgttggccgagaccaacagtataacagggcttagccaattatgcaaccaaggcaaagagattaatctagtctaattaactcaaaattgcatcatgccgaatagcaattagggtttaattggcataatggcttcacttaaggatgatgggatcaagaaggctaagattaggctctgataccacaatgttggaatttaatccaactaattaattgagtcttagcctaaacataataccttatgcttatgcggaaattaattgatcactgacctgagatgaagccattgctcttcttctttcttctcctttgtttcttctgttgtgagatacctcacgaaccccttccagtgtctaatcgatcgggcgattgatttagggtttagggttggagagagttgagttgtcacccatcctccctccttctctttttttatatagcgacactggtggggctcgggggtttatctcaatctaaatttgaatctattttgtaccgatcacacaaaacagatttatctcttagtttgtttcttgttaggataggaaaatcggtggaattttaaccttattctaacaaaccggcattagccgataaaatcaaccaacatatcaattagatggtctacttgatccctgagtctgtccagcaaccagaagacaaacattttataggctgtgtttagatccaaacttccaacttttttcatcacatcaatctgtcatacacacaacttttcagttacatcgtaccaatttcaacccaaacttccaactttggaaggaactaaacacagccatagttgttgcaaattgcaatccacttttgacagcgggatgcctaacttggcacaacccacatggtcacagagcttggctttattattgttgttattatttgaaattagtattatatccgatagaacacttgtggccgtactataagaggaagctttcaatccgtagtagtccgtactttcgtcgagaggacctacagttttgctagaacgcaatcatcaggtaccacgtttgcttttgcgtcggcaacagctccggcagtgagccccttgttcacctcctgtattagcctctctatcactggattcggcaaccttatgggcacaatgacgcctgcctcaccaacctcattcctcccctcaaggtgaaacgtggccagcattgtcgtcgccggccctccatacaccggctttccccagccgaagtcgatggccatcagcccggcctgtgtcatgtccgagatgaggtacgtcctggccttagggaacggcggcctccggtgagccgcgttgaagttggccaccgactgcacatacccctcctccgacgcacgcgccttggcctgcatgagcagccgcagcgcgtagccgaagggcctccgccaaagctcccccgccggcacggacgcggcagcgaacacaatcgcgttgccgtagtagcccctcggcacgggccgcttgctccggttcctgacgcgggcgttcacgaacatgtgcaggcggacgacgtctcccgggtcgtaccgcagcgcggcggtgcggcagcgccacatgaacgctcccaccaggtcgaaccgggagctgacggcgcgcaggtcgggcggcgcctgcgacctgagcgccgcgatctcactcgccccaaagaagaagacgtggtgtgcgtacgcgtcagtgggggagagcacgtccttgccggggttgggcaggggtgtgtactccacgtggtcgcgcgtgacggtcggcggccatcgggcggtgagcacctcgcgctcccacaccgggcgcaccgtcggggctccgtgcacgccacgggcgaactcggtcagtgcagtcagaaactgcactatcccagagccgtccgccatgcaatggcatatgtgcatcccgaacacgaagccgccgcacgccagccgcgtcacctgtgtcgtccgaatgcatgtaataaccatcatttgttattagacgtagtacgtaccatgcatgaattttactacttcactgtaaaatgatttgcatgctaataacctgaataaacagcaaaggacggtcaactacatctgccgtcgggctctccggctcgcacagcaacatgtcatagcacggcaccggcggcgccagcgacgtcccgagctcatccatccggaagttggcgtcggcctcgacgaacacgacgccttcgccggtgcactccaccacaagcttcctagttggccgcagctcacggaaccgaccggcgacggggtagaagtgcacgagcgtctccgagatcgccgccttgatcaccttgacagggtcgaggccgtccttggaggggctgtggcggtagaagaggatgccggagcggttgaagcgaaggatgtcctggtcgtcgatgtccgacagcatcttgaactcgtacggcgtcggtttcgccggcgccaccagctcgcgctcgcgccgcctgacggagaaggctaaggtcggtgctccggccatttgcaccctaagtagctactaagccactgagctacgtgagagtacttgttgattataccaagattctttgatgtgtacttgtaaggtaattggaacataaattttgctctatatataggcgtgccacggcgtacgagccgagagagtcgatagattttgatctatattcgatgtggacagagaaaaaaaataagtttgtaaaatgatggtaaaaactagaccattagccgagagggtggtgaattcacaaattggctaaaccattaatgcacacataactacacgaggaaaaaaatggctaaatctaactaataaagaagatcacatttaacgtgtagttagtcgattgaaccaatgctttccagataagtgacttcgtgtctaacaatgcgatattacagtacgacgatgagttttcactggcagttcctataggcttctagcatcgtcctggattgaattaagcttcggccgcatgcgttcggtagatatatatatatatatatataatagttctgattccccgatgtaaccatcaagccatcgaattagtgtttttttgtcggtgtgaattcatgtcgcgttcattctgactgtccaaagaaatcattgtatgtctgtgtcgcttgatcattttcaaatgtggctccaaacgaatctgtagggcacaccgaatttataccgtctggtgtcatttgtgtctaccacatacttttgtatgagtgggatacatacacgcataaatagccaatcaaagcacatgtacaaaaagtgattttggggctaaagtcctatttattttcctccatctatttcctaccaccttcataaaaatttatccaaaatcataaaccatgccatttacatttcctttccttcctatttgagtgcttcaatataaatttccaattctctttagtatcctggaaaccctatttgaattctttgtcaacatccaaagagtccaaaaacaaactcccttagttttcatctccttgaaatcctatttaattttctttgccaaagttcaaaagtccacaactatttctttttaattttcatctcctttgaatcctattcaaatttatccatacaaaattcctagaagttaccattctttcgggctgaaatccccatcttttggcccatccttcttttcctctccctccaccctttctacttctcgggctggcagcc

SEQ ID NO: 75763 - DNA, 2801 bp, Oryza sativa
aagcaacttcttgcggctagctaatgaaaccttatccataatgcttcatcgcgaaatatcttttcgccccgctcaattcataaagatatacactgccaatatcaccacagcctatcttcttgaacaacctgaaatggctcaacccaatgatcccatctctcaccctgatcgtctggatcgcctcccaccgtgaatcattggacttatgaggcttcgtggtgctgctcatgctgctacacgaactctcatcactgatatcactgctagtgcttggcctgcatctgctactactacccctttcaccggtctcggatcgatccgtcatcctagcacttccacttgcttttcctggaccactcccttcgcatgtgtgaaatgaggtgaggttcccattcacactctcatactccccacccttcttttttgacctgccataccttttgaaaccatttttttgctcatttctgtcggacacttggccgatgaaacatcaacagactctttcaggtggtggtttggcttttgttcctttggctccaatttatgattcaacttgccgcggtctgattcttgtagcaatttaggtactgaagaacgagaattgtttgatttggggatgtctggagcagtcttagtatactgctgtggttctggggtggttgggatttctgggagggtttgaggaattatctttgaagccgttgtcgccatgactggttatttatcaggcaagatggccaaatactgccacaagctatagttaatcaaaatagcaaccttggaatagtgatgaaacttccattcacatctgcaaaggagaaaaaaaaatctgataaattcaaaggtgcattcatgaaaccaactatcattccatgattggactaggaggtaaagattcaccaaacaaacaaaagagatgtagtggccaacaacaaactaattacctgattaagatatttaaaagtaggcaagtcaatcaatggtttggtttcagtcaagaaaactaaacatcaagaaatggcctccacagtccacacccttctccatcaacctcccctcaaatggacacttaacactattgtgtgccacacacaggaatttgtctgcttaactacgaaagctaaagccatggagagctccttcctatggcattaaaaccatcaatcctgcctaaccctccactaaggccaataatcatgcaacacactacagatctagcgttccctttcacaataaacaagtgtttgatcagatgagagcacatgaaaggggccaccaaaaaaaagagagaaatggcaaatggagccttttctttcttctaaattaaacagcatcactctagttgagcaaaagctgtgcctgttgatgtattccttccgagaggttgcataaacaaagtggtagcacatatcaatcggcctacctcgttccagtaaaatgtcaacatgtcatttgtgagcgcagaaaggtgaggaaagcaagaatcaagaacacgcccaaaggaaagcccttttctcgtctctctgcaaaatgcagcagactgaaatcttacattctttgcaagaaagataaaaacagagaggaaaaggtttactacgatcaacccaaggcagatctacagggccaaagcaaaggattctctgaagaaccgaattgggcaccaaaagaagagaaaaaggcaggagaagagaaatctcaccagactgaactgagcccggaaggctgaacccaactgctcacgaatcaaacaagaaggaagatgccgagcggtagcggttttctactcaggagaggcgttggatttagcccggtttttccacgagttctcgtgactgtgtacttgagctgttcgtggtggggttcagcaatgtgctgcaaaaatggatgcgaggaggagggcaggaaactggtggctcgactgtattaaaggttggcctcctcatcaccttccctgattttatttttctattgcttttgttaatcccaaatgcaatgatcttgtctatagttttgggtccctgaatatgatttttctttttaagaaaaacaaaagaatgccttgttgatgttgttgctctctgtctcaattattagccgaccagaatcaccaagtttaccatttttggagcttgacgatgtcaatttctacgtagccacgttagattagatattccttgggctaggaatttgaatctaacttgaaagttgaaacatctggaactgtacattattttcaacacgttcctgaaacagcccagggcctaattgtacattattttcacatgaataaattccttgggctaggaattattgttatcagcattaattaagaaaaaaaaacattccaacaaattcccaccctgggctaggatagaaaaaaaaattgtaagccgtaaccaaaatctaaattctgctagacctttttttatcgttttgtttttttaaaatcatgatttttaagtcctatcctgacattatttttctttgcctcatttgtttttctaaggcttcaaattaaagccaaataatcaataagacatgacaaaatgcattccggcctcctttctcaagtcacttcattattttattttatttttatagatggagtcacttcatttttactgcaactcccaacagaactttttcttgcctctaggagtagtactctagagacggaatcagcgccaaaaaaaaaatgaagaggaaaaaaaaagaactagtacttgtgccaatcaccagctcatgatcgatcgatctgcttcgaagtccgggcggaaagtaaaaaaccgcgcggtgaacgg

SEQ ID NO: 75764 - DNA, 2707 bp, Oryza sativa
ctgtgccgttgtccttctttccacgccactgccaacgaattctccttctccttctcctttgcaaccgcctccaatcaccgcctctcgccgcttaaaagtagacgacgagtgtcacgcccagaaattcactaacccaaatttcaagcagaatgtgtattaaatctctatccaggaccagccagagtacacaaatgacaatttgatacagttccacctcttacaaaaataacaaaaataaaactcatgcgcaacgaaaaataaaataaactagacttaatcttcacaaccaaagcgaagcttcctccataaaccacaagaaatcatcgacgtctggaacaagctcaatccttaaagaactcaccatctgaaccaacctctgcttctggggtgggggaaaaataaagtaagaccgagtaccaaccaccgtactcaacaagtcataccaacaggaaggtatgatgcaaggtactctcaaaggaatggctcattggataatttgcagtaaaaacagcattatataaatcatattttgaagaagtaaaaacaatatataattaagcaatactaaatcatcactgtccaacgctaaaaccatgttgaaacaggcccaaccaaaccacatgaactacaccagttctataagtcatattattatagtgagactaatcacggtgagctggttgaccgccgaataaccgcgggcacagctattcgaatagttttaactctgatcagaggtgtacaactttacccacaagacacgattccacacatgttaccatatcccgaagcaccaccgagatactgcaaaaggggaaatcgtgacaaaaaccttgtgccaagtcaaacagtcccctctcttgcctaggtaaatccggctacaacagagaccaatatatagatccgaactgcaccatcgcctctacccttgccatgctatgtcagctagcttaagttatactctagatttagcctagtgcccatctagcctgtggtgagtatgagtacatcttccagggattcttgagaaccggtccttaattatgatgaaccctgagttccactcgacactcaaggctgttgttggcccgatctttcagtgagttgagataactatgatttgggagaaacgttgacaatccgactacaaccgtacgagacgttgtgctgcgccttagcgatcgatacacctttccgtgggttgttgatattgccggtgcagatcaaccctattcctgcaagcaaatcgaagaaacaagcaagaacaagataaaagcaatctgatattgcaaataggaatttaatacaaatgataagttggggtttcgaatacaagcagacgggcggtctagccggcacgcgcgctgcaagcaagtagcaatggctaaactttaatctatcaaaacccaagaaaccctgaaggggtacctacctatttataggggtgggaggacgaccaaggggtgccaagagtcgttctccacctggttggggcgcaccccacatgggccccacttgggccggggtcccagacgaagttacaagcccataggcccattacaggtgacgcagcaccttgttgcttcaaatgcggctcactaagatggaatttctcaattaggctggatctgttggaaagaggactccgagagctttccatcaagtactcacgggccgaaaacggagctcgtatggagatttggcggccgtttgaaatcagcagtgcagcaggtggccgaatcggattccagcacttggaggccttgaccttgatgtctacttgttcatccatgatatgagcaatgattgtatccgtagtagctatggtcacatgaaattgtcaagggcatgacttccaaaatcatgcatgtacccacaacccaccattaaagcatattttagttttattaaaccataaccatggtgctacatcataatataattaaggactaaattataatgagtcccattgtgagctaattgatctaagcatggctaagcattcctaaaccaatcatctaactcaagttatcaatggcataagatattcaatagactgagtacgataggcatccatcccacatgacattctaaaacaatgccatttgatagaaagcaagggattttgtaaaattggctcaatatgatcaatgatgtatgcgtgacttgccttgctcttgagctgactgaacctcggcaatcacttcgaagtaaactggatcactggaactgatggaatctaaacgacaaacaaagcacacaagaaatacaagcaataaggctactaaaacagaaaaagaaacaaattttaatggattctgttcattttaacggattcactgcaatttgaatgggttaaaacggagctcaaattattagttatgaattttacaagatgagctgtgttattactaataatcgaaaaaccttagtcatttattacatattattgcccatagataaaaagatcaatgaaaataaacctccggtaagcaagcctcacgaattaacgactcaacgagccaatccttcgtgacacgggactatccaaacggtcaaccgaaccggcgaacaaagcggcggctcagaacaacaaccgaaaactaaacatggtttatggcaaagactcggtacggcaaacgataggccagtaggaatttagcgatgcacctatggctttgcaacatggctaccaagatacgacaca

SEQ ID NO: 75765 - DNA, 2059 bp, Oryza sativa
cacgccatgccattgcagccgcagctcagctcagctagcgccggtcgccgtcgtacagtttgcccggtaaagggtcatgggacgccatgaagtgtgcccatctgcctccctgtcctccctctcctttcatcttctccaaggcttcaagctcaatgtccccagcttagccaatcatgcatgcatgcgtgttagttgttagtttacataggagtactacacttgcacgttgatgaaaaaaaaagctttttctaagagtatatatcatatgaatgtccattgtttgcaagaaagtaacgaaaggagagacagagacagggacaaacagatagtacaaggtcgagcggctatggacgttgtggttaaatagaccattagcatatgcatgtgtgccactgtgcagctagttaattatccaaaacggcacccaacgggtgtacgatgtgcacgattggccaagctattagcatagcatggagtacaggataacaggaacccgtcgatcaaggtcaaggcgagattattgacgccatataaattttaatcaccgtagggcgataggccaattgtcagctacagtattaacgtagttaattacctcctctctccaccagccgttgcacaattgcatgacctgacgacggagcaccttaattattccttggctaatttacaagctcacaagcagagtttgattccgatttctgacctcttaatagtctttttggaatttctgctatgacgttcggggttaataccggagacaatattattacttatttgggaaaatccagaaaaataccatcgacaagctttccaatccaaagaaatacattttttttgcgaacgccaatccaaagaaatatcatcgacaaatttaacttcttagaaattaatgtcattgtacaaatgtctttatcccataaataccatcgctgttaggtttccgttagcaatcatttgttgagtgctataaaaagatcattttacccctacgaattgctaaaagatgattaaaaattttgctcttttcataagcttagactaatttctaggtcgttatttgcactaaactgttgttagttgactcgaagagcaaatgttttgatgagttttcaacaattcgtacgggtaaaatggtctttttacagtacttaacgaggatctactaatagagacctaacggcgatagtacttttgggacaaatgcgtttgtatgatagcatttccatgaagttggatttgtcaatgatattttttgaaccgtgaggcttgttgatgatatttcttgaattataacaaaatttcattataccgattacgaaccccaagacgaggctaactagacctgaagttcatataattaagtatataacacctgacaagttatgatcaaactactaagtccagagttttatctagggagcacacgcagtacgtgtgcgttggcacatggatgcaggcatgcagccgcttaattagctaggtacagtactgttcttgatggcatcttaagaatccataacctcacaacgcaacatttcaacccctgcaattactcaatcaacagttgctcccccattgaataagctgctcctgccttgccccgttgagaggaggcatgtgcagggcacatggttgatcagtatagtgcactgtcaaggaagcatcctttggaacggagacctgtcactgtcttcttgtcaagtccaaagtttctgcagcgccagtgagagagatttgctatacatccatcatccatgtgagggaatacatgaaagtgtaacgctgaagagaaaaaaaaaacttaattaacacgttacattcaaacatgcatagcgtagtgataaagaagccggcaataattgttcttggagagactgttcaagagaataaacacacacatcagtgtttacccaagaacaatgatgcgtccactggtggagaaaccatctttcgtcggtcggccgatttccacaatagtcccggatgcaataaaaaccggggctaaagatgatctttagtccgggttcaaaaaggtaacgggcatatttgatcttta

SEQ ID NO: 75766 - DNA, 7156 bp, Oryza sativa
ctgaactctcaagaagtggggaaagaagctaacatgtgaaagtagtgtcgaccacgaacaacaaaagattatatttgttttttttcgccgggcaagattatatttgtcggagcaaacgttttcaaatccaccagaccagaccaccacaacattagtaagaaatactccacttcaacaattttagcagatacggcgtactccttacatcttgaaccagcgccatctgaaagcaccacctcaggggcaatgcacgccgtgactccaacctcaaaaaccaatgctagctgaataaaattgcggaagagcgcttacttacgttcatcgttgggaaggggggggggggggttgggacgcgctgacggcggagagagccccgccggcaggtgtcgccgcctcgccggagccggcgactggaaccgccattggacgggggaatccgaatccctaggtgaggccctaattgatttgaggcccaagaacatgggaggaattccgttcgaggccttacattcacatacggcccatgaggaagcttcacactgggccactttctaatgggcctctgagtagcacggcccaatactccctttgttctaatgcgacgctgtcagactgaaactacgctgaagaaatctcaatctctcggtcgatttttaccacccgatgttatcccttcaaccgaatgaatggattacggatctaactcatctgtacttgccacacacacacaggatgaactgaataactatgaatgctccggatattgctgttagctgccaggcaagccattcatcaccaaaatgatgggaacaattcatgctctctctgtccctctctctcccggtctgcagcggcagccagccagggtttcattacgacagaaacctgaaaaagaagaaaaacgtcagcacttgagagagcatggggttgggtgacactgccacgtgaatgcggttgcatttgggccggaattacctgtgcttgggttttgcctgccatgtgacccgcctcgtttcgtttcacccttgctcggcccgatcgatttgcagctctgcacatgctcttgtccggccaccatggtagtaagctatgctatgttagtataggaacccttttggagctgttccaacgcagatggtgccactccagttttgggccaaaataatggagcctgacattggttctaaatgaaactatggtatgtttgagagagcttttggcagctgcaacctctttcaaaatcaaaagctctccaaacaatacaacttttcattaagattttgtgaatgatttttcttgagtaaaatacaccaacagtccttaaacttgtcgggaggtttcacctaggtccacgaacttacaaagcacatatcgagatccctaaatttggtttattgtatcatccaggtccaaagccacttttgaccgtggtcttacctacgtgacacgctacgtggacgatgacatgattttttttatttttttctctcttatcccttcttttttctctttctatgaaaagacgatgacatggacgatgatgtgtacgaggcattttcgtcttttcgacaaggaagaaagagaaaaaaaaggaagaagggagaaaaaacaaaaaaaaaatccatgtcatcgtccacgtggcgtgccacgtaggtaagaccacggtcaaacgcagctttggaccgggatgatacaataaatcaagtttagggacctcgatgtgcgctttacaagttcgtggacctaagtgaaatcttctgacaagtttaagaaccgctggtgcattttactcatttttcttcttagcagctgcaacctccctcagaatcataaactctccaaatagtacatcttatcatttagattctgtgttaatggttttccttacggcttatcgaaatatatttgaatgaaattttcggcagatgaagacattcctatgcttgcatcatcaatgcaactggaccaaaaaaactaaaaagagggagaatgacgtcaaaattggaccccggaagaaaaaaaactcacagaaatgtagaatgtgacacattacgacatattctgtcacgacccattttctggccgcataggacagtcatgcacaacgcaaacggcgacacgtaagttttgcaggcgcgacgcgcatctggcaaagccaatttcgcccttaaaaaccaagggcgcgcaacggctcgtcgcgtggagagcaacgctcgctgcgacctgcgacgccgccccgcgccaacttctctccctcccacctccaccacctcctcctcctcctcctcctctcctacagcgccacaatgccgcgcgcccgcgtcgtccacgtcatgctcctcctcttcgtcgcgctcggcgcgtgccgtgccacccacaacatcaccgccatcctcgccgaccaccgcgacctcgccgagttcggccgccagctcacggccacgggcctcgcggacgacatcgacgggcgcaacaccatcacggtgctcgccgtcgacgacgcccacatggcgcagctcagggcgcgcgggctcccgcgcgaggcgctgcgccacgtgctctcgctgcacgtcctcgtcgactactacgacgacgccaagctgcaccgcctccccggcggctccgcggtcgtgtccacgctgttccaggcgtcgggcgacgcgcccgggagcgaggggatggtgaagatcgccgtgcgccgcggcggccgcgtcgcgttcgtgccccaggacgtcgacgacgcccgggccaacgtgttctacgtcaagtccgtgcacgaggcgccctacaacatctccgtgctgcaggtcagcgccgtgatcacgtccccggccgccgaggcgccgtcgtcggcgacggagtcgaagcccaactctacggacgcctcgtccaagcacgggccgccgaatgctggtgcacacgctgcaccgtcgccggtggggcaaggttcgtcgtccgacgacggcgccgacgaggggaagaaatccggcgacggaggagatggtggcaagaagaacggcgccagcgtcggcgcggcaccgcgtgggctacccttcgctctggcgtttctcatggctgccagtgccatcctcgtggtgaattggtgatcgtgtgaaactgtgaagttgatcaccaacgttgtcttgtgaaattcattttgggtgaatttgcacgtttctgtgccacttttgttggggatttcgtgagtttttccactgttaggtaccttaggttcatggtgcattggtgcttggaaatgtgttgaattgtggtttgcaagttagtagtaccattttgtgtcgtcaacttaatttgcacgcgaacgtatgatcattcatcagctgtattctgagtccaaaactccaagtcgaattatgtaatgatctgatcaaactgaaatgcatctgttcttcagatatgcatatacgtgaacgggaaaatgactctgcatgcagctgtagacatgtaaaatgcagtcttaccaaattgtctttctgctgcacgcgtcttctgcgcaagattacaacgtgagaggtgaaacaaaaagaagattactgttaaatcaagcttgctactgaacagatatgcatcaaaagaacaaatcaaattccaaactgaatgcgcctatgcgtttctgaaacaagatgcctgacacccacaagaacactactgtcagtatagcaccaagcagtgcaactcaagtactcaaccgtagcttttgcccagatcaggctcagcaacctttgctgctagccaatagccactgcccactggtcacttcacttgtatcagtagcatcttcctgtacagcgaagcacatgcttgccttccatgcacggacgagccaaagctgcccatgcatggacgagtgcatcagttcgggaagcagaattcaaagatcatgacaaagcgtagctaggcctagctaagacggtcttttccttcttcctttcgatcctttccttgcgtttttttccccttcttcctttcgatctttttcctcacgctgttcgtcgaaagtatctagatctgaggcgaggtacgaatgttattactacagctgggctgcagaaactgaaggggaaactgatcaccgactcctagttatctttcctttcctttgcagccagattgagcaaatcagcaaggctgcaactgcaagcctgcaaagaacgcatctccggtcttaatttgcttgcctggtacgttttggatcttgctaaaagggcactgcaagagctgggagagtagtagtatacacaatagtcagcagtaaacagagtaacagagagcatgcgatctttgcttaaagaagtgcaagtaggagtgtggtaaagagatcaaagcgaagcaaagtggttcctgcaaaccgagctggactgtgcatggatcggattaggattatacggaaagatgaacacgttagaacgtagtagaagatgtgagcaccggctttagctgccttcctactctcccttttttgatacggtgtactaggtagacatatggtttactttctccggggatgtaagtaccgcaacacagagatcatgaaaacattggacatgcataaacttgttatgcataaacttggagtagtagtctattatacattcaaaaatggacagttttcgttttgaactcttgattcagttttacaagtaaagctcgagcctcaattctcaaaaacagacatgacagtgcgctagtactcccttcgtttcatattataaaatgttttgacttttcctttctaatcaaacttatttaaatttagtcaagattatagaaaaatatagtaacatttttttacccaaaacatactattaacatatattcaatcaatgtcaaatttaataaaactaatttgatgctatagatgtttggtaattttttctataatttaattgaaattaaataaggttaattaggaaaaagtaaaaaacatattataatatgtaacggtgagagctatggtttccccccacgttcatattgtcccaggtagataccaaaacgacgatctccccccaaaacccaacttttgagttttgatcctatttcaacgtatgtgggtcaaaataatggtcaaactaggtagaggcatgaagcctatctagatttgagaatcctaacttactataaaattataatccactaattttaaaaattcataccacttcatcatccactagcaataatttcatgccaaaccctatgccaagcgtaattctaataatccattgaattttaggaatcacctccattcttctcctcacaatatttttcccaaaattttttaacatgtatatatccatcattttcatagtcctctctctctctctatatatatagagtaagactattcaataccccctcacgatccccccccaccccacgcgcctcctcgagattcctcctccccccacctctcccttttttttttttcccgatcccacctccacccctccccttttttgagagagaaaaaaataaaagaaaaatttgccttcaatgggaatagaactcaagacctttaattcaaattaccatatggcactaaccagtaggctatttctcaattgtgagagagttttcttagtaaaaatttatcttctcatacgtgctaaatccttgtagtatttggcacagaacatgtagtaacgatacgcgtccggttactacaaaatatatatgttgttattatagtcaagtgactggtattactgggttaaagcctcacatactaactatatacttgttattgcacaaaagtagaagtgttactacatgataggtgcatgttaccacttccaagtagctatgttactgcatgataatgtagttttactatgtcatgtttaagagataaggatcgaataggtgggttataggtaaagtctgttgatggctttgagcgaggtctgattgatgtaggagtgttttgaacaattttatacatttggtaaaaccatgttactgcatatataggcccttgttactgcaagttacacattctgttatggtatgtggaggattaaagttcaaaatgccagtttttgaaaagcaatatctcacaagatatgtattattttttaaaaccgttttcacaatgatactgtagtgcatgtggaggtttaaacttcaaaatgcatctacatattctcctccttaagaaatcgctcttcctccttcttcttaagaaaactggtctcctccctccaatatagtgttactgcatgcatgtatatgacgttactgcacttttgacagtaatattgatgtgaattacactaaaccagaaattgaaataaaaatatatgggttcaaattcttagattctaaccatatacttgttactgcacaaaagcaaaagtgttactgaacggcatatacacgttaccacctgacaattacacattaccgcatgtttacgtagtaacactatccaataactacagtaaaacactttgttactgtagaacatatataacgttactgcacctttggcagtaacatcatggtgaaattatagtaaaccagaaatcaaaagaaaaatatgggttaaaagtctcacatgctaaatatacatgttaccgtacaaagtggaagtgttactacatggcaggtacacgttaccacatgtttatacagtaacactattcataaattgcagtaagacgcattgttactacaaaacttatggtttttactacacacttacagtaacgtcgcgatgggattgtagtaacgcataacagatagtactaacaagtagtaatgctatagtattgctacttgtggagagttaagatcaaaaaacccaagcttcgaataacaatatctctcatgtgatgtatgattttttaaaaccgtttgcaccatgatgttagaaaaaaatgcttatcaaaaatagatccgtcatgactatatttcaactaaatttgaatgttgttactgcacgtaagacacagtgttactgcacgatggctgtcgctttactgcactgtttcgcaagacgagagctgagaagaggtgggtggtgggggagttggaggcagtttgaccgggttttgaccgacgtcgggggtgctcttgactgacctttgactgaggtgggaggtgggtttggcccttgggagggagggggggatat

SEQ ID NO: 75767 - DNA, 9614 bp, Oryza sativa
cttttagctcgattattacttaggaatttccgcagcaaagtgcggggaatcacctagttaattaaagaattgagtcctcataaaataccttttcaatatggcctgaatcattgtttggttttttggccttctgttctatttggtccaaaaggccatctttctaagttggactgggcccatggtttcgttatgggccaaaaacaacaatagcattttgttttattctccccttttgaaaacagtatgcaggggtgatgcttgttcattataagaggcaaagggtagcatatgatatataagtttataatttattatagatgacaacctcaaaggtaactatcgttgacatatgtaaattatgctacattacaaaagaaataatgtgaacattgacattggtacatacgtggacattatctataattatagactgacatctacattccctatggttatcaatcggaatgtcggctcttgtagccttgtgaacatacgtactctctcgcactatatgtgcattgatgtgaatcctccaatttgctataggaatgtcgtaggtttgagtagcctatgtattcattgtcagcaaatgcgcaccgtgaactctttacgtcagaggatctacgtcagtccgctagtacgctcatgacatattccccctgtttttgaagatgcggttagttactccttctgtacactccataaaatgtgctatcctacaatacattccccgcttcaatgtatgagatatttttccccattttgttagaaaatacttaagcaatatgttccaaatataatgttatattgggttgatgttgtgttaaaatggagtggttaagcatgagccttcatttccctcataactgtttttttagaactcctcgcaactgttgcactcaacaatttcattttccttcctgttattcaattaaggttctccttaaaaataagtctttcatgaataatttagtattttgaaggtactattgaaagaattatttggagatgtctaatgcttgaatgataagtaatttggaaggcatctactcctacaaagttgaatcttctaaatactccttcgcttttaaatatacggcattgttaacttttgaatatgacaatatttaacaatttatcttgtacaaagatttagtgcaaatatgcacaatgcgtaaagtacctttaatgtaaaacaagccacaacaaaacaaatgatacttagagcattttttaataagccgattggtcgcatcatgtttaaaagtcaaccatgtcatatataaaaaaagggagatagtttcatacatagctctaatatattttgaaggtactaaattttaaaaattgttgttgcagattgtaagtcttgcatataatttattgtttcttttacttagcttattagctctaattaatcacaccctatctctcctatatttatataataaaaacatcccgacacaccaacgtacattttctcatctatttctaaggtatggatggtattgtcatgtcaacttatcttctttctagttatgcaccctccttaattattgtaccaacttaaaataagccatatattttgaaattatcataccaactcacaatatgccatatattttaaaattattatgtcaactcacaatatgctatatattttgatattatcgtgccaactcacaatataccatatattttgaaatgaaggtcatatttaagatgtagagtaaatgtatgaaatcctcccatccatatcctcattattaattgcttccacctaccccaagcatttatagttaaagtaaaacagttgtgctcttgcaccaaaggatgacatgtaggagccatgcctacgtcccctggccacccaagccccgttgataaacatggtccctcaacagaaacatccatttttgatggggtgcttccttcttggcgaccttactggtaggggacatgcttaccaaaactggacaatcattccagggaggggcccggcaaaaatgaagtcccttctaccttgattggaacccttatctattggttaaccgctttggcggaatttggcaaccacttcttcttcttttggggccacaactgcacctttgacgtggcttgctgcttgcatttgtccaagccggggcagccctgatgtaagtcctttggtataaatactgcccaagcatagagcgagagagagccatcacaatccaatacaagttcacaacataagcatagtacaggtcattgagacttgagagagcatggcagggaacaaaaagcgtggtatagtagtatagtcagtactaggattagtacttgataactagcacaacaaaaagctactatcatttttgcattcaaagtggtaattaagaatcggatgatcattttgattgttcctcttcatttgttttggatgtcaggtggcaggaacatggatcaggtcaagaaggcggcagtgagatcggatggggtgggaggtagtgcgaccaacgccgagctgccgatggccaacctcgtacgcctgataaagaaggtgctcccagggaaagcgaagatcgggggagcagccaagggtctcacccatgattgcgcggtggagttcgtcgggttcgtcggcgacgaggcctccgagaaggccaaggcagagcaccgccgcaccgtagcgccggaagactacttgggctcattcggcgaccttggcttcgatcgctacgtcgaccccatggatgcctacatccatggttaccgtgagtttgagagggctggtgggaataggagggtggcgccgcctcctccggcggcagctacaccgctgacgcccggtggaccgacattcactgacgcagagctgcagtttctccggtcggtgatcccctccagaagtgatgatgaatatagcggctcatcaccagccataggcggctatggctatggatatggctatggaaaaaatatgtgaacaacttgatgcatgtgtgtgtgtacactgcatgcatgcgtggagggtcaaacagagtcaagactcttgtggtggtttcaataagtctctagtgacaatataagttgtgtatcgttgtttcctttgtaaaaaaaaacgtcatgtatcgttgtgtgtcctcatccggtaatcctttacgtgggtgggttatgcgagaaaaagaaaatgacgttgcatcaaataaaatgcttgatgtttgcgtatttactgtatccattgcatgtgtgttaaaatcatatcgcaaattcaactatcctgtgcgtttattctcactggtggagaaaacgtttgtagtcccagtttgtaacccccctttagtcttggttttcaaaccgggactaccaatctgggactaaagatcgctatctttagtcccgggtgaaataaccgggactaaatatcgatctttagtccctgttggtgtctaaagatcgagctgacattttgtttttttttgcatggccttgttgctgcatggtttatatatatatatatatatatatatatatatatatatatatatatatatatatatatatatatatatatatatattatttatatatgtttcaaacatatacatgcataatatatatgtatttatacatatatatgttatgcaaatgcatatatgtgtgtgtatgaccaaaatatatatttacattaaagaaaatgtgtacatgcatatagaaaaatagacatgtattaattacaatccattatgatgtcctagctagctacaatttcgacgtagtagtagtcgttatctcagaagctaaggacctatgaattgtatttccatcgtagtagaattcacccttgggatcaaggatttgttcgttgatgaatcccatgagttgttcttgaactgccgcgataaattccttgtgtgtgatcaggttatccctcatgcgaataaactatatgaatgtatgaaattaattagtaattaaacaacaaatcgatacgtacgcaatgaaattttgaatttatttgtacgtacatcgagctctcttgtggtgatgatttggtctgcaaggcagtggcaatactcgcacacgtagtagccgcacaagttagttccctgcttttgctttgcgcactataaataaatgacaaacggcgagagatctaattaatatacacttgtatgtatttgaattggagattgaatataaatgtagagcatgtgtactcacaggaaaattgaacttccgtctaagtctttctctccatttgccacggaccaaatggcggaacctataccaagccctacatagagtttaaagctatgattcgtagtagcaattaattataacaagattcttaattaacataggaacttatgacagtacctgtctataagttcaaaaaccttgtcaaacatagactcttttttatccattgagtcatatacgttgacggtgcaggcctccaggtcgaagagtaaaaggacccagtggaatctgcaatgtgcgtgggatgcattacatatgaaacacttagcatgttcgtacgggaatgaaatttgttatagcaagacagtaaaaactaactctgtgttgtacggcaatagtatgaatgtcttgtaatgctgcgccttcaggagatggacgagattgtcctctgtggcttgcggatactggtcgagtattgcgacgtttactttccgagggtcgatgaatctagtatcgaaaacccctcgctgtcgggccctttgaatctccattctacaacgataaaaggaagtatatattatatatagtctacttatatacaaggacctaattaattaaaggaaacgtaataagaaatctaactgaacgatacttacaaaatccagcaactcataatagagacgtcgagggcgtccagctggtatagttcgtagatacccttgaaattgatctagagaatgtcatctccttgcaagaagtccgtgtccctgatcctcgctccgatcatccctctaccggtggcgctcatctccatgtacagttgatggaacttgtacatttgtgtgggtagggactgcagctgctcaggcttgacaaacggtttaccgaattcgtacatgtatttcacttccgccttttcgattggtgcgcctcgtagcaattgatccgtattagaactatgctaactcaaacaatcttatatgctaagttttattacaaatctaataatcttatactatgctaagtctaagtgtcgtataaccctaggtaatcatatatgctaagtcgtctaagtgtcgtacattacaaacctagataatcatatatgctaagtctaagtgtcgtatattaaatctaatagtcttaattgcattaaaaatctaataatcatatatttacatcacttgcctgcgcgaattccttcgagggctatctaccactccggcttgagggacgatgacgacaacgtcttttctgcaacatacaaaaagatgtattaggataaacgcaaagtaacatatattgtatttcacgttcgcgttcttgttaagttcacatttcgttcacgatcattcacgttcgcgttctcgttaagttcatgtttcgttcacctacgttcgttcgttcacgtgcattcacgttaacgtacgttaagttcatgttcgcgttcttgttaacttcacttttcgttcacgcacgttcgttcgtttacgtacgttcacatacaacgttaagttcacgttcgttcacgttcacgttaggttcacattcgttcacgttcacgtacgttcattcgttcacgttctcattcacgtacgtttcgttcgttcacgttcgttcacgttcgttcgttcgtttacgttcgttcgttcgttcacgttcacgtacatatcgttcgttcacgatcgttcttcgtttcgttcacgtggcggcaatggagcggcggtgtggcaggcagctagagcggcggcagtgtcgggcgccggctacgggcttgagcgcgacggcgtgcgtggcgagcgcggcatcgcgcgtggcgcggcggcgacgaagcgcgcgacgtggcagtggcggcgtgcgcggcggcggcgtgacggtgcggcggtggcgtgccgcggcggcgtcgtggcgtcccggcgtcgtgccgccacggcggcccggcgtcgtggcgcggcttcgtcggcactgccggcgcgacgtcgtcgccggtgacggccgcatcgaggtcggggtcggcatcgtcggcgcggcggagtcatgttcggccgcgacgacgtcggcggcggcgtcggcaacgaggcgaccggcagtggtttggggagagagagagagatcgaggtcgaagagagagagagggaggcggcggcggcggctatcaccccagagatgcggcggcggcggaggcggcgacgacgacgcgcgcgagacgacggcgagatacgacggcggcggcggcgcggagatgccctaggcagtggcggcgaaggagaagccgagagagatcgatcggggaaaaaacttctaagtgttggtggagaatacgagggcgcgtatcgggaatatatatacccctagatcttctcaacaaccgggagtaaagatatctttacttccggttgttgagaacaacatatctttactcctggttgttctcatcaaccgggactaaagatattttcccgctatttccaaattctttttaaacccggttagggttaagaaccgagactactgataagcgcactgaatattaatttccattacatatgtgtttctaaaatagaaaataatgcattaaaattatttaaagtcgaaaaattaatgacaattacttcgaaacattattgttgtatgtagtaaattaagtggataaaacgtaataagcaaatatatgatttaaaattaataaaaattctaataatcatatatacttagcatatgaatgacattaaattgttaaaaattgtaattaacatatgtatatacatacgacatgcatgatttaaaattaataaaaattataataatcttatataattagcatatgaatgatattaaattgttaaaaattgtaattaacatatgtatatacatacgacatgcatgatttaaaattaataaaagttctaataatcatatataattagcatatgaatgatattaaattaattgttaaaaactataattaacatatgtaaatgccacatgcatgatttaaaacttttaaaaattctaattatcgcatataactagcatatgcatgatttaaaattgttaaaactctaagtatcatatgtaattgccacatgcatgatttaaaacttttaaaaattctaattatcgcatataactagcatatgcatgatttaaaattgttaaaaactctaagtatcatatgtaaatgccacatgcatgatttaaaacttttaaaaattctaattatcgcatatatctagcaattacatgatttaaaattgttaaaacctctaataatcgtacgtaattaacatatgcaatacaacaattgatttatatggataattaatacatctaaaatagtttacatcgtgtacacaataattacggtaatacattggcggtgacggttgaccgcacgtactttctcctcactattgttccctccttctgatcgctacgtgagtaaggggtgtcttcatttgataggaggatgctagggtcaatcgtcaccgtgaaagggggttgcccatccaactgataataatcctcatcagtcttgtcctcaactccgacgatttttcttttgcctgggagaaccacgtgacgcttcggctcgtcaggccctctgcccttctttcctttgctagacatgtccttcacgtaaaagacttgcgttacatcattggcaaggacaaaaggtttgtccgagtatccaacctagttaaggtcaaccgttgtcatcccactgtcatcaatcattacgcctccaccagtcaacctaacctattggcaccggaacagagggaccttgagaggaccatagtcaagttcccatatgtcctcgatggcaccgtaatacgtgccagttgttccatcgtgtcccatggcatcgatacgaacaacgctgttttggttcgtgctcttcatgtcttgggctcttgtgtagaatgtgtacccattgatctcatatccctggaatgttgcgatcgacccagatggtcccctcgccaggaaggccagttgttggttgatcgtctcgttacccatgagatgttgtcgtagccacgcggggaaagtatcaatgtgatgccgtgtaatccatgcatcggacttaccgatgtttttggcgcgaactagagccaagtgctcctcgatgtaaggagctaccaatgaagattattgcagaaccgtgaaatgggatttacggaataaattgttgtctaccgtcattattgctttccttccgagagttccctttccccgtagtctcccttcatggcgtgattcaggtaccccgattgggcgaaggtcttcaataaattctacgcaaaattcgatgacctcctctgttccataccccttggcgatgcttgcctctggacgagcacggttacgaacgtacttcttcagaacgcctatgtacatctcgaaaggaaacatgttgtgtaggtacacaggcccgagaatactgatctctttgacaaggtgacaaagcagatgcgtcattatattgaaaaatgaaggtggaaatatcaactcaaaactgacaagacattgcaccacatcattctgaagggcttctaatctatccggatcgatgaccttctgcgaaattgcgttcatgaaagcacatagctttgttattgttgctcggacattgtctggaaggataccccttattacaactggtagcagttgtgtcatcaacacgtgacagtcatgagactttaggtttgtgaactacttctccttcgtgcttattattcgcttgatattcgtggagtatccagacggtacctttatgctctccaagcattcaaacatactttccttctctgccttgctaagagtgtagctggctggactcaagtaatggcttcctttctcgtttggttccgggtgaaggtcgccgcgttgttccatatgcttcagatcattacgtgcttccagtgtatctttcgactttccatatacacctaggaagccaagaaggtttacgcaaaggttcttagtgaggtgcatcacgtcgattgtgtggcggacgtccaagaattcccaatagtgtaactcccaaaatatagagttccttttccacatcgccgcgtgaccatcttcgctctctataggctggcttccaagcccctttccgaacactactttaagatctttaaccatagcaaacactgttttcccgctgtgatgtttaggcttcgtacagtggtccgccttatgttcaaagtgcttgcctttcttccgtaccaggtggtttgcagcaaggaattgacgatgacccatgtacacaaccttcctacagtgcttaagatacgtactttctgtttcatccatacagtgagtgcaagccttgtaccccttgttggactgtccggaaaggttgctaagtgcaggccaatcattgatggttacgaacagcaacgctcgtaggttaaact

SEQ ID NO: 75768 - DNA, 10041 bp, Oryza sativa
tgcagccccacattcatattgatgttaatgaatctagatagatatatatgtctagattcattaacatcaatatgaatgtgggaaatgctagaatgacttacattgtgaaacggagggagtactttatttcttaacattactttgcatacaacaatattgtggaagccctaacatgctcatctttatccttgtgccgatagcaggctcctctattatcctttgctctaatatgtgtttgcgtgtgtgatcctcggcctttggtgcttctatgtatgcattttgcacggagacgcaaaatgctgaatttctatgtacgcattttgcatccaaatcaacgtacgtttgtcttagctcttcgtgggaactagggtagttttggattgctaccaaaatttatattgatagcctaaatactaaatagtacccactatttatttggattaatgaagccaacttaatttttatgatacccatattaaatttggtagcaatctacaacttcactgtagtatctcaatttgattatattttagtagcaaacctttttttttcgaacttgcaaaaggattgcacgtcaatatattagcagaaaaagagtttttgttacacaaagcaatcaactagactggcttatgcctaaaagggggggggggacttgaagctaggaactactacgacggttaaaaacgcaactccaaacagcgggagggggcagagccacgctacactcccaagaaatccccaaaacaagtaacaccggctaaagaccacagctggccctccgagcggatggactctagaaccactacgaccgaagcgagcgcagagtaaaaaccctggagtttcgttccttccacagctgccaggagactaggagtaccaaggagtcgaagccgctgcgaaggtgctcaggtaaacataccctggaggatgaccaccaatcctggagccagctgccacgagggggagagagggcagcccagcgaggaggggacaacacacggagccagacctgccgagcgaacacgcaatcgatgaggatgtggttcgctgtctcaagctcctgagcgcaaaaggggcaagcagagtggctatcgataccacgcttttggagaagatcggcagtccagcagcgctgctgaaatgcaaaccaaaggaagaacttgcatttagcagggcccttcgcgtgccagagtaagtcggcataggcaaaagagtgctggccaaggaagaacgcctgatactccgatcgcgctgagtagcactggtcacccgtccaacgccagacgaggtgatcctcaatacccggcgagagctgggtaggaaccaccgcgtcccagactaacaggaactgagagatgaccgggacagtgagggcgccacgtatgtcaccaacccaggagttgttcgctaacccagcagcaactgtgcgcgatccccggaagcgtggaggcacgacgtggaggaggtcaggagctatagaagctattgagcgaccatcgatccaccgatcagtccagaagagcgtggactgaccatctcccaggatagagaaggtggatgctgcgaacatgtcggagacgctccgctcaacaggggccttcagatcagaccagtaggggtgtcccgagcgctgaagccagagccagcgaactctcaaggcaaagccagccaccctgagatccggaatgcccagtccaccgagatccctaggacgacaaaccctcatccaggacacccggcactgtcccccattggccgagtccgtacccgtccacaagaaggcgcgacgcttcttgtcaatggctttgataacccagcttggcaagccgatcgctatagaaacatggaccggaatggaagagagaaccgactggactagaaccgagcgacccgccagagtggttagacggcccttccagggggggagccgatgggagactttatccacaagcggttgcagggccgcttttggcagcttgcgaactgacagtggaatgccgaggtaggtgcagggaaactccgagatcgagcaaggaaaagaggactgaaccagctccaggtcaagaaccgagcagcggatcggagtaatcgagcacttggtgaagttggtccgaagcccggaagcggcaccgaagacagagaggatgccttggatgaactcaaggtcttgccgaacgggggaaaggaagagaactagatcatcggcgtagagggatgcacgatgtcgaatagcacgatcattgaggggaagaaaatcacccaagtcagaggctttgcggagcatcgcattgagcacatccatgactagaatgaaaagcatgggggaaagaggatctccttggcgaagacctctctgatgggggaaccgtggacctggcaccccattaaccagcacccgggaagaggaggcactgagaatgagggagatccaatcacgccaacgttcactgaagccaagctaggctagcacctcaagcaagaaaggccagctgaccgtgtcaaaggccttcgcgatatccaccttgagaagaagtcggggaatgcgtttggcgtgcagcgcccttgccgcaagctggacatagcggaagttgtcatggagagagcggcccttgatgaaagcgctctgattaggcgccacaagctcgtccaggcgaggggagagacgagaggccaagatcttggagaacaacttcccaaagctgtgaataaggctaatcggtctgaaatccttaacgtcaacagcctcgtccttcttcggcaagagggagattagggcgtcgttgagggaagcgaaaccttggccgttggtcaggaacaaggagttaagagccgccagaatttcgaccttgatcacaggccagcaagacttgtagaaacggcccgtaaaaccgtcaggaccgggcgccttatcagagggcaaggacttgatcaccgcccagacctcatcctctgtgaagagacagtccagcccctcaagctgcgcagggcggaggccaagagagtggaggtctagggctagttcacgctcgacgctcgtccccaagatggcgcaaaagtgagaggaggcaagctcttgcagcgcatcatgggagacggcaagctggtcaccatcacaaaggcacgtgatgaagttcttccgcctacgagctctggcgtgcaggtggaagaacttggtattggtgtcaccctccttaagccagaccaaacgcgaacgctgacgcgcgatagtacgctcaagcgaggcaagaccaatacacttcaactttaaatctcgccgcagccaggtctccaagggggaaagagaccgactctcctgcgcaacatcaagccggaagacaagttccttcgccatctgaagctgcagacgaacactgccaatgtgacggtcactccagctctgtaagcgcttggccgtggtagagaagcaccaggcaagagcggcaagagggggtaggttggcagggggatgccaggcgtcctgcacgacttgaagaaagccgtcgaacttgggccaaaaggcctcaaaacgaaaacgatgcgctttcggggaggtgacgcaggtatgaaggagaagagcacagtgatcagaggcgatagaagaggccgcttggaggaggcaagaggggaaaagctcctcccaatccgcagagaagaggacgcggtcgagcttaacaagcgtgggcgactcacgctcattgctccaagtgaagcgacgtccgtgaagcggcagctcccggagttccaactcgtcgacgagccgacgaaaacgacccatcatacgacgattgagattaaggttgtttttatcctgatcttcgagaatgaggttgaaatcgcctacgatggcccacggccccgtgcgagaggagcgcagcgaacgaagctcatctaagaaacgaagcttgtccggctcctcctgtggcccatagacgacggagagccaccagggggcgacatcagaagagtgtcgaaccaacgaggcaagagagaaatccgcaaggtgaacatctgagacagaccagacggtcgtccgcgaggcaagcaacacccccccactccgaccgaccgcaggcaagaaagaataatcaaagtcgaggcctagcatttccagaatagtacgagaggggattacatccataatagtctcctgaagacagagaagagagacatgctcatcacggactacatcacgcacagcatcccggcgggcgcgcgagttcagacctcgcacgttccacaccaaaatgttctcgttgcatgatcccattgaggaggaccacaccgagagcagaagagaagaaaccgatcagccgcacacgaccaactcctccgcagccttggccgggggcaaggagctggagaagagcgaggagagcgcgatgatgtgctcctgggaaagtggcttggagaagagggcgttgtaagccgcgaccgcctcggccgtgaccgggcccctctccggaactaggccgagcttccgcatcaggttgcgctgggcgcgcgacactgcgtggatcggcccctcaagcgcctcaagtgccatcttagcagcgatacactcactgcgcttcggcacaacctccaccgccttggcggcgagaggcggcagcggcaaaggcggcgggaggagcgcaggagggagaggcctggagcagctggtgaggaaggcgtgaagagcggcgttgtctgccacagaagatggaagcgagtgcgccagtgggcggccatcgaggtcaaggacaaccatcggcacatcgtagaggacgccgtcgggcacatcaaccaccaaagttggagcctgctgagaaagcggcgactcaggcctcagccactccccaccagtaggcggtgtgcaggcagtcctcggcagagaagtgcctgcaccggaggcggacggcggcacaggcgataccctgggcggcaaaggcacagccggaccaaactccgcggccagggcgtcgagctcgtcgaagaagagaccagtcggctcggcgtaggaggccgcgatcccatcggccaacaacggcgaacgtcgcgagcacagcggcgaggcagggaacgccgggccgccacccgaagggccagacagcaaggaagatgcggtcggcgggtggcaggcagcaaccggtgaagtggcgcagaccggagagacgacggcggctagtgaacccgcaaccagtgagttggaggcaaccacgacagtcggcgagccgaaggcggccacggcggcagccggcgaagaagaggcggccacgatgtcaaccggcgaagcagctggcgagctggaggcagccactacagttggcgagctgaagacagccacggcagcaactggcgagtccggggcgaccacagcaggagccgtcgagccagcagcggccacggcggcggccggcatgccagcggctaccggagagcacgtggtggccacatcggcagctggcgagcccgcgtcgaccggcgggacgacgtcgaccggagaggccgtgatggcgtctgcagcagctggcgaattcgtggcgtccggcaacgccagcagcaagccccgtccgtcgtcggccaacggagaaaatgaggtggccgcatgggctgcatgggccagcgcaggcggcgacccaagcggcacaagaggtggcgactcctccaagtcacacgtcggcccagctgagtccaccagcctaaggggaggggacggcccacccagcggcccagctggcgaagaagagactgggccaggactgagcagcccagctggcgaggccgcgcgcggagagagagccaccgctgccacgtgcggagggggagccgcgctctccgcacccgccgcgctctctgcgcctgccatcaccgcgtccaaagagccagcgagcgacgtggaaagcgatgggggaatcaacatgggatccaacgcccaagcatcgcgagaggagacaaaagaagaagcaaaaagagagtggtcaaaaggagaaacggcctcaaaaggagagatggccacagccgcagacgccaggggggcaccaagtcaggtgaagccgtttgaatggtgggccccacagctggacacgctggcagcactgggaaccgcaccgccgcgtcggcagaccccgccgggcacgccgccaacgccggggagcgcgcctccgcgccagcgacctccgcaaggcgcacatcactgagaacgcctgacgagcgccgctgcggagcaccgtcgcgccggctgccatcgcgccgactacccccgtccaaacctcgcgaagaacgagcgccgaggtcgccaccaccatcgttcgcagcgccaccaccatcgttcgcagcgccaccaccctcaccgctagcaccaccgccaccggccgggtcgacatcgccagacgccgagggggccgagaggcagaccaccgagagcacgtggagaaggacccgataccggagaaggcactgggagcccaacgtcggctcgggaatgagaagaagacgagccttgggaatggcggccgggttgtgcgacgagatggtgactcgaagaaaccggtactcgtcggggcgcgccggggtgtccacagagatgagacgaccgggagcgacgagggccgccgccgtggacgcgttccaggcgtgtgccggtacaccctcgaggtccagcgacaccctgaacggcatggagaaggaggtagccatcacaagccgggtccatggtcgtagaatcagctggtaggggggagccgggatcggggaacgcgagagcgcgaggtccatgtcaccggagttagcgaagacgatgaggaagtgatcgggctgcgcgcagtggacggagaagcggcctgcggggaggtgaagagcagccgacagcgccgcggcggcatcgccggccgacagcgccatgtccaggccgctcacccgggcgaagagagcacgccggagccggccctcctcctctatgagctgcggcgagcgctcgaccacacaaagcgactcgtcctctgagcgaatcggcgacgcactgaagcagagaggaggcggagaaggggcaagagccgccaccggcgaacccacaggcgtggaggcctgcgaggccgagggcgtggcgtcagagggcgacgccgcacggcgcggaaggacgcggcggccgccctgccgctccgatggcgagctcgggctgcgaggacgcttgcagtcgcgagcgaggtggttgagacccaagcaacgacggcaacgcaccgggagacggcaggtcgcaatctggtgcgccgacgacaagcagttgaggcaccggtcctacagctccggcggaataccggtgcgcgtctccgtggaggaaggcttgacggaggccccaggacggcgctgccgaggccagcggcggcgccgacgacggcccggcttccagtccccatcctgcgcaggctgccgagcagccactggcggtggcacggccgccgcggcagcaggcgctgcaggcgccgcaggcggcggtgttggggcagcccccaagacgcccttgaagatggaggctggaggaggcgccttggcgcgtcggcgcggcgccctagaacgctggcgggtcggagacgagggagggcgcgcagccgaggcgccgcacagcgaggcctgcgaggccgagggcgacgccgagggcgggcgcgcagctggggcgccgcaccgcccggccgagggcggggcaggccgtcccgacggtgcagcaggggaggcgggccgtcccgccgtcaccacgaccacagccggggaggccggccgcgtcagaggaggccgccgcgcgacatcgaggtaggaagggaggaagaagggagggaagaggaagaagagagggagagagagacttccttgaacagggacggagtcggggagaggtcgacccgcgaggccgggctctccggccgccccgcgtcaccagaggacgtcggaacgacgacgagggagcggagcgtcatcggtttggaatgttattttcaattgggaccttagggctcctttgattcaaaggattggcataggacttttgtaggatttacaatcctatggattttttcctatgtatgtctttgattcataggaaatgaaaggaaacattccttaggattgcattcctttagttcattttcacaggaaaataagaaagaggtctgacctctttggaaactttcctggcgcgaaagaagggcgcgcccacgcgtgcgcacgtcgtcgttggcgccacttttgtgtgtttggcggtaaaccgtggcccttcgcgcttcttccagaaaaaaagagagagagagaaagatgggaacgagaacaccgaggaccacatattagcagccaagaaagccaactgtgatagagatagacagcagcttgagccggccgctgggggtgcaaggcggaggcgaggctcgccggctcagtcgcgtatgcggcttccgctggggacgccggcccaacaactagcaacacgcagcaaccaagcatagcatccatctggcgcgcaggttgggctccgctaggcggaggcgtgcggcaggtccgccatcgagggcagcagccagggccatcgatttggtatttgtctgcacttttgagctttcatacttgacttattattgacttattagtgcttctgtactttggatctatggattagtgaatttttaagctgactacttggaactagtttgtttcattggcactgtaggtgtaaatccctctctgataaggattatgtatttcttttttctttctttttttttggggttaggaaagcaatgccatcgaaaggctcttctcagatgaccatgacaaatcaacgcaatttgtccgatcgacgagcccagcaacctctatcacaggtttatgttgatgttgacagtgagcatgggactgcagagcgtcaagaaataggtaatatttgcaaattcagtttcacttgttgtttgcatcaaaccttttttgtttcatattgctgctgaaactgaaattgttaaatgtttgtcaaatttagggacgacaaagagagccagatggagtcaccagatgaagatgttccttattgagctcctaacagatcatgacgtgccaggttttcgaacacaaaatgcttggagtaaggaagcatggacaaatattgtttgccgcctgaatacaaaattcggtacatcatttacgaccaaccaagtcaagcaaaaggagcaggatttgaagaaagattatcgcagtgttaaagatttgttggatcaaagtggttttgggtgggatagtgacagaatgatggtgagtgcaccacaaagtgtttgggacacttttgctgatcgcaagaacaaagatgcaattcattggcgagataagtcgttcccatattttgatgatttagctccactttatgatggtgagctttatattttttttatcagtggtttgtttgttttgttgaaatgttttaggcaagttatgctgatcgtgaggagaatataattgtgcaggtcgttatgctgaagggagaactcgccatggtatggaccattatgcaaggaagacaaagaatgcaccagctcattcaacacaagaagcaaatgcggttgatacatatcagtcaccatcccctaattcaaatgctccaggtgaatcaggtttgcaatttccttttggtgaagaggttgagacagccaatttggacttttcacagcattcacctacccctgtccatctcacaaaagtcccacctagctcggcacaaacaccttcagaggttcctgaatctcgacctgggaagaaacaaaagatcaaatctgttagtcctgatgatggatttcatgagagatacctaaaacttaaaaaagaagaaatagatcgatttgctgcaattgaggagaagaaattggaggatccttacagcatcaacaagtgtatcacagtgcttgaaggtttacatggtctacaaataggagatatattggtggcagctgatatcttcaaaggtaaggataatagggaagttttcttgtccttttcaagtgatgcattacgcctggcttggattagaaagga

SEQ ID NO: 75769 - DNA, 13161 bp, Oryza sativa
ggtagcgcgaggcgacgactgccctgggcttcgccgtggcggcggcgcggcggcgcgacgtgctcggccgagacgccacggcggcgccgccatcgaccaccattgatcttgaattcttgattccaagaacacaaaaaaaaagatagtggtttatggatcgaacagaagaacagtagcagctactgcatcatcaaccgatcgatcgatcaatcgctagtgctgctgctagttattatggatcgatgattaatagtagtacgtgcagggttgtgatctgtgggtgtacgttcatattctccaacatgtggtgtgtgccgtacgtacttgcgagcgttagattttggtactgaatttttgtatctttttttttggttgattcgattttgccgtgattacgtacgatcaacgtatacagtatatggtactcgatcaatcgattgttatttacatgatctcgtactgtgatattttagattgcattcttgatctgagattatttgtacattcctggtataggagtatcttggattctatgcttttctgatttattgctagaaggaaatcatgtactactagtctactacaagtcctcttgcttaatgggcctgacgtgttcgaccattgtattgggccttgttaaaattttacactttaggaggccttgttgaaagaaactgaaatactagagggcgatatataccattgaaacaattttgctatatatctgtcgaaaaattttctcctaaaaatttgacagatgtaattactgtacgatcgtagtgtaactatactataacttgcatgcaactacaatgtaactttcacataattttgaactgttagatatgttttaagatttgtgtaagtaaagaaggaaaaacgtcaccgagtgcacatatatgagaggatttgttcccacgactgccgtttcaccgaaatagcatgttacggagagatttttgaaagttaaatacaagttacatgtaagttacagtataattacataacaattgtactataattatatctgttaaatttttaggagaaaatttgtcgacaaatgtataggtgatcccgtcctctattgtccaacggtatactattccttaatcttcatgcaaaattgcaaaccaccctaattttaagatttcatcctatgtcccgatttgttggaaaatcccatctaccaaacacatgtgagtactagattcggctcatttctttcaacgtggattcacagagggtcattatcatggtttatccaacgtggctatgaggtgagtctgactcgagcttgttcccaggttagtttgaagtggcaaggtaactgtgaacgatgagaggggtaagcatggaggcgatcatctgtggtgatcggtagtgaatccacatttaaagaaatggaccgaatcaactatttatgtgtacggaggtaacaatttcagcctagcagccttagatggatgtgcttttgtaacaaaataggttataaggtaaaatatcgaaactagattaacaattggagtggtctatgcaattttgccagaaagaaaagatatttcagggttcttaagcacggattacttgtgttgtttcttgacagattgatcatggtggaatcaaaaggagttcctaatcctaatggctaatggcatcatctatatgaaatgatccatcagtcacatgtatgcctgcctcgctgcctacggcacacggcgcctctccgtgacacacgcatcaaacttgtagctgaaaccatcagttcagaattgcttctccatgcttctcctaatctcttaatgttaacctcaattaatccaggaaatatcatccattcagtctggttttcatgccgtctttttcatgctagtatgtgcttatattcgttcccgttgacattaatgcattgtagtatttaacacagatgatcacatcaaagatagcatcacactctttttgtttctctgttttgctgtctgtctgttactctgttatatgcaggctgatattcctttaatttttctgtttgcttaatatgttcgtttgtgtcggcaagcaatttggtcgtatttgatctttggcagatgtgctgttctctagtgcaaaataatcatagtatataaactgcaaaattaacaccttaaacaatctgggtgtactagtatttctgtgtgtgtttgtcagagctgcaggttatcagtgatcacacgtcaaattgatcaactctgataatcagaatcagatcactgtacaggactaaaaatcatgagaatattacaaacacaaaccaagtatacacagattatcgtgtgtctctatcttgccttcttccctgttgaattctgtatggtcggcattcaactaccagtatatttgaatgtgtgatgtgacgttgatgaattttctacaaattaagaaaaaccaaaatgaatgtgctctagagtattccatgaatatcaaataacggtggttgttagcaagcctgccagtttgcacatctctcttatcctgcgttatcagagatataaataataaaattcgtccaaatcagacgtcgaattaatatattattttcccaattttctattcttcaaaaaagaagtaatttgcttgtaatcatcccatgtaatttggagaaacacaaagagaacaatacacgacaaaattaggataggaacaaaattggttttgtacattgagcataatcctagtagtaatgtacatgaatcagaagcagagcagcttatgtgtacatacaactcatgaatacatacacgcaaacgcaaatagcacatctttgctctactacctacttccccgttttgaacacgagaattttatcctttttccaagtgaattgaactgattttccatgaaaatcatccaaattcctccgttttgaaggctgcctctcgaatgttataatccaagaaggcaaaaggaatcaaagggctcctttcgactctgaatcggatgaacatttctcagaaggcgcagcagcagcaggagacaaggcggctccacgcggcggtggcggcggggcgacgcctcttcctgccggcggcggcggcggcggcgtggcgcggcggcgcggcggcgtccatggagctgagcatctcccacatgacgtgcacgtcgctgtactcgcacgtccgcacctcattccgcagcttccccaggcctgcaatcacgcacacgataccgatcagtctcgtcgtcgtcggcggcggcggcggcggcgaccaaatcaatccaagaagcacggcggcggcggtggactttgactagctacttaccggtggttcgccggaggccgaggcgggcggagaggccgagccagacacgcttcaccggcaccgccgcccggccaagcaggcacgacatgatcgtcggccgtacgtagcttcgattgcactccactctctgctctcctctcctttcgccggcgatgtctctcgtctctcgttctctttctctcttggagctcgtgaagcttagcttgatttataggcgaagtgggggtgggagaggatgtggacgcggcggaggaagaggagcgcgcacgtggatggaaggaggtctcgatccgtcgacgtcgcgttgtcttctacctcgcgccttcacttccttcccgccgcgcacggtcacctccgacggccagggttattcgtgcactcataccggcgaaaatatttagtgccaacttgaaaactacaccgtcggatcgaagagatttgttcacgttatcctgactaaattttttattcccagatttaatcagagtaaaagttttactggagtaaaaattttattcagtgtgacgtggacaaatctcggacgtctatttttttttaatatgatggtgtttggttttttttactacatattttccgcctgataccataacaattttctcacccttgatttgaaattctttttgaaacatggtcatacacacggcacacacacccacccttacgaacacacgtctggacgtattttgagattcattaagtcattactggtaggcacgtcgtctatcactaaaaaaattaataattagctataaatgggagctctttactgagtttgggaataaaacccatggtgggcagttgatctttatttgatttccatatggggtgctctttatttagtttgttttttcgttgttgttcattggatgagaaaatatactcacaacttctattctctcgtcttcccgcgtaagcttttctggacttctcaacggcatattgttttttcaaatattttctattggcaagttgtttttttaaaaaaaatcatattaattcaattttaagttctttttaacaaatacttaattaattatgcaataatctccggctctgttttacgtgtcgaggaagaagggttcccaaccttcccaaaataacactaccaagaaggaaatatatttttgtcagaaaaaaattgtttgaaatcataaattcaaaaccaattttgttttgtattctataatcttaataggcagtggcttaaaatagaacactactctaaaattatacgtttagcaatgttcgaaatgcgaaatagacatggacgatggaaaaatgggtgatggagccagataatttgaaatgtcgttttttgtgacaaacaaaaaaaatgtgttcgtacaagtatctgtctaaactctcaaatcccagttgttatgccaaattaaataaacactcccgatgtggacctcttaatataaagaataaaaacaaagcacaacgcgacgtcgactttcttataccgaataaaaaatgtttcttgaaaaaaaagagacggctggagtaaaatcttttagcagtagctctcgcatatattactgtcacaaattaattcatcctagagatgaaaaccaaaattaataaataaatatcctattggcctggcccaaatgataagatatttaccagttaccatcaggtcatcatctaaaaaagttaccatcaggtttcccttgcatatatagaattgccaacttgttcatgatcagttggtgtcaaatccgtgttagaattaacagtccatctcttcttctgtctcctgctgtcatacacatctgacgaagtagtagtaacagtgagtagtattgagccattttaattaatcagctaaaatattcagctaacagccgccttagcagcaggattagtgcctgattaagcttatctattcctgagctcctaacacgaggcagcacatttcacatttccatttcttcccttgtaaagattcctatattaaattagattggttgatgatcttccttgtcatcttgcaagagcattattgtgggccaaaatcttgatgattgatcacaatctgcatgaccatacacggagaacttgggcaacatgtgctcaaatgaaatactactacatggtattttcctcttcctctcgtgtaacacatgctcatttttctccatccataatcatgttcatataactgcaaaaatatggtcatctgatattttcagaaatcagcataccagcctttatatgtaactgtaaattcagagttcagacatttacttggtagtaactgcaatttacagagttgtggatagcactgtcattcattcgttcaggaattgatgcggaaactaacaggacatgaaggttcagacgtaacagtcagaatcctgagacgcccaattgcagttgcagctttgtcagacaagaacaattctctattccaatttcttggaatggaatgaattttcaggcgtgagtgcgtgtgcaccgttaattagtggaattcgatttggccatcacatctctttctctttcagggtcgcagtcaccagtgtgtacaagccaagttattttttattatttattttgcaaaaaagaatgtaccaatatgccaactttagttttgtctgttgctaatctgatacatacgtgcatgcactgcgacatggtttgattggcattgacatcaccaggttacacagttggatccatctcagaggaaaggaaggaaagcataatcaagttaaatttttttatttaatttgaaggataacacgagattaagttgtgtttctatttgtgttggcttgagaaacagtcgtgcttcattagctagacctgatctcattcattgcctgaaaaatatttcagtcactcgcacccacactgaaagtctgaaactgaaattttcagagttagctgtgtcaattttcaatcttctttttgcatttaagtttactacagaaagtttactcaatgtgtgtgatgctccaatactaagtcactggatcatcacatccaactctctaaattaggctctttgatgggccaatggatgattacactgacacactcacaccccactctgaattctgaagcctgaactttttcaccatatatatataaataagaaagttccaagagctcttatgatccactaatcttggcactttaagtgccaaggaaaagcacattaggccagttttggggggcctgcttagagattgacacttggagcaaacgagtggctcctctttcagattcggtgtagattattgatgatgatcttcatcttttgcccaaccaaagcttgcaattgttggggtggccactagaacaaaaaaaaaaaagagaaacaacaaaaggagattttttttttcagattatcatccaaagaatagcaaagcagtgcatgcgcaaatgcaactatcagagaatggagattggcattccttttgttgttttgggttcctttctaaattctgatgatggtgtatggatgtcatgttaggatataaaactttacttttgtggcatgaaagaaacataagcctaaatgtgcactcaactatatttgcttctcttggactaaggacccccatcgtttcgtttatcctctgcttattcataccgcttattagaaaaaagaaggtataagtaaaacttttatatacttatccttagtgatacaaaagtaaatgttgtaaaataaaccacaattaaaaaaaatacaaaatcaacttcaaaattaggttttgaaattaaaattttggtttattagcataatgggaccattagtacttgatttattcattccatttgtgcagcataccacaatgatcttttcctgcaataatacgggtcgtttcttatgttttacatcctccatttcataatgtaagtcattctagcatttctcattatctagattcattaacaccaatataaacgtgagaaatgctataatgacttacattgtgaaacggagggagtagtattcagttttggtcttctgaccatgcagatcgcagaggctgtttgctctgcacgactagccacttgagcttgacagctgacaacaaaagcgcgttgattttattttattttactttggtcgtcgttagattgcgttcttgttgcataataaaacgacaaaaacagtcttctctcagttcactgaatttgcagtttttacactgaaattatcgcctcagtttagtcagttatcaatcgatcgcagacaccaacacgaacactgaattttccccctattttccaatcttgcaatgccttctctcttgggcccaaagcccagttactgcttacacagcacaggcccacccaagtaatttgggctcaactcccttcccctcttgagcccaaggaccatccggcccaagccccaaaacccaacccaaccagggcgacgactgctaactcctcacctccgctgcccgaccatggccgtacctccggtcctccgccggcggcgacgggctccaattacgccggtgcagaacgccggcaccgccgccgccaacagcttgcgtgcgtgtcccgcgatcgataaagcctcctcttttctcattcgggtgccgccctgcactgtaagtacatggagagagagagagagtgggacaacgcgcggccgcacgccaactgctcggcgaaatgcccaggccaccgcgccgcgggcagcgcacggtatggacacaggtatgttacgtatgctcataaaatgtctgggatccaaaaactggtcacttggcattggcacccacctgtttgcacaaactgcactatatgcacattcacaagctatgtgttgccgaattcttcctttattcatagtattgttgaagtgatttcagcgagtgccctctgttaggctaactactttgtttatcgtcatttattaatttattattattattagctaaaagagcataccttggaaattttgcatgatcgtctaccagtatcttataacctagcacaaaatgctcaacagtaagcaggaaaacatgatggaattatgtatgccatgaaagaacctcatgattgcatataaagggaatatgtataagcagaattagacaacatcttcctccttatttagatgaacaaacaacactcacggctaaacacgtactagtatcttgttgagatcttcctctcacctaggttaatacacaactatgcccgttgtgttcttttgccaaggcattggacgttgccgccttcaaagtaccatttacttattcttcagctgcttctcttgccaagcttgaccaacttacaaccaagaatacgtaaactctatcatacagcttgtcaaagagccggaaataagcaatcctccatatcttgttgaacagcaggacacaaaataccacccagatccccaccacaagtcctataccgaaaccaaaataaaatgtcatcggtttgaattcttgcttgctgctgtggatgaatgtataatttcttgaacagttcttttgaagaggaggtccacaaagtccttcatttccaatatacattagtgatggatcatttgcactgagggtgtcaagttggcggcctgagggtatcattccagataaattgttgtaggacaaattcaagtagcttaggaatgccaaacttgataagctcgatgggattccaccagaaagtttgttcttagagaggtcaagagattccaatgactgcagggtaccaatcttgttgggaatttctccactcaactggtttgaagataaatttaaatttattaatgcatcaagagaagtgatatttggtggaatttcacctgtcaatgagtttgttgataaatcaatgcccacaaaatattgaagtcccccgccatatggaagttgtttcccttttgtagatattaataatatttctccgaattgaccacttacttcgactgtgaccaaaccagaactcatactagcaccagaaaaaggctggaagcctttcattgtcatgcctgtaaggttagatagatgccacggtatagcaccagatatgttgttatctgataggtccaagtactggagagacaaaagatttgtaattccagctggaatgctcccagaaaatgtattatgacttagtcgtagaatttgtaaatctctaaagtctcctatccacgcaggtaagctcccaaagaacttattccatgcaagatccaaaaactgcaggcctgtgcagttctgcaaaaaagccgggaattttcctgataacgtattgttgcttagcaggagaaaattgtagctgatctcagaacattgtgggatttcacccaccagaaggttgcctgacaaatctatatctcccaacagttgcaattcgcaaatagattgcggaatgttgccaccaattcggtttgaatacatgagtaatgtttgaagctctggagcttcaagatgtggcggcagtgttcctgagaatgaattgttggagatgtcttaacacattgatttttcttggaaaaggaggtattggtccagtgaattggtttgaactgaggtaaagttgttcaaaagccatgtcacctagatgcgctggtaagctaccacttatttgattttgcgacatgtccagatatgtggcctgggaaaatgttgaccaaaaccaatcaggaatcttgcccattagacctgtgcttgaaatatcaaattcgatgattttgtgctgccactgaagccaagatggaaacagaggcccaatttgacaagatgcaagccatgcagactccagcctgaagggtggaagccaatctgaatccattgaaaacttcaaataattggaagacaggtctatgttcttcaagcttatcagacctgcaaagtgttcttccctgataacaccactgaaagtgttattgcgtaggaccaaagaagtcagattagtaagcacaccaatctcagcaggtatgcttccacttaggcgattgctggagaggtcaaggctggctaagcttaacaaatgcataacctctgttggtagatgtccagaaatatcattataagagagatcaaggctaactaaagacgtcaagtctccaatccctggtgatatacttccaataaggttgttagaggagatgtcaagcatgcgcaagctcgtgaatcttcgtatcgaatttggcaaggctccagtgaaattgttgtaactcaaatgcaactccagtaattttttccttgcagcacactgtgacgacaaaccgtcaatcaacattgtcatatctccagttatctccatgttggtgagatctagtatttccaaactgcatagattgttcagctctcctgccatcactagtccttgttcagattgttgtatgaaacatcaaggacttggagagatgtcatgcttcctagttgttgtggaaattttccaaccaacccattgtaggatagatcaagcatctcaagttttgtgagattgagatgacaagtgactggtttgcattttatatagtagcggtaaattatgaagtttactacattgtttagcaaattataattaacatgagcatccttttagactaaaattgataacaacaattaacccacacatttaattaacatgtgattaaaattttaatattcacaataacaaatatataataatgtcccgtgcaatttgatcacggctgattatcagttaataaagttctactagcacataaaaatgccatattcaatgaaaaaggggaaggtgaaaagtataaaaaaaaaatttcatttactcccaaaaaaaatgtcaccagtgatcttaattctatttattaaataaagacgcatgtaggaggaaatacatcaatataaaatgtacgcatacagatcacgtcccgcttgttttagtgccatctgatcaatgacactttcacgtacaaccatatgaccttggtacgtggcaacattggcaacgatgtgatgtttcactttctagctgaaaaaaaaaatacacgccattcatatatgttggccagtggccacttagcttcgaccaccaagtggagatgatgttcatcagttcatcactacaccgaggtatcatagcattaaagaactttatgaccaaccattttgattgtagtttacatgcatctatatatggattgaattttgcttatgttttccctttacatttgtgcaaaagaaagcaataatttgaaaactggattaattaagctcagtgtaagaacaaccatgtagatgatcatcagttaataattaattgagcactgcacaattgcgacgaatgttgccttgcgacccggtcttgaccccaacccggcccaacttggtcatagccgtgacgaaggcctggttgaaggcggcgctgctctgggcccaagaatccacgatgggcctggaccgtgggtccgagtacagcacctggtcagagcccagaaggcccatcccgttctgcaggttcttgaagtactggttgtcgaaggcccgcggcgtcaccgggtccatggtcacggcgatccgcgggtccacgttgggtgggcacgacctctgtagctgggctgcgtatcttgggctcatcgttggatccaccgacgacccacggatccgacccaagaatgtgttgcagtgtgcgaaccccaccgtgtgccccgctgcacagtttaacatgacaatgaggtcaaatgtatacatacaaaaaaatacagtaggtttttgaagtagcagtgagtaacaccacactactacaaagcggatttgtactggggtagaatctattttcgcaagcggacgaagcgtccaccatattggctagtgaaaatcgatgaagtgacatctcggttttttattttttattttagtgacagtatgtaaagatatgtgacagctgagtggctcagattgattctacctacttccttcgtaaaaaaaaaggacaacctaggagaggaagaggggatgtgattcctcctaattcaacgaatctggacaggtgacacgtcctcttttagattgcctttttttaaaggatggagagagtaggtccaaatcggaatgtcgtgacagggcatgttgctataaaaaaaacagctcatgggcaagcacatagttttgtctcttcatgttgggctgttttccagagatgggcttgggatcgagtgatctcgatggatggaaggatttgtacggttgtttgtacagttgtagcagatggttccaaccacaggcaagcatggttggtaggagttggattgtgtgcaagccagggaatatttacttagctacagagatctggttgcctttatctctctctcagatgcaacaaaagctagcaatatgcatgcatgggagatgtagtaactatgcttaagtaggagataatacttagtacacatgaacaagttgcttttgcaattaattggttgcctaatcattaaagcacaagcaatcagtaattggtagtggctatttctcagagtcactgagtagatatgtactgatatattatcaatatagttgccttcacttggaagaccagaaataattgatataattattttgagaaagtgttttcatttttttagggtatatgtcacctaagtacgtagttttttttaaaaaaataagatagattaacataagttattcactccacaaacatatttgatttctaagagataaaaaaaatagatacataatactagattcagtttaatttattttcgaatttaacctttgttagtatataactcataaatctatatattttcttaattttttcaatgatcatccctcgagaggaatgagaaaaattgaaaaaccatcgtcgaaagattttgattaagtttaattgatgggagctgttcataactaat

SEQ ID NO: 75770 - DNA, 21001 bp, Oryza sativa
ttgagcatgttcctcactctcgaaacataactgtctttcaatatagattaacagtgaagattagcaaagctcataagtaaacaccatattacagcaacagagaacagacaacttgcctgcaaatgctgcatacaacaaactatatctgcttggatgcccttttcttgcatttgagcttcaaagtcatcctgttgtataaaccactaaaagtgtcagctataaactactcatgctagaatgttagtgtatttagttgcaagtatgaaaggagggatggaggttgtacagcagaaggatctaactcgatgaactcagacgtgaaaagtttctttctgctctcccacagctcacgagcatcattgacacctgatgcagaggcatctattgtagaaagtagtatgttcgtcaaattaacaagacagactagacaatgtaaccatggagaggcttaggctagtgtgaattatcctaccaatccctatgtagtgaccaatttgtgcatcgccccacttgtctgtatcaaccccaccatcacaatacaggtcacagacctattgtatttcacaatcaacaaagagaagcatcagttttctgattctaagattcacgctgatctggaacatgctgatctggaacaaaatcgaagatcaggaaagaggggagcagataacagaccgtggcataagggaatgcgaaaatcttgataagggcagtcttagcaaattcatatagccgatgatgcggtgtcactgccatgcactaaccctgcaattacagatagtaggacatgagccaatgatgaaaaaatatttctacagatactgcaatggtggtgttgagcacatactaaaaaataaatcgcaaaatcaaacaaatctggctttactaactcagataataatagcacatgcaaccgctaacactacgcttccctagttccttagaacttagaaagtacaccaaaggtttagggtttaggggggtgaattaggtcaaagtaattcctgctctagtgacataattagcaaaaagcaatcgagttctaagagcttcccgatctagaaactgcaatagcagcagctcatcctcgaaaaaaaaatcaacccattcgacagtgcccaatctatctaccgcgcgcggcgcagcaggcaatgcggggacaccaacctggtgacgcggcgaccggatgaggaggaagaagaagaagcaaccggcacccgcgtgctggacgagaacccagcgacgagccgcggaagggggcgaccgcggcggcgagcgccaaaggcgggcggcgcggagtaggcggggaagcaggggggagtcgggctgcggctgatcgaagcggagggtgggtgcggaggccgagcacgcaacgaagggggaggaggagaaggcacgcgcggatcgggcggcgaggcgaggcggagagcggaggccggaggccggagggaggagaacagcgttgctcacaggcacagcgaaagagagtcaagagtcagagagagagagagagagagagagagagagagggctgtttggggagctggagccttcacccttcagctctcacaagctctgtagatcttcacaagaaactgtaattgtaaaactaaaaaataaactaaaagtcaaaatattttcaccaattagcttatcagcctcagatagcggatctaaatccactcaagaacggtaacatcggatttcgtgaaatccattgataaaccgataaaacttgatccaaaaaatgaagaggtttttgtttttaaccaaatccgaaaagtccacatttttggatttcattgaattataaccctgggcaaacgtagcatgcggaaataggaatacctctgtgtgtggccatacggcttgtgagtagtagggttcagaatgtcgataaatttcgatcggatttctcatcgtctcgagtgtggatttcgtttaggatttgtcaaaattcattgacagacccatcatttggttgataataagcaaaagcgtaacgttacatttgcaaataaaaaataatttgtgaataaaacttttatatacgtgttcttaacgatttaaaagcaaaggccgaaaaacaaactatgatgaaaaagaaatcttaaaatcaaatatttaaggttgaaaatttaaattttagctgataagcataagcgaaaagatgagaggatgaagcgtggcaaaattagtcgacgtctcgttgggctcaaatttcactggtcaatcgagatcgcaaacccactcgttctcgttgggaccagctttcactttgtaaggcccagctcactgcagactgcactcggtttaactaacttctgtaaattgtccctttcttttttaggtctgacatctaccgggcagccacaatgtagcaataggagagggtcttaaatctctaaagtggtcattatacattgtgaaagtaatccatatagtagtctttaagataagctacccataatgtcataagaataaaataacaatactttctcttctctctctcctcttctctctcacatgccatataattgagtgaaactagtaggacccaggctaatgccttctcttgccatatatattgtagcaaacaccataactaataccgggtcccaccttattgcttaagtagacattatacattgagcatgctctaatacgcacattttgacagtaaaaatgatgagagattctaatgggaaacttccgtcccctccagattcctgacatgaccacaaacctcagtaagaaacttcttagctagataatttcagtttagtctcaatccctatatataatacctccatttcaacatcaaaaaataatcaccttaaccagagaaaaagggaaaatcatgagtttacctccaccccaaattcatgcgcaacacatgtggcaattccaataagaacataaacattggttgagaggactaccgtaagtctccacgttaattaactaaaaacaagttatacctgatatgtacatacgacatgtacaacgagaaacaatacaacatacatgatgtttcgtgccgttcttctctggcccttggagtagctaattagtatacgtgcattgtgcatacaggtatagatagatatattttacattgtcaggttagggctcaccttcttttttccccctaacctccttttcttctcccagattgtttacctagaagacgatgttagcacaggttaacatggagcagaccaggctatggctgcgtgtgatggaggccttcatccaggaggaaatgttcaagggcgtccggcaaccttgcctcgcgagagcccttggtgtggtgtcctgttccaatgcagatcatgatctgtgccttctccagctgaccttgtagcacccatcaggagggcaagctcagccttcacaacctggatggcttcgctcacctgaagcccatgcaagtcgatcagacggtcctggccttgttcagatgaaaatgggttcctgcaacgaagcaggggaagctaaaaaaaactagatgcgcctttagagtgcgaaaagatacttgtatgcaagaggagaaaagatgaatacaatgtgcagtccaggtcctggtattttgttagtggtcagtaagttggcaggttgaaaaatacttttatttatgaaaggttaaggtcatgtcaattggttatcagggagttaatccacctttgctgataaatagcttccctagctgtctcatgagctgccttcatttgcaggttgtacaactgtcccttcatgctcagttcctttgctaacgctttgtttcccatcatataagcttgcgtggcctgccagaaaatattccaatcatccaaaataaacattccactagatcaaaggacagtgatcaataaatggaggtagtcaacacaagaaaactcaaagcaagtaaacaaaatgatgccatgaatacattgtgcaagatgaacatgcaatttaagagtgcttacttgttcaaaacatgtattgcgtatgcgggcaaaatcaccagcttccccccttgattctgagcacatgcttgctggacagtagcataaatgcaggctatcaatccataactggagcatggtcggaaatcaaaatgtctggatgagaatattacccatggcatcaccagtctttagactgactggggctgagtgaacattactactggccttaaggaacttgtttcctaaggaagaccttgtatcacagccatactgtttccgcgcaacaatactcaaaagaccattagcatacttgggactttcatttttaaacttcatgtggccagcatcctgcaatgcaagtctttgaatagctgaaacaaaatctccagtcctagacattgttgaagagttgtgtctgtttgtaattccatgggcacctacattgccttcaaacaaacaattaaggtcttctgttccaggtagtacagggaagtttcctgtgccaatgtttggtgtatttggggccagattcagattctgacaggagctagcatcaacttgcatctgcaatcaaaagaaaaggtcggatttgcgtgcaagtactgcattttttttaagagaatgggaaaatcccagcctacatatatatgccacaaaatctccagaacacaacatgcactaaaaggttttaaaaaatgtaagacaaaaaatatgtacagttaaatatagatatgctctagctttaagggtcaactttgtactgttacacagaaaatgtaatgtcccatctataagtaccaagcagaagttttaaaatttttacttgaaaaaagaataactttaaaacaaaacgatctgcctacaggtcaaaagaggctaaaacaataagatagcaacacaaagctctaatactaatgcatagcagtatagcacgaattattcatacatacagtttgtgctttgtactgacagcctaatgcagcagctaatagatgagcaaacggaagttgagtgaacattatactagttttggtcattattctcacttagtgaagatgtccaagttgttagcaccagtcaaagcaaagtaatagaacactacattataatacccaactctgcatcccagcaaagcaattaatacgggacaccacaatgttgcgaatgatgggtgcacaactggctatcaagacaagaatattttacagatttattttccttatattaatatttaattataaggactagattaggagatcacctctaactgagtgagaatttcaacagtaaggtcgaagtcgcaaccattagcacagtacaactcagcaaggctctccacagaaaaaccaggaaactgggatgctaaatactcaagtgggtcatgatcataaaggaggtcaagcttcccattagtataacataggttatctgcatgattttgcttcccactgtttgaacctgaattctcatcataatacaaatcattgtgccccaggtcaagattcttgcctgcttgagacaataacccatgatgctctctcgacaagttgctggctgctgtgccaaagaaagggggtgcattcaatgacaatccagaaaatgacaattctccatgttgctgttcaactttttccatatcactgaagtctggaataatatcatcaggaagctgtctatgccaaaactggtgtgtttcatcatccgagttattagattttgatgattccgacctaccaaggttcgttttaccagagagccccctaaaatctggtttacttacatccgcaactgttctacttccaaaaggcgacctaaaagttgaagggacaaattctgctgcatttggatttagggtggtaactgtacttggtaattttgaccctgcatctccgccttttgtagaaaatccatgtgaactcatcttcttgcagattctgtgcaatgtcaccagtacaaggtaatatatccagatgataatttatccaagccatggaaaacagttccagcagtaagtaaatgctggaacatagtggcaattggcaacagccatttcctattctaggaatactaaaatttaactgaagaaaaaacattccaacagcgaaccaagaatatgcactacacagtgatatagactatttggcagcatgggaagaataaaaaggaaagaagacaaaaataggtcatcacaactagataacaagaatacaggtagacaatgtccagaaattacaaagctacaagcaatccactttcgctaatataactaaccttaaacggtcagagattttcccattctaaaaatgctactactaaaaaaagttgcaaccataaatgtagcaagcagcctgcttccccattctcacagctcataaaccaaacaacgtctctcccaaaagccacgaatttagttagcgttaccaccacggtagcaagtgaaacaaccaaagcatccactctcacaccacccctagaaaacttcgcccaagaatgtactccaattcagtctagtagtattgtttttaacagaagcatataattcttcgcaaattcgcaagtggatggaaaacataaaggaattttgtcaaggtaggtgtgcacaaaggcaaagagtgcacagttattcatgcccacagctctaaagcggaaacagaaaggaggccttccgcacgggaacgacgcacaaccacccacccaccgcacccagcccagccgaacggggcaccgccatggattccaagccagatctaggaggaacacgaggaggagcccctgagcccgcgtggcatgatccaaatgggagcgaaacgaaaccccgccgcacctttccggcggccgatcagctggagcgcagccggaggcggccggcccatatataagatggcgagccctcgacggagagcggcccctccggcggcggcggcgggttgattgctcgaccgcgtagaggagtagagaggagagggagtggagatgaagatggtggggaggattccttggaaggaatggaagagagcagtatcgggggaaggagggcgtggagtggagtgaagtcgtcagcgtctgggcgaggcgaggtggttgcggtggcggactcgcgggagcgccctgtgtacctctacctgctcgccggggtggcgcgtcaggattggtttccggtcgcagtgctgatctggctgacacgcgccctctagtaatagggctgtgtttagttcctgaaaaagttataagtttgggaaaagttgaaagtttacgtgtgtataaaagttttggatgtgatgatgtgatgtgatggaaagttgaaagttagaggtagttgggggtgaactaaacacggcctaggggtgagtttgagaagagaggaaaatacgcaaaacgaggtgagtcatcagcgcatgattaattgactataaattatttataaatttttaaagcaaattttatatagaatttttttttgcaaaacacacgttgtttaatagttcgggaaacatgtgcgcggaaaacgaaacaaactttctcacgatgttatcctgtccaacgcctgattttagggggctgttcattttaaagctaaaatttagcaaatgtaaccatctaaatattgtcaaaagttgactcttaagatttggtaattttagaatcttcttctcataaaaacttataaaggtaatagcttgcacatcatagccttatcaaattcttcctctatccgaaaatgttgttatctagtattttatccgtttcatattacaagtcgtttgattttttcttcattaaagaaaaaaattttctttaggtttgatcacatttatagaaaaatatactaatattttcaatacaaaacaaacatattatcaacatatatttaatattaaatttaataaaactaatttggtgttataaatgttgctaattttttctataaacttagtagtcatacgtaaagaactttgactaagaaaaaaaatcaaacgacttataatatgaaatagagagtactagatgaaacacatgttaatactatgacttctgtctcgattcgtagtattagaatgtgtcacatccagtactggatagtcatattttgtgacgtaaacagtattggacaatgccaaaatttggcactactgaaatttagtaaagtcaatttagacataaaagtgtacaaccacttaggctttgtttgaaattgccgtaacttcttaaatctagtaagtttcacaaaaccttaagtattgaagaatccgtaatataaaacctcaattattatgatttgtttctaaaaaaaccctatcaacaataacaacaacaaaatcaatatttgggctcgttctgctgcattccccatggctggctgcgcgttgtagcctgtacagtgtcttgtgtcaacaacagcgaatgcataggctgtaccctgcagacgaagaaggccattgttggagctgacagtatttcattccttccacagaatcaccaaaattgatattccttctcatgagtaagaagggttgcccgattgagcagatgaacttactgccatgtacgaatcaacacgtgacacaaaacggggagcccagatacaaacaattatcttatcttgcataacaaggatacatgaaggcatgaatcaagaaaccaccgaatatccaaggttttgaggtatcctttctttgttagtcgatagacattgggccaacaatgtgttcttcgattctttttgccgggctgtgttcttcgattccccaagtaacattcatcttagcagccagagcccgcaaggaatttatcgtagggactcaggaccggcagcttacagaaatcagagtgacattgctcgtcgttcgttgatacaaacccagccgttggagaaatttgctgaggtgacccaagcttgtccatgggtgattcaccatcctgcaaagtcccaagaatctgtgagtgtaaactggagaagaaagactttcacctcaaaaaaagaagaaagaccaaagaaaagtcaaatatgttatgaccttgagagaatcgtgtgcaattcaggttcccacaataacaactaacaagctaaaaaggtatgattgtgttatatattgaaagcctagaagcatatttttccttagtttacctttattacaattacctattagatctgctgaaatatcaagcatcgcaaaagtaaaacttatttctttattacatactcctacaacggaagagtgcttggctgcttgcttcacttcatgagatttcaaaatgcaccgatttaccattcaacatagtctaactgccccattccacaaatagtgttctgtaccattttcatctttttaactgtagacatctcaagttgtctgtgatctttctgaaggtcactaacctgtttttggtggacgctcatgcagacagatagcttttgctgctttccgatcaaaagagcttcacatcggtttgctacctccttaaaaggcaaatcaaggtttgttgacactgatagtcttccaacgtgccgagatgtttccacaacctgcggaagttataacctctttttagcatatatcagtacatcttgaaaatgttcagttttaccatcgagtaagattccatattcatagttattgattgaatgattatattaataagggtacctccatatttcattaatcatattttaagcagagtaaagctagcaagcgggaaataagtacatactgattcaagaagctgattcacatcaataaggccattgtccaaaggttgttgcaattgaggttctgctaagctgttagctggttcaactagggtatcatcctcaaaaataaagccgacaggaataacctgcataataattaccacagtaatataagaaaacaagaataaaaggatggcatgtgtttgtaaacaaggttgatcacctccaacgatttttggtgcaacttagcattatatgcaggagattgtgaagtagattcattcgagtgagaacccaggggacaggcatcatctgctgagaactcctcaagcaattgctttcttatagtagacaattcagctgcggtaccaccaatagtgcgaaattagcaatcacagcaataaaaggtatcaagacaaatgttcatcagactcttcttgtgatttacctccgataaatctttcaaactatcgagaataagagaaactgatgcctgttttgactgatcattgatgttgatgtttgagagagatttcaaagcaagatcatcgtcgtcttttgaccgtaaactgtcaagcaagactcaacaacctgcaatttgcagtcttcaactagacgaagaaatggatcaacctggcaaacacattgcttatcagatagtaacacaacatatgacatcttaaaataaaatggataaccacacgcatgtgaaaaaatgataaaatattcacggcatcaatgttttgagaataggcaagagggttgtgcatctttgtataaagatattctaagcatcaaaggctccacttaaaactcagttcaatatttaacattacattctagagattaatttgcaactgacaaaagtagatttttttatggcatcacagtggttagaattgatctggtattgactgcaaaacatcttttagtacacaagaacttaggtgcaaatgtgccatgggtaactgtgtctcattcttttaactgagggagagtatgctaaccattcactcaacaatttcaattattctccaaaagaatttgtattaagaaattacatattgttgtttgcgaatgagtagacatttatctgtatggtttgattatgtatttatgttagtcaaatttatgtaaatttgtttgcgaagacataatctctccaagggctatctattgatggtaaaaatgctcactagatcaccatgcacatcataatgaactatgcaagcataatttcacttactatgcttgtagtcaacaaatctttcactagaggaatgagagatggaatgccaaaagctttcgagaaaaacacaagcatagaagttgccatagtaaagagtgaacgcctgcgtgatggtggcaaaaaacctgaaaaacatgttgatcgaatgcattatgaatatacaacttctgaaggaattacataacagcacattacttctattgcttgtagcatggcatggagaatctatgataagagtcatagagtaagccgaacaatcactacagagaacaaatgaacaaaaaagtaattgttgctttgtgaagtaagatccaatactgtgatgggaataaaatactggtgtgtacctgcttgtaatgaaatgctttgcaatgaaaaagcaagctgaaagctgccaacaagaacttcaagacatgatttctgcaatagggtggcaattaagccaagtaacagagagatgcaataaaaataaatcaaataaaaattgatcagcaaaatttaatatggaaagttacattcagattaaatattcacatcagaaaaaaatatggatgattattacattatattatgtattatattaacatttaattgtgcaagtgctgaaacatggtcattcttgatctataatctggcaaccattcaaaagcttatgaaataagagaaaagatgttattaccatgaattactatttgattgacaagtggcaatgtattataacccaacattccatggagggtactatatcatgtgatcgtttatgtctttatgttgtcatttcctgtgctaagttgattgctcattaagtcgagctttgcaaatggtgtcaatacgtgaatactacataatccctaatatcaaggtctatctatacatagaggaagagggcaatagagacgataatgcaaaatacagatatgaagtagagggaatgggccaatgggttctctcaccttgtcttcagaaaacagtagcatcaagcaataagtatgagaaattgcttcataatttcgtggaacattttcaggtgaaagtgcctgagtccacaaggaggaaagcagaaggatagcctgacgaccactcagcatgagggtgactggatcctgcgtgtaaatgaataaacattcttttttccaccagaaagaggcacagttaataaataaccatgttagctacaagaaatcagagtctagcacttactgtttcctgagttgtcccactcaaattacttatttctgatgaagatgttacaaaactatcttttgcactatacatcctttgaatggtctgtgatttgaatagttttggatcattcccgtttatctggtctgaattctcactgatagggattagattagtgccatccaggcgtgaattttcacgaaatgaaaacacatctcttttcaatttcccaaacagagcagcagaagatgagaaaacagatgtagtcctagacaatgtccttttaataccaatcttgcttgtttgtgaagagcctgaaaatgagcatggagagacagaagaaggaacaagaacaacagagaaaatccgatgtgcccctaaatgtgtctcacaatctggatagaccattgccaaaagcaattgatgaaataacgcctcaggaaatgcctacaaggtgtagtatatattgttgaacaatttgtagagtcataaaagaaaggaataaaaatattgtaaatcaacttactttgctctggtataacagatttggcaatgatgcaattatttgagctgtacgatatgttgcagcaatagtggaccgggcaacaggtgtagtacttgaaatgttctccaggacaacagccaacgcatcaaggataggcccagcatcgcctacctgaagagtatatagatcaattgaaggagcacctacatggatggtgggtgcaaaatgatctgtagagtgcagctatatgcatagctaaaaggaaataaagcaatgcacttatgctggtaaaacatattcacaggaaaactgacctttctagacaactgaacaagacattcatcggtagctttcccatatctgtcattcataaccatgccatccccaggacctacatcactgaccaagagctgcatgtttttactcaaatgcctgaccatatcacttattgcagccattagtgcagtagaagattgagctttggagtgctcggcaaggcgtgttgtgacctcaataatgtccagaatcttatctgtctgcttcaatacattcttgtgttcaagatgcttgactaacatggataacaatatatgtgaattctgtcctgtcagccaataatgtatctatcacttatcagcataagcaactattcaagataatagtgctcatgtagattatttaaataccatagaagtataaaacttattacagcaaataagaggaatgcatctgaaaggaaaaaaaatagaagattcaggaagcactgaataccagatttctctatcacaatttgcatatccaaaaggacacacaatgcaagtcctttagaaggcgaccacagattgttgttatcaaaataacgaaatatagcttccagaactcgtcggactgttgttgcttccctggatattctagcaaggttgtgcagacaaatccctgaccaaaaatttggactttctgattcttcactgtgttgggaaaatgatttaaaagagataagacatagagaagcttaatataacatgaaaataaaaaaattccatgactaaacttatttacgttgtcaggcttaattcaccgcggggagctctaatggctttccatgaaggaacccttgtcaaaatggtaataccggaaggttcatgatcttcagctttgagaacttcactcacccactgagtccttctatcctcaatggcagcatcattatcagaatttgcatatgggctctcgtagttttccagaactgcagagacaacctgtgcaatcaaattatgatgtctgagaatagaggtaggttggcagaatggcaataattctggttacatcactgtggaccttaggtcatgtggtctcagtagagttaacgattaattgacataagtagaagcattgtgttacgaggtctgaaggaagataaactaggaggtaaagaaggcatgtgcaagccataaggtattcggtttcttgctcagataatctattttaatttataatatggaacgattaaaggttcataaattgtttttgttactcaaattggtaacaaattaaaagttctttgaaattaaaaggttgtgctgaactaatcgtatattcgtatgattcttttatcgccaccagcttaatggaaaaaaccacacttacgttgtcgagctctgcagagatatgggaatgctcacccataaaccacacctgcaatccataccagtgggtattaggcatgaaaattctgcggtaaaaatagcaagcgacgaatatgtagcagagcagaaaacgaaagaacattctttttggggttttgcaggaatgttgagagggaatatagataaatccatccctaggcagcatggtgcaaggtccaatgtttgttgaggtgataaaatgagagaaaaattacacatcgggcacctatcgttaccaaagttaccaaagtttcattctggagcgcttcaacaatgttttcactctgggattagatgaaattgcatttcgttgcactctggagttctgactgcctcttcctctccatctctctcccaccaaaactctggccggtgtcctcccatcccaggcagcggcggcgcccatacttgggggtagtgggaaaacggaggttgagctcgagcgaggggactgtgttagcggcgggcgaagctctcaagcaatgggcatggaggtggacggtgagctatttggtcgccgaggagatcgatcttgggggcgacccaggctccggcacttgccccctcttgctctcctccacatcagccagccggccgccatctgctcctactcccttccaaatcgagccgccatcccggcattgggtcagatggagcaacggtcccccgtgctcgagctcatctacgcttgtgtcacctcatacttgagctccatctccgtgctcgagctacatcggcgagcaagtggcggttgcctgacagcgagaaggtgcccttgagcacgacttccgcttccataccaagcaccgcctcccctctgaagctctgactccctcccttggtggcgccggcgatgggaacgaaaggggggagattgccggctgtgtattcttaggaaaactctcgtttttcgtcggttttccgacttttcccagctcaaccttctcagtttcccaagccacctctctctctctctctctctctctctctctctatctatatatatatatatatatatatatatatatatatatatatatatatatatatatatatccacatacacgctttttaaacggctaaacgatatgtttttttaaaaaaaattatataaaaattatgttaatacttaactaatcatacaataatatgtatttcgttttacttgccctgaagatatccttaggttgtcgcggttatcatgtgtggtaacattttcagttttttaaaagatagtatacctcgcggtaatcatgtaattttctaaattataagatggcggtaatcacactcccaacggtttgttaaaccgttatgggttaccaaagtgccgcctccatttctttctcacttatcgggtggaccgctggcccaaactaaaacaaagtgaaaacatgaacttcagactcggtccaaattgccactttggtaacgatatatggtccaacatgtaattcggttgaaatggatggtttagaatggaagtactatttaatggaattctgaattcccttaaaaaacgagccagaatgttagtatgatatacgaatgaaagaaacattttgaaaagattcaggatggtatcagcaaatcatccgtttggttggcaacgtaaaaaaagcgccgtgcagagaacaagataaacatgaacctacagcaacacaaggaaggcataacaggagaggtaccatggatgaaagggcttggaggccagctgcatgaacaatggatatcttctccttctcacccatctcttgggccagttgacatagtttagggatttggctctctaaattgaacatgtatgtgctgtcaacctgtaatgagaagatgtaacagaactcaaaattttctcaaaagagagttttatcggaagatacacgtaaatgtcaagaccatttcaccttgtaaattgatgcctacccgaatgttaaaatacctggttgtttacaaagtaaaaaagtgttcgacacgctattgtccgcaagtcatcctgtctgttctgttccaatagggcttctacgatgtttagcaagctattggcgaaaagaggcctgcaaaacagcggtccatccattatagcaattattcacactaatataaccaaaagaaatgcaacaaatacatcttgtaaactccactgattgccagaggaaagtccacccaaatagatgacttcacccaaaaaaaacactaatacatatatatatataattgagaatataattgccacaccagaaattaagtatttaaagcaaacaaaattatcattgataaaattataatttaactagcatggtggcccgcgcagattgcgcggctagcatcatcatattttctctcatatattaacatatatgttttctcattatattattaaaatatattacaatgacaacataattttaaattgagcaaagtacacggccggtccttaaagttagaacgaggtgtcacttaggtccatgatctaggaaaatcgtcattcgggtccgcggtcttgtttaagtgaatcatttaggtccaaagcgcctttgactggattgattggcttacgtggccgtccacggtggcagcatgtttgcattttagcccccctcccatcttggctcccccttgtctctatctcatttctctatctccacatgttgtcagttgctgaccaccacgcgtgcatgcatgagccactagctgcacccgccgaacaccccggagccgtcgcctgcacccgcgttgtgcgtgtccttggagaaaccgagcacggtctgagcttgttgttgctcctgctgtggcggtggcggcatgcggaactcgccgagatggaaccccacggctgcatactccgccggcatccctagcggccccatctgaggcagaggaacgtagcagccaatgctcctcagcaactccatcgccgagaacacgcacccacgctgcccctgccaccaacgccgttcgccaccgccatgttgcctccggggttgcacatgttgctactctccaagctcgggaacgctgtgaactccggcgactgcagggcgcggccgtggtgatgcgggaacgccaggttgaggtcctgcgcgcccttgtgcatcgacttcaggttcttagccgccagccccacggggaccgagctagacaccgtcgcggaggtggaggccgacgcggccgctgatgacaccatgaggacgacgaacgcttgttctcccttaccgttgccgccgtacgcgcctccctcctcatcgtcgttgtcgtcctcgcggccgccgccacatctacaccgccacccaatcgccgttgcaatcgctaaccctagaaatcacacaggaggagccgaggaggatttgggggagaatggttggatcgtatatgggagagccaagatgcggggggctaaaatgcaaatatgctgtcaccgtggacggccacgtaagccagtcaacctggtcaaaggcgctttggacctaaatgattcacttaaacaagatcacggacccaaatgacgattttcctagattatggacctaagtgacacatcgctccaactttaaggaccggccgtgtactttactcttttaaattttgcaataacttttcaaaactactaatgtgtaataactactctagtctcctcttctaatattccttattttttaattctaaatttcagctatttctaaattgtatttctatatggactctgctttttctttttctcttattaatgtgagaatttctaggccatgagagtgaacgtggaggctcctttttattccgaattttagttggttttaaattccaatatgaactctatactctacttctaatattccttattttttaattccaaatttctattttttttcttaattgtatttctatatggactctatactctacttataatatttcttatttttaattccgaattttggttatttcctaattgtatttctatgtggactctatactctacttctaatattccttatttttaattcagaatttctattattccctaattgtatttctatatggactctatactcctcttctaatattccttattttttaattccgaatttcaactatttctaaagtgtatttctatatggactctagtctcctcttctaatattccttattttttaattccgaatttcagctatttctaaattgtatttctatatggactctgttttctttttctccgattaatacgagaatttctaggctatgagagcgaacgtggaagctcctttttctattcctttaattatataatagattgcagtatgatgaaattgttaagagatggatattacggaaatccaacgcattgcctatggaaccttcagcaatatattcaagggagcacatgtaagtatgtaactatgtttataagcaaaaataacttacagttgctcctgacaagaacatatcacctttcggtaaattgccatgacaactttcactgacccaaaatgctcaactctcaattccttgtagaatttttgctctaaataaactgtaatctgtcaaagtgcaagaacaattttcaatgaagacaaaaggatcaaattcatgaataggggaaagaagtaactccaaaatcttaaattttgataatacatcattggtttttctataaaatacgatttttttacagatttaaagtaggatatatcttttttctagaagaaaattaggatataccttgcttcagattgaacataaaccatcagaataaagctagatatgtgaaaaaaggcatgcccaaatgttctgtatgaaaagtacccactggttttaactaagaaagtcagcatgttgcacaattgattgacttttgggagggatatagatatgaacagaaaatgaggcatgccctgcagcttcctctgatgattaataagcactcgataataattcactttctaaaattattagatgaatcatggcagtgaaataatatataaaagagatgagaaagagaatcacacctttggaacacgcaaaggattcctcgaaatatattcgcacaatttgccgatctttcggtcattgggttcttcatcctaaaagaacaagacaacatttatagccttttccaaaaaaagaaagaaaaagaaaacatttataggtgtgttactctcgcttccccagataggtttatatggggatgtattttaacttttaactgtgcacatatactgatatacaacagtagaacttgccgaacatagattttcttctttttgtaattgcgttattagtaccaatctgtactacaacgagagatactaaaataagcaactactgttggagtatgatacagaaggaacctaaggaaccaacaaatcgatcaggatgaaataagcaaacctcaaactacacaatatgatccataatgtgcaaatgtaggatacagaacaaagcctaatttatccatgaacatctacagcgggtttcacctgtgacttagggaagatttctgagagcaacttcttgtatcgcttgaccggatgccgagacctcgtgcgcaatgacgggcaaaggaagcaaagcctctcgcatgcaggcaatacctcccttgacaccacacccatcgtcatcgggatttcttaggctccaccattactcatccacaaagcgaatacgatgcaccatcgctccaaatccaagccgggttctgaacatcgtaagagcattggccaaacatttttcgcatcagttacatctcacatgcatcggagcgaatcacctgaaaattaaccaaatcaaggcaaacctcccacgcggctaccaaggaaacgatcgaatctaccaccacagcacaatcgctcacaccgaatggtaattccgccgaacacggcagaggcatatcccccgcattctcccaattttagcaaaaggcaaaagcatcacacacacgcactaatactctgctaaggaaattcaaaatgccatcaatttgggccacacgcagcagctcatgaatgatgatgaattaatcgatccctctatcccccgcacccaaaaacaaaaacaagaaaaagccgcccccgatcagcggcgacgcgacatgcagaaaagaaaaggaaaaatctaaaatcaccgcgatcgcaaggaatccgaccatacctgcaggatggcgatcggctagctggctcgcgatccggggcgaccgatcggacgaacgggtggaggggaaagggaagggcgctcctcctcttcctctctctcctcagcgcgtcgtcttatcgcgcgcgcctttgttgcttcgcgctcgcggcggtcgcgtgggttttctatatctgggaatgggggcagggcggggcagcgttttccggggaggagccttttataatggccaaaaggcccgaggcccaacggtccggcccatggcacggcattttggtccggcccaagcacggcatggcctgacggaggtcaggcccgtgccggcccggcctgaataccggccgtgtctgggcccctccaccggcacgttgggccggcccagcacgaccaggccagcacggcacgatgggccggcagccaggcccgatataaaaaaaataggggagtaaaaatagacatattatatgccatggacgaaagaatagggatgtaaaatagacttattttatctatacatatgctagcctaaagaggtgggacgaaaagtagacttatttagctatacatatgtcagcccaaaaaaggagggatgga

SEQ ID NO: 75771 - DNA, 21724 bp, Oryza sativa
agggggtgagagaagagcaaggggagaggatggaaggagaaggatggaaaggatggagataaggaaggagaagaaaaagagataaggatgggagatggagagagaggggggctgcacatgcgcttgtgcgtgggctggtggactggtgcatgcgctttcttcccggttgatgttaccaaccgggactaaagatctcagagggcctgacaaggtctgacagatttagaaccgcatctttagtcccggtaggtaacaccaaccgggactaaagatcaaatatgcccgctgtagtcaccaaccgggactaaagatgatctttagtcccggtttgtagtggaactgcgactattgtggatttcggccgaccgaccaaagatggtttctccaccagtgtcatcagccataatatcccccgttaaacttatgaaaaacaaggagaaaattaattaaagggctatcaacaaactgatgtaagtattttaggtggaaaactttgaaatataattctagtagagtagagttatagtgtaattacactgtcagctatacaatagttaaatttaacttttataattttctatataaattaaaaagagtaaataatttacataactttctataactcttacaaaggaaattttacatagaagtaacaatgctataatgtaattatattataattatactaatatggttacaacatagttacactataatatattaattgtactataattacatttgaaacattttcctcttttctgggggaaagatccactactagaaaaaacgattttctctgcaacatatatatgccctagctagatatagaaggggtgtacgtatatgctgcgtcgatctcaccttagagaccggatcccacgacgaagagaaggcgcggtggccggcggggaagtgctgccggagggcaaggggatgagtcgccgacgctgacgcggtgcgacgacgaattagggcgcaggcgagagatcgccgcaggcaattagccatcagatcgatcagatgaattagatttagggcacaaaaagcttaattagctagctaaaagaatattgaagctaattatatactgtatcatctctctcgtacgtctcttctcgatctgccctccacacgcggatcgacggctcggattaactatctgcatatatttttgctatataattaaatttgtctagggtgtagtttggatattgatttattgatagtaaatcccccctgtcacgcctgcaagtgggggcccagtcgtacatatgatcaactcgtactcgtgtgcttttttttttaactagttattatgtacccatgagttgcaatggtataccaactgcaaattatatcgtacgggatgatgttaaataatttaaatgatggtaaaaaagagaatttttaaatgtctattggcagaaaattaggtcaaaatattgcaaatttctaacattaggatttgcttcgtgattcatgctctgacgatccctggtctttctcctccagcttcaccaaccggtgatgatccggcgagttacgattcagggtcccgggttggagtgatgatgggaaggggggttggggagagaggggagatcgctaagcttagagggatgatcgtgtgaggcggctgcaggcgtcagactgggcgctgccgcgtggtcgagaatgagcggtggatcggtattaaatgcagaaaatgtaataatgacacctactttagggaggttgtagtgcttgaagcaccgtcgtcgtcctcatccatgggatcctacatatggattagtttgacccgaaagttcctgcaactatacatcgattttgtacactcaaattgaagttgttgccaacacacataaaaccaatctccaaattaaatgaatttctcttggaaacatagcacacgttcgaatttaaccttggactaccagtccatcggttcgatcgcatttaaattatagccaataatataataggcctatattaaaatgttgtcgttggagaactgcgcctagcgcattaggcagggtctgcggtggtgcaccctacagcctctgttcaaatcccaacgaatgcactcactactctcttaatatatatcgatatgaaagccctttcttttatatccaacgtctttttaaatgttgtcgtttactgtcttatgaaaaaaaaacctcaatcctaaaatataacaagttctgcacataaccatttaatttgtcaagttacagttattattatcttgatcagcattgttagtaataaagaattacatgacaatatattataatcaatcagtactgaaggagagagaccaattaaacgacgacttagtgaatctatagcacagattaattaaagagagaaattcagaagcttttcgatcgatcgatctggactcgtcttaattcttggtctcctgagcaggtgattggcgttgaggagtgatgtacttgtccatgattcgttcagtagaggaggaggcaagcaagaagccgacacagaacatggcggcaatgttgatttcccctactacctcctctctgaacttccccttgggcacccccatagctgtcagcttactgcatatatgcatacatgtattgacatgtagatttgaagaatgtgatggattaattatgtattgcaatgatgcatatatgcatgagctaattactatatccctcgatctgtataaaaaaatgcaaggcatgcgtctatatgttattgacacgtagtacgtctccaatttaattaattgagtgatttactattcttatgaaatttgcacataaaaattttggtatctattgatatctatttaaaatttatctaattaattactttcataataaatataattaacatatacgaaattaatgttatatgaaaaatatttttagatacgattatattagtggtaccacatgggtgacattaaaaccagatgaatactccgccgccacgttgctgcggaaaggaaaattaagttgcatagtatgtacaaacaagatgcaatatgattattaaaaataaaaataattaatatttataaattttgatcctaaaaattgagatcacatagcgttatgagagaagatagaagagacaatttaaactatagatctatcattcaaaggatagaaataattagctagggtgatgtggcttaataagagaagagagaaataacattaactaaacttagtgaggatgaactatacaagtatatagtttatcatagatatatagttagtttgatacttaataatgacgaaaagtaaggacgtcgatcgggagagagagtactacctccatatgagatgggaattaaaaatccgttatattttaggacggagtagtatgtacgacataccagttgaagaagccgtgttgatgagaggaggtgtgagcgttgatggcgtggaggttggccgcgatctcgtcgtcgagtttggcctccatctcccgcatcgtccggagcatctcctccttctccgccccctgcagcttcctcatggctgaccagcaagaacagccgggcttccattgccgccctagcatcatcttccctgggatggatcggagaagacaaagataatacgaccaagccatggcgccgatcgatcggatcaaggatcgagctagctagctaggacggaggtattaatttaatttctgttaagttagctagggcaggcaggcaggcaggttaattaatttctttctgattgattgatttcatatcatatcttatcgtatgggatacgtacggcccatggtacgtacgtacgtggctcggcccaaattaaaccaaaaatcacacttcaattctcctagtataaagatctggtcctgaacgatcgatcaaaataaaccctagatagctagagaccagagagatcgagaatactaactaataataactcgatcgatcataaaagccatggccgcagctgctctccggtgtcgcttggcagccgctgcgtcgcccggccgccgattcctctgccgccgcgcctcaggcgatcaggtattcagctcaggttcacccccaccaattccacagtctctccatctcctagtccatctactgctcctttactagctacctacgtaccattcaaatcttattttaactatatatcttgacaagtaatttaaagattagtaattttccgttcgttacaaatatttttcatccgtgcgtcatatgagctgcagccgtcccaagatatgaaaatatatacaaaatatgggctttcagctcagtccacgcgcaaacaaaataaaagaactacacatgaaaatcccaggccgcaagttcagacgcgagtcgtctcatccttcctcctcctgcaatccggtggcttttgatgtttcatatatcagttttttcatttaatggcacatgtaccaaattaaaaaaattaaaggtgtcggttttttgtcggtttgcacctataccacggtttttttgggtttacacctataccaaattaaaggtgttgtttttttatcggtttttctctacaaccaacacctattactttacaaatgtgcccgtttttaccgttggtgcccccgctgtcgttcgtgtcacaggtcattgcatccacacatgttccttgcgtctctcccttgctttaaaattagctccatcggttatactccagccaaggagctaagataaaattaggctacattatcactggcgttgttgttgtacatacttgtatacgtgctattgatcgataagaaatcatctgcatgaataatgttcaaatcatgaatataaaatcctaattacctaaagtttaacgtgattttaatatattttccgttgcaacacatgagcaccttttctagtagttataaaaattagaaaaaaaatgataagtagtgcatgcttaaattattttgacttctacaagttaaaaaaaattattgtgaacaatacacatatactggttagaattaaatttattatttttgttataacttgtggagatcaaaactgaactttcttgtttgtgtattgctgtatcacataattctatattgtcaaacttttttgaatcttctctaaaatgggtcatttttctcgagggattcgaatctattttcgctattataaaataatctgatgcagcagcaggaaagggatgcgctactgaggtgttgcgtggaatccaaattgcacagctacaaggcgactatggaatatgctgatgaatttaacggcagtctaaggtacatctggcattattctagatcataattataactaggtgaaacaccgcgtgttgccgcgggagtttagtatgataataagaaatagaaataatgtgtaagatagctagacgatagaagcttgcataagttgatatggtttatcataatttaaatagtatatagaatgatgacccaaatttaaaagtaatatgatgtggttttatgagagaagaaaatgagagagataattccaaccattgattaattatttgagggctagaaacaattgaggtgatatggcttaatgagagaagaaagaaatagcattaactaagtgagaatgaattgtataggtatatagatattatataaaatgatggaaagatatattaaaatattttgagaattatgtggaatgatgatttaacatgcttggatttttttaaagctctaaaatttaagtaagaatgaactatataggcatataggatattataaaaagtgatggagaaatacattgaaatattatgtgaattatgtgggatgataatttaattaacatgcttgcattttaaagctctaaaacttaataaattagcatgcttgtatgagatttgagatgtagtaaatgttagtggatgatgtggcatctttgcatgttaagctttagtatgtagtgggcctgaactttatagaaagataggactagttggcaccctgcgtctttgccgtgggttatgtagttttatcgtcaaacaaaattatagttttaaatggttaggtgcaactctatgtatatacaaaacatatgataatatggatttatatatgccttatgttattacaatacaattcatactttatttttttcaagcgtcattgtatattgttataatatatgaatattattttcatgcgcaatatgtgtatcgttatagttagacaatttgcatgtctctactttgctcaagtttttttttctggaaatagatttaggtaaaggtacctaataattatatgatatcttatcatgtataataatacataacaaatatattaaacaataatcacatattaaaaaaataatttgagttgtattaggaaaatatggtgttatgcacaaaatatataacagtgttttgtgtgaatgtgaggtggagcaaagggatgtgaatggataactaatgaatgattggattggatgaataagtagcttcttgatccaacgggtattatctttgtactaatatgatctaatggcttaaaattgttgatgatgtgacttcttgcatgtcttactttataggagtaaatacatcttagtgggtaccaattacataggaagataggattagttgattatattatatattgatccctgtttctcacttattcctgtctactagctactagctagtacctggatctatcgatatctcttgtgatgtaattcgacatgtggtagctgctgcatgccttaaaatcaaattcgtcatgtctaaatttggtcttattaatttgtttcaggcgtgcaatgttcggcatgaccgcgctctccgttttgtgcccttttgttggactagtcagtggattatgggcatcctcgattgcccttacagacgacgacgacgatgattagcccttgcagacgagattgatcgacttgattgaatacgcataacagcatatatatatatatatatatatatatatatatattcagttttcatacttaattaattattagcctgctcgatcgtgccatcatatatgtatggattaaatttgttgatgctatatatatgtatatatatatatatatgtatatatatatatatatatgtatatatatatatatgtatatatatatatatatgctcctgttgactggacatgcgtacgtgcatgtcggcatgcatgctactatctgttttgatcatcgatcgattctctgcggaatagtatattttaatcaaatcctgttttatcatgataaaacatgataaaaaataacctcgagaaaataatcaaatcctatttatgatgatcactagaggcaccatggtcaactcccatggtagtaggcgcgcgcgcaccaagttaaagaaaaccacatggaattaatccattatgagtttcttccatatggagtcatcgaggtctaagcattttatcaaacacataaaggacgtgaccttggggaggaccttggtgatgatgaggaggttgggtcctacatgaaagcggttaatctcctctacatgtattccctcggacgtgaccttggggaggaccttggtgatgatgaggaggttgggtcctacatgaagacggttaatctcctctacatgtattccctccttgtctatcttcttatcgtggctacttatggtgaatttggtggaggatttggtgacgattttctctaggaaggaaggggctcagatgccaaattattaacgaagcaaatatgtaaatgtcaacaatttcaaaaggaacaaatatcaagtgaacatgggatattttagaggttaaagatggaggaatacaaggggcttagaaagttgtagaaactaggaaatgtggaggtagagggaataggtactcaacgaggatcctagcccggatcttaagctgccaccactctgctcgcctagtcgccgactctagtcgttatattgccattatttttttaggacaattgcgtttgtaccccactttcgatctcaattgtgattttactcttcttttttagggtttgcgaatttgcctctgcttttttcaaacgaagccaccgtttgcccctattatggatggcagttaagtaggtcccataaaactgagttgaataaatagaaatgaagaagaaaaaaatatttcaaaaatatggtacctttctacccccaggattatatagtaaccaatcttcatctggcttcagtacactcaccattccccaccattccccatcgtcaaaccgatgagatacattcctgccagctgacgcggcgtgagggctcatccagcgtcctggcgcattgagcgagaatgcgagctcggattgatatactccgaggtattcaactcccattgagcaaaaattttatgtaaatgtataagatataaatcacacttaaagtactatgagtaataaaacaactcataacaaaataaattataattacgtaaattttttgaataagacaaatggtcaaacacgtgagaaaaagtcaacagtgtcatctgttaaaaaacggaggtagtatatgcctccgtttgtccaccatgaacagccaccacgtgtgacccggctgcagtgctctgctagctgtgctggtacaaccttgattaatttcttctgcagggatgtggccaagtaggggatgaaggacatttgccatgtctttcaggctctccatgcctcgctctagctaggttatcactaacgcttaccgcttagcaagcactgggttatcgagcaacatgaagcttaatttgcaacaacttgatgtattatttgatctgtgaagctttgcaatagttcgatcatatataaattatttcacaaattttcagttcaaagcagaataggagcaaaaacacaactaatgtccgaaagtaggggcaaatatatatgcaatggcaagtaagggtataaatgtacttttgtgctcaaactaacaccgtcaaactaatcatcgactaggggcaaaactcttcttcatttcaaaaacacaggggtaaaaacgcaaaccctaaaaactaagggtaaaaccacaattaaacttcaaagtacgggtaagaatacaattgcctcttattttttcgatgaatccttgatgttatgctgctgcggggaggtctaccgcatgagtgactgtacgtgggctcgaacacgcggtcaagccatgtcgtggcggcactccctttttttccgttatgctcccatagatggtttttttaaagaaaaaattaagagaagaaaaaaaattactaatagaagcaaaatgatgctgcttagctagaaatattcgtgtgtataaagtttatacatattcatacattaaaattttatacatataaactatatatgtacttttaatcaagcaaaattcttataaaacatataaatccgaatccgcatttgcatccaaaatcgtgcttagaatcgtaaaggctagcctatctttggctggtactaagggttgcatcagagtttcagccgatcttatcttatatgcatgtttcttaatatgttttatgtaaatttgccacttatatagaccgatctttttatagcattgcatcaagcctatgtcgtatcggctgggacaccaaaattgattatcggcttattcttgataccttgctatagattggtctgcctatataggtttgtgctagagtattagctgacacgttatctttatcgctccaaatatcatcttatcggcttattcttgataccttgctatagattggtctgcctatataggtttgtgctagagtattagctggcacgttatctttatcgctccaaatatcatttataggtttgtgctagagtattagctaacacgttatctttatcgctccaaatatcatcatatcggctatcttccttagtattgtcttaagctccttctgttaatctccatagacaatattggagccggtagggcatgtttaggggtttttatctaccaagtctgtaaccggtttggtattatccaattggctagaaccaccaacgatacgctatcggcctatcggctatcggctgactaaccctatcttttgtttccttgctggttacaggatcaaaccagctagcatgcccttagcacctcgaggcaagccttggacctgcactggagctaagtagatctcacagaccgccgtgttttcttgtgaacagtgctcttggtctacaaaggattaaacgatattgggcttggcggtgcctgtttggtctaatcattgcaacataattactggattatccttccaccttaattaagtaaatgacttaaatgaccatcaaaatcaacgatgggatttattcttagttaggctgtgtttagatccaaagtttagatccaaacttcagtcttttttcatcacatcaatatatcatacacacacagtttttcagtcacatcatttttaattttaaccaaaatccaaactttgcgctgaactaaacatacagccttacactactactacatccaccaatggtaggtactgtaaaaatacctaatagctaggcacacctttacagctgtggtgttgacatctcctgcttagatttttggaagccctcgaaaagggacctctcgtattggtagttggcatatcttcctccaagtttgcagctgaagaaggtgataacggctaaaccgaataatctacccctgaaacaaataaacaaacaaataaataaataaagagcaaagtagttagataggggactttaagggtaaggacttatgtgttacccctaaaagtgtcacattaaattagatgatgaggtggagatcgaagggaagtgaaaagagaacataacccaactctcatgcaagaggcaaaaagaaagtggaatagtgtgagagtggaccaattcaagaaaatgttaggatttgtgtactaaaagtaacataatatgcatgttacatcttaataaatttatagatgacatagctaaaattagatgtggtaatcacatccgctgtaaaacttgtcgtcttgccctaatgtagcagtaacagcaattactggtggttgtagagctagtatataggcagtaggattacgagcatatatatctcaccagctgacgatttgcacttcggaattcacagtcgccgataccacctccgtcttcgtgccgccgctgttctttgcgagcttctaatggaagaaatataatcaggcataaacatataaatacaccatataagcaggtagattaattggttacaataatcgatcgatccagtgaggcggacctgatgatgatctgacgccgcgttgcaaatgaggcggcggctgacgatgccggcggtggttgccgacgagcgactactcagggtcgtcagggatcggagaacagtggccatggcggcgagcgagcgagcgatcgacgacgtcggtttcgtctcgtttggtgatcagagtcgcaacgggtttctgaccaaaaatatataggatcaatctgcgatgtgttctaatccgactcggagtggacggtattaggcctctacgtccaccaagacggacatcaacaagactagtagttgattgaacacacaaacatatgacgatggacaacctataacaaattatcactactacagaaatacaaattagagtcgtttgggaaccccgcatagatatcagttttcccaaccagcacccaacaggtgacacttatgagagaaattaaaggtgtcagtttaggaaccgacacgtttaacacatttgaggtataaaaaaaagtggatcgaacagaaacatcgagcaattgataccaatcaaccatgagatccctataatcaaccatgagtacacgtcgtccgttgtatttatagtaccatgaacggcccatgtttatccgaatgtactataaaaaaagtggatttttatagtcatcacgagaggaggtaccaaatcctgtacgtcaatgtaactagatctgacagctgatgatcctcagtaccgtgaggtactggagtatccatgcggtggtacctcccgtccgcccgcatgcggttagcaagtgaaagggcaaaagtggattttcgcatcgttttcggttgcgctgagtcgctcctttcccgatcccctccttggaacggcgcatccctttcctccaagatcgccggccggatccaagaagtcaacgacctcagcctccctcactaccacctatcgctgccaccgcccccttcttctccttctcctccccctccacccttctcgtcctagtcctagatccagaggccactagttcaactcccccatcccattcacatggtggacgcctgatttgtccatggtgagggaggagcatcagctttggtccatcatacatggtgctggagatcgatccacctgaattttggcttttcttttcctcacccaatgatgttcctgtgtccaatttttttcttacacgatggtccatggcaacggaggagctgatgctatctagttcatggtgatggagatccggtgtagattagttcacggaggagtttaggagctcgtccatgtccatggcgaaggagattcccagcctggattggcatttactcctgtgcggcacttaccccaagctcgccagcgaccccctcttccgacggtccgaccggacgagcatggtggatgagcagaggatgcacggtttctgcctcgcggggagggggaggacctctcaaccgttgttcccatcgtacccttttagaccttttagattggacggttggattttacttggtacctggaagtaccagttgccagaggtaccacctgttggaccatagcaaagctcataaagaaaattcaaatccatgtacctgttggaccgtagcaaagctcataaagaaaatcctagttatttgtttaataggaatcttatgtatctctaaaaatcttatttgatctgaaagagaattttctcattgaaagaaaaaaaagaattggcagctatatatggccagaaaagattatcagtctacaggtgctaaaatctattgcatacctgctgaataccatctacggcagaaaggagcaatatgtgagaatttgtaaactaagacaatttctgcattataagtaaaattcacccacgaagtacatcggtaaaaaggttggaaaaacatgattagctcagaaagctaaaattctgtggctgtcaagtaggcagacatggcatatttctgtaggttggtataaaacataatgaataataagattttcatgaagcatcataggcagttccagtgaaaaagaaaagcatatccatattcaacatatcaattccaagtggacttggtcaagcatataaggtgcaactgatacacacaattcaggctagatcacaaaaatgtcaaaactaattaacaagtaattgatgtaaactatcttttgcttaaaatgaacttgatcagccaagattgctccctgttttcatagacaggaccaaaagaagtcatagcatactgatcgactcattcccaaacaaatatagagcggattatcataatgcgaacagttatcctaatatagcacggctcagccacagaacaaaagatgggatattcatagttgtcggaagttgtcagacacgttaaatcattaactaattgttcatatgaaaggggggcaaatcattgacaccaaggtgacaatgcctctaggtatagattagtattacaaaacaccaactggtctgatccctacatgcatgcattaaattgacatcatcactttggaagctctccctctccattgagaatctcatattgttgtccaacttcgaagctgaagaagctgaggaggaggcttagtccgaatgctctagtcctgaaataagtagtgaccaaattaaattaattagaagacttagcagcagctagatagaagaagaagggattagaatcagggagtaaatagtaattagttagtaccagaaattaggattggcatgtgcatctccccagtggctgctgtgcactttggattccagagaattcttcagtaaagcatcacttccctgctgctgatactgcatagttgaattagggaatcaagcagagcaggaaggcataaataagcagcacaaagcagatagattagattggttacaattgataggaaacttgaagaccaaatgtaataagatgatgaggagatggagaaattacatctatttatccttattcttgcagtgaaaaaacaaaggtggcaatagaactaccttgtccaaagtcctgaggatgagccttcgtagtggcactttgaatgatttaaaactcatattcatatccttttctagttccttcacaaccatcccaaattcttgagaaaatgtcttagtgaaacccttttgttttggaacatcaccgagcgacctcacaagcgaattgataaggcgccttactctagcttcattgtgcttggcatacacctcattccagatcaattcttcaagcagtgcttcccgacatcgctgaatgtaatgaagaagaaaagttagttactctatcactgcagaaatgaatgatttcttattagcagaactagagaagcgctattattgggataaatcataataggttaagcttgaagtgagcaccttgaccatccaatgttcgaatatattctctaaacgcttcttgctgtctcgaaaccagttatgatatttctactcaattcctttaacaagtaacaacaatccagcagatacccgtaatcaatagaattgtcacttaatcggtgttagcttgtacacataaattagtactttaaccataaagttaggaacccaagaaaaatgaagaaactgattggttgtacgctggtgctctgctaatctatcgtcagaccatcttagccgcgtgcccgctatccggagatccccgaactagcaactgctctgtgccagctacgtcaaatgacaattttacagcagagcttgatcgatcgcttgctccttgcctctgtcatcactcgccaccgtgacaacctacgaaacattcagcatcgttgtttagcaggggctgttcacaccagaagctaggtatggcagctgccacaccttgccacaagggagggtccgcccatggctgtcatgccgtcagcctcgagctttattcgctttttctcctgagttttttttttttcatcacacatgcagttccctaattctagatgtgagcatgtaaggttaggagttctatttctaagcagcatgcacatgtgaacaggtacttcggttgaactgatggcctgatgcccaacaaaataactaggctatctatttaattaaatgtcctatgcagttccaaataccaaaatgaaaagcaatatctgaactcaagcaaaatagtttgctgaattagcagagggagaagcaacggaggtcgaagaaaattcaaggctgatagcaagatggcagtcagcaagttgacctattttactcactctcgtaatggttcatctatcatccttgatcactaggtagtttgactaacagtggcagttgggctatacatcgatttaccggtgcatattagtttgttggattaagagttcgatggaacaatcagtgcacacgtgagcatcatgcctacagatttaacttctggatttgtgtgctcacatctagaattagagtgttgcatgcgtttagatgaaaaaaaatcggccttttctctgtcctaatccaccaaaaagtattgtttgacttagagaaatgggaagtgcggcgaccagttgaaatgtataccatctgcttggatcgtcaagatcataatatggagtagcaatcttgatttgtttcacataaaagcggcatcagcaaggagaggaaaaaaaataacagggtcagggtgatgtaattgtaatactagcgatatctgttagtggatcatttgctttgtactattgtatacctactagtttgactagaaacagaattcaggacactgggtaggtgctcacatttggaattatttgtgttgcacgtgcttggatgaaaaaaaaaaagggtagaagaagtgaaatgggaagtcatcaatcattactcttgctacaaaatgcaagctgttcttgttgccatcttctcaaacaaatgaaacaatcaaagacctgacaagtaaacgttgttgatgctttgaccacaaaaaaaaaaaaagaactactccagatggaagaggtgcacaagtgttgtctcacctgaatggcgtgtttggtgttggaggcggagaagtggccgacgttgggggcggagaaggagcgcgcggcggtgccttggggcaggaggggaagggcgcgggcgcggcggaggagagccccgagagccatcttgccctagccttccttcttcctcgcctctctctttctctggtgatggtgatggatttgggaggagaagccgaagcggaggtgggggagtatctctctcgccatccatctccgttccgttgtgttgctcccgttctccgttccgttcggctgcctctctctctctcaaggctgtgttcggaaccctcgcttcccggcacgtaaaacaaagcagcacttaacacgtaattaattaagttttaactaatttttttaaaaaatagatcaatatgaattttaagcaactttcgtatagaaaccttttgcaaaaaaacacactgtttagcagtttgaaaagcgtgcgtgtggaaaatgagggagaggggatgagaacccctgcaaccgaacgcagcctaataatgaggcctggaggcgcatgtgaaatctcatctctacccttccacctcaaccctcaaccattcttcctctaccgttggatgccacggatgcacacatggcaggtagcgagagagatggtgccgaccaccgtaggatgggattgagatcctctaacttaagtcacatgactttgagtcactgacatatgggttttctttgctatgaacccacatgtcagtgactctaaaagtcacctaacttaaggtagagaatctcaatcaccggaggattatgcggcaccggacacgtgctgcgagccctcgtcgagtgggatgttgctctgctgccacctacgtcttctccgcatgcctttgccaccacctcctgctcttttcccgttgaccgaagagggacggagcggcgggtaaggaggatgtcgccccctgcttccggctctccttcctgcggtctctcatcccttgcgctcgccgccgcgagggatggtgagaagtcccgtcgacaccgcagcacaccgctaagcgtggagtgtttggggaaaaatatagaggggagaaagaggctgacaagtgggcccctttttaaaaaaaatctaatcacttgcatgtcaagtgggggccaccttctgtcccccttactatcatatctcaccctctctccacctttcttcttatcggtggggagcggcggcggcggggctctcttctctttctcaccctggccctttcgggccgacgatggtgacggagtggccaattgagagccgggatgtgaggcggcggtggagaagacggcttggaggaagaagtggagaagcaaacaagcctgtcgttcgggagcacgtcattggcgagggcctccttggagttggcttacatatgggcctcacttgtattttatgactagcttgccacatcagtaaaaaaaggttgaccaagtcaaaggccacgttagcgaaactgtcctccaaaaccgtcgaggaatcaaattgcattgattgtaatagttgggggggtcaagatatccgttattataattcaggattcgaattagatttggccactagttaagagaatcaaagtggacttactacaatttttaataagagtgaaggagagatggactggctggcccaaatacaaaactagtcttgatgtgtcgctggcatgataaaaaaaaattcggtccagagattccaattccaacacatatgaaaaaggaaaaaaaagttcaaatacccggtagcgctaatccacgcgctgcgtgcggaataataattcgagcgccgtacaacgctccctccttccggttttcctaaagcttctgctgctcagaagtccttcgtctccacatccatgtccctcccgaacctgcacaccagcatgtcggagctgctctagggatatgtctctgtatggctccacctctacttgatttccttgtagatgaaaaggatcggcacctccattgataaactaaactcgattcgactgttggaaatagctagtgacttggatgtttggttggctttgtttggacctactataacaggcatacagctccatcacccggcgacggcggcgttggagctcatgccctgctagtggcgacgcaaaaaggtgcgagcgaaggcagtgaagtttcgagtcgtctgaatttaatgtttgtcttctggtgtatttaatatcgtatcatttatatacttatatcgatgtaccccaatactctcagaatatgatctatgtatatccccgtcgacagattaagctaaatattttattaatacaaatatcatagctacatattttattaagacaattactatataatttaagtagtcaaatttgttccttccatgttgaaaaccaaatacaaatttatagttactgggctaaatagtttattattattattattattattattattattattattattattattattattattattattattatttataatttaagttcccagtttgatcaaactaaaataaatttaaacagaccatgtgatattttggaaaaagaataatagaacgagtagagtcgagggaggataaatagaaaacacctaaaaataaaaaaaaaatagaaaaagcattgaaccatcgtgctaggctgctagcaccactttgtttactttaggagcctgcataaaatattttggacgagctctcgtgatgtgacaatttcattgcggacgttgtatctcagtgcccactttgatgtcattttttttaaaaaaaataatcagtttttgatatttatttttgaaataagttgtataaaatgattagattgtcaaaaattcgagaaggggacaatcgatcaacgcctgaattgtatcggtgtttccttttatcgtcgttttgtttggttgaaactacgagtactatacatgtaccaccggtggctgcgtgtacgtgcagaggtgcagccatatcgtaggaacgagagtttgtgaaacttctttatttaaaccgcatggtgttactataaagatacgtagcacaatttggaaaacgtactttaacttttaaaattaagttttcaaatcccttctttctatataaagttaagacccaaaactgctatctcctgcctccacgtcaccagctaattgaatccgttggatcaattcatatcagctactgccaagcgtaatattaagcaccatgatctctcttcagatgcactttggaggcccatttctcagtttaggcccaattgattgcgagctcagagcgcaagagaaccttcatctctttgttcgaggtgcctgtggctgcagcctagagcgacgacgcattgtcttctctcaaatcaatggcctcgctaattaagtccgttcaaatgcatggcactacactaatctacctcatcactacagttgttttgtgtgctcatacactgattcaataatccgaatagccattttttttctttttttccttaaaatgattcaattgaaagaaacttgcttttatagtttcattcataagttcacagggtctacagtataatgtttgtgatgtgcaataaactgacctaacaaaagaaaaaaagatgtcttcgtgcatgtctgggattgcatgcactttggcctgccaacacaatgcaataattatatatgcattttgtgaacgaatgttctatacatcctccccatctctcacaggtaatttggctatcttgatgacttactctaatggatcaacatgcaaatacaacttcaagttctttgtgtcatatcttattgatatcttattgctttctctttattattattattttttatttttacaaatatacttctttagtttaatcaagagaaaatttggcttcaatcaaatccgctctaattcctgtgccaacgtttagtgtccaaattgcctgcctctttcttcttctcttacgaaaccaaaacaacataaatttgtcttcagatgattcatctatattgtttcccttccttttcctctctcataaagttacatcaccttagttttgcttagttttgcttttagttgatcaatctataatttaaattgtcataaaccgtatcatctaaattgcttatagcttttttcaactatcaatcaaagatgcaaattttataaagtatataaaattatgttgtctagctactccctccggtttaattttaattgatgttttggacaatggcacggactacaaaatatatctttaaccttatttttctatcataatatatatattaaataaatacatgtttacttttgttatagtgctttgaaagacaaatctatatatatattgttctagtttctttaaactaaatatttttaaagttattaatggtcaaagttataaaaatttgtccctaatcttgtccaaaatgtcaattattataaaaccggagagagtacaaaacaaatcctaccattatcatgcaaaataaattctgcagcaacgtgcgggctttcatttaaattataaccgccatttgtaagctggagggcaaatgacggggagtcccctaaaaagatcaacaaccttgctacttgtacagtcaccgtcaggtgggccacgccactcgctcggatccagggccccacctgtcattagcactggccaatatccccaacttttcttcttttttttctttcccctttccctctcagaaaaaagaaagaaaaaggaaaaaagattcatctcttcctcctcgtcttgtccccttccctcgtcgaaaccctagctaggctcgccgccggcgacgcccgcctcgccgatgcgctcccccacctgaccgctccgcctcgctctcccgggtcgtcgttgcctcaccgctgtgcccgcccacccccacctgggcagcgggcgggatccagtcccagatcggcgccatgtccaaggccagggtctacaccgacgtcaacgtgctgcgccccaaggagtactgggactacgaggccctcaccgtccaatgggggtgagtgcctcccactcctacctcggtacctcgctcttgcttccaccctgtgttgtcgcctctgcatctgcgtgggtcagtttagattcagtgtcggatgttgcgtgctgatacgtatgataaagctttttagttacccgtttcatgactttgcaatcgccggtgttatcatcaagttattaggattgtaaatagaattgtttgtgaatcaactgctgctcttgttgttattggagttccattgtttcaggttgcatgttagattagtgatcttgtgcggagagctgtcaaattgtttagtttagatagaactcggtcttatttattgttacagtcgatttcaattaattatttgttatactccaacaatacaagccaaggattatgcaatatacagagctaaattgaagaatacgacttagtgtacactggtaaaccatgtcaatgaaatgaccgtgtagattataataaacttctcctacatcaaataatcataaattggatctat

SEQ ID NO: 75772 - DNA, 11635 bp, Oryza sativa
catcacttcctccactgctccagccgagagagggagagattgagcgagccgacgcgtggccgcaacgtgtcgtcgatctcggtttcccttttctcgctctctactcctcccagacgcgtcgccattctccattcaccactcagagccgaagaaaccgagggaggaggttctctgcctctccattgccccaaaccttgccgccggccgtggagacgacgaccatcgccatcgctaattgggtagaggtcatctccaggtttttcgcgttcccttctctccacacagtgccgaaccatttctcttttgaccacctcccgttttgtgttttgtgcatcacagccaccggaacgcgaccacgccgacaacgccctggagcacgcaccggagcgccgccgcttcaaccatcgtcgttgtccggccattcttgaccacctcggagcaagccgctgcgccatcgtcatcgcctcaacctcctcttcaatacgcctcaagaaccccagccggagatgtgaaggactcggagaacgcatcttttcttcaccggcgccgatctagaatcgccttcgccatcatcgtcgattaccgctgcctcggtgagccattgtttgatttctcgcgcatacaccatctccttgacctcacaaacctcgtgcatgcttgcttgtagcagctcatcgtcccgttcgagccgtcgtcgttcacccgaggaggagcaccgtcgccgagccgttccacaagtcaccgctgccgccaagacctcgacaaccctagctcgacccacggtgagcatcctgaaggctagaagaccacatgcatgcatcctttttgttcggaatcgacttccatgcacacatgcgctttcaccccaagaaccaccgcagctcacactcgccatcggcgctactccgatatcctctaactaagaaaactagaggaatggaatcgcaagatcatgctcttcattttatcttttaaccccaactccaaccgagccaccaatcgccgccggtgaacccgggatcgagctcagccatggctgctctgcctctgtgcgtgtgaaaaaggagtcagggacttcattttgagaatttaaataaatataaggttcattacgtaatgttcccaatcaatgacatatggaccttggactgcgggttgatttcctgattccctaggggcctttttgcatattggcctgatactgacaggtggaccccatgagtttaaaatctgaaaatgtaaaaagataatactaaaagctttatattttcaacaggaaagcatgtaaacttataaaatccataacaaattgaaaacaactcattttagagtaaatcaaatttctgtgaactcaccaaatcaagaactttagagttattgcataaaactagacattcactgtacaaactttgtctctaaaattggtctaagataaatcatacataaagcatacacaaatttataaaatgcatataaaattcatctcaaatcattttatagaaaactcagtttctatagatccaccaatttatgttttcctataaagtaaaatgaaatagtatacatactttagatcaaatgcctctgaaactattatctttaaaatgactagttttaggtaagctgaattttagaaattcacataaaattcatcttagatcctttttgagtaaacccaagttctgtagaatcaacaaaacgtatacttccatgttataaaataaaattatacacctactatgtaataaaagcctttaaatatttatataagtaataaccaagatagagcaacctttactttgtaaaatttgtagaaaattcatctttagttcaaatgaaatgaaccaaatttccatagaaccagcaaatagtgagcttcaacataataaaataaaatattgcaccttttgaacatattatagctctaatctttaaatagataaccttggagttaatcacctagtaatggttaagcaaaatatatgtgtaaggtagttaaaaaaatgcattctagctatgaataaaccaaaataaaacttgttagaccagagaggccatagttccatccccatccactaaaacatagaagaacttggctcatataacaatttctaggttaatataatatattgctagtttagtttagagcatctctagtttataaaatatgaaccatagtagtaaagaccataaacatttgaactaaaaatgttttagttaaccaaattattccttttattcaacttaaacaggaagtagaatgttctgaacctacaacttaagagtcgtgcacatataaaacactatatgcctaaaacacgttgtaacttgtaaaatctataagaaaatcattgtaactccaaaaattgtgaaaccaaatgagttagtcttataaaacacatctctacacccctgtgaagtctaatctagtaaaaatcactttacaaaagtatttcataacactacctaagactatactactataaaccgataaaacttctaaaattcataactccctaatggaataagataaaataaaaattctttcacctaaaattcattttagaccagtacctaatcactgtgcataaataatgcattttagagcattttggattttcagctatttcggtgtttaattgcataacgtgtcctttatctagataattgcataatcggtgaaggagtggattaggtgctaacatttctctgatcaaggcaagttttctcctcccatcctttgaacacattgaatcccatgatttgaggaatgaaaatatttgtttgcaaagttgcatgtgaacttagactatattggtatttgaaattgggttaaggtagttatgacctatttgctgcataccccaccttgaataattgatcctcttgctatttgaacccctagaaatggttagagtacactctttgtgctcaaatgggtttatatatgctctatttgcaactacttgcttagccatgcttagaactatgcaaatgctcattccatctataattaaaatatgattttgatacatgaacctttgctggaataaaatgaatatgatgggtatttgcgaactaaaatgtgtaaaatgtgattttatacttgggcggcaagtggtgtgcatatggtgttagttgcataccgatagggggagtgtttgcccaagtccataaggaccgaacttgtgtcacccatttaaagttattcgtacatccacatgtgctagtatgggatggcctaagctgagtaatctatttaggactagccttgcattctggtaggccggtgtgtatgagttcgtataattcagaggggcttcctatttaccccgccgtggtagtttaggtgactaagcgtgtccaatacaacggtattgtgccacgtggtgggttcccgtcgtgtccgccaccacggcgttaagtttaaggcgtgggcccgccacttaacggttctaggtatattccaagtatgcctaggatggaggaacacgtatcgtgctggtgcaaggctaggctctaagtagtgtaaaggcttcgttatgacctctagatcacattcaaaatgaagagtgtggtggagtcttgcaaactcaaaacaaactagagagttcatatcatgtgggtaaagctgtacaaactctgcagagttttttaaactaatcgattagccgtgctcacggtcatgagcgctttggtgatgtgtcatgagtatagactatgttttaaaaatgtgatcatgtgacattggtttgaaattgatagatgtgttgagttgtgtgtgtgaggtgatatattatgacttattgtcaaaggatgacaacaagagattgattatgatggaattatgatgaatttaatattgaaacttaaaatttgttttgttaattgaagcatcaactcctttacaaaagaattgcgaaacaaaacttgctttatgctgaaaatgaactacatattgccttcctttgaatatatgccttacatgtagtatggtaggattgacttgtgcttgccagtacattaacttgtttaatgtactaactcttgctgttgatataaccttttatttgcaggtttagtcttagtctttgagtgatgcgggttccgattgtttcttctaggatgagaacttaatggggtaaacccctagtcggtgtgcttgtgattgggtaatcaagcttccgctgttctctaataagtctatttggccggtcggcctatgtaattattaagttgttgtaagtcttaagtttctttcatcttagttgtgtttgctatgtataatcatgcttaagatgaaagtgtggatctagtgcacattctgggaactagattcacatgagtatgagttaggaatatttgagaggttgtagatctttagccatttttgtcaagtctcctgaatgtgcaatacatctggtcgccgccttcgagtggtttgacgggcacatctcaggctgaagttgactggcaggctaagggcccagcaatgtctccaatattcctctctcgaggcgtcggatgtttcattatatttgtttgatgacttgaattattcacttcatctctcaaatataatggaaggtctggagagcctacgacatcagggagaatttttttcgaaatctctttgctctgaaaatcactaacatgacttaaagagtaaatatcataacaccggaggccgtgttgctaagtttaaaagtgtcaagactcctctaatagtagtttcttcctttgcccttggttgtgaattgtgcccaattcactcccctctcaatccgcggtttcgttttgcatggcgaaccgtatccgttttcgttcgcgggactgtttccgttcttttcctaaaacggcaccgcattgattttcctttttgggaaagtcctagttccctcctctttcttttttccctctccctctctagctagccgagcgcccctctccccctcccccgcgcgcgccgcccctcctcctgcggagtcgtcctcccaatcctactcccactaggattcaccctttcataatctaatcctcccctgtataagtaattcctccccttgttttttttccttttcccaaccaatagctctagtctccacccaagccgctgccgccttagcgccactgctgcccagcgctgtcaccgccgctggttgccatcaccgtcgtcgctgtagcgccgccggtactctgttctcctcgtcctttgatgtaattgcttctgcaatcatcaatctagcaacctaagtttttcccctttttgcctccctctagcgtcgtcgtcgatctcgggtgctgcccccggaaccgccgtcgctgccgtcgtcgtccttccccggtttttgctcctcggtgaggaatccctcctgtttttagggttttgcttccgtgtgtcgtagattaattgtctaaaccaaacaacacttttggtcaccgtacacacttcgtaatgacccggtgcaacgcacatgcacttttgctagtatattgtaaaatacccttctcaaaaaaatagacttggaagatttgctactccgtgcaggcagtggcggagccacatggtggtccgtgtgggccatggaccacagtaaaatctggcccaaatgcctattacccttgttctgatccaaacatagaaaagaacgatgcttttgtttcataagttgatttgctttatcgagttgttgttccggtttccgtccttcctagttcccatcctgactacgccatcgatcgtgcgagtgctgctttcataactcgacgactcaacgcttgggattgggggcccatgtccaatggcggcaacaggcgtctggcgactaggatcaagagcagtgttcagcaagcaggtatatcactatattagtttcggttcgattttgggaattccgattagaattggattgataaatccgttaaaacaatgcataatcctattgtagatttgttgaagcagttctatgttaatagtatattaacattaatagtgttcagaaaaattatgttaattaaattggaccaccctaatcctagctacaccactgcgtgcaggcaccgtcaattagttctatgttgtgattagggcttggtgagtggaattggattatttgctactcatcagcgtcatcggtgtttgcggccttggacaaggacaatgacggcaaggtttccgcgttcgagctgcgtggctgcatggtggtggagcttggcgaggacgtgttcgaggaggcggcggcgatcctcggaaaggctaaggggtgatcgatcgcccctagcgcggttcccccaccctccacgtaattttctttttcggcaccatattacttttctattttagtaaatttatgcacctaaagtttgtacatctcaagtttacacatataaagtttagagatccaaagtttataagttaaaagtttatatatctgattcaaatttgaatttgaattcaaatatttttatatatagtatttctatacatctaaagtttatacacctaaagtttatagatccaaagtttataagtcaaaagtttatatacccgatttcaaatttaaatttgaattatatccgatttcaaatttgaattgaattcaaatattttttatatatagtatttctatgcatctaaagtttatacacctaaagtttatagacccaaagtttataagtcaaaagtttacatacccgattcaaatttgaatttgaattcaaatattagtttatagacccaaagtttataagtcaaaaagtttacatacccgtttcaaatttgaatttgaattcaaatattttttatatatagtatctctatacataaattttttcaactttgtttttttattttttaaaaatgtatggtgtagtaagaagagaagagggggtaggaagggagagacagtagcttatagggggatggggggtgatcgcctggagcggtcacccgaccattagccgaacccggtgatcctcgctacggccgactacgacgacgacaggttgcggaaaagaatatattctttcactgatttgcgggttccacatggattttatttttttgtttcttctagtgccacgtcaatgccacttcatccaaaaccactctcaaaactgccttgcgacctaaagtgatccagttttacaagattatggatgcgctatatctggtatttcggtgtagggatgattttcaaactctgctacaagatgagagaccacaaatgaactttttccgaataagatagagcggggaacttaatgggctaataccaagtcaatgggccagatggtaacgggtcgacccgtcccggcccatgtgcaggccgtaccgttgcacggcacaccgttccgtaatctccctcaaatcgaaatcctatttgccccacttctcccctgtctcttcctcccacaactcccctcccgaaccctaaccctagctctccccccgcgccggcggcggccatggcgctcatcaccccagctagcggcgggggcggcggcggaggagacaaagccccaccgtccgcctccgacccgagcctcgggttcctcactaagcgcgacacggaggtgaagctgccccgggcgacgcgggtgaagaacaagacccccgcctcggtccagatcaccgcagagcagatcctccgggaggcgcgggagcggcaggagcccgagatccgcccgcccaagcagaagatcaccgactcaatcgagctctccgagtaccgcctccgccgccgcaaagagttcgaggacgtcatccgccgcgtccgatggaacgtcaacgcctgggtcaagtacgccaagtgggaggagcagcaacgggacttcgcccgcgcgcgctccgtctacgagcgcgccctcgacgtcgcccaccgcgaccatacgctctggctcaagtacgcagagttcgagatgcgcaacaggttcgtcaatcatgcccgcaacgtctgggaccgcgccgtttctctcctaccccgggtggaccagctgtggtacaagtacatccacatggaggagctacttggcgctgttgccaacgcccgccaggtgttcgagcgctggatggcctggcgtcctgacacagctggctggaactcgtacatcaaatttgagctgcgctatggtgaggtggagcgggcaagagctatttatgagcggtttgtggctgaacacccacgaccagatacgttcattcgatatgccaagtttgagatgaagcgtggagaagtggagcgcgcgcggcaggtgtaccagcgtgctgcagacctgctcgcagatgatgaggatgcccaggtgctgtttgtagcctttgctgagtttgaggaaaggtgccgggaggttgagcgtgcccgagctatatacaagtatgcacttgatagggtgcccaaaggccaggctgaggagctgtacaggaagttccttgcatttgaaaaacagtttggtgaccgtgaaggaattgaggatgccatcgtgggtaagaggagattccagtatgaggacgaggtgaggaagaaccctctcaattatgattcatggtttgattacattaggctggaggagagtgttgggaacaatgacaggatcagggaggtgtatgagagagccattgctaatatccccccagcagatgagaagcgttactggcaacgatacatttacctatggataaattatgctttgtatgaggagcttgatgcaaaggacgtggaacggaccagggaagtttacagcgagtgtctcaaattggttccacacaagaaattcacttttgccaagatgtggctcatggcagcccagtttgagataaggcaaaggaatcttaaagctgcacggcagatactcggaaatgccattgggatgtctccaaagggcaagatattcaaaaagtacattgagattgagttgtatcttggtaattttgaccgttgtaggactctctatgagaagtatattgaatggtctccagcaaactgttatgcctggaggaagtatgctgaattagagaagaaccttagtgagactgatcgtgctcgttccatatatgagcttgctattgctcagccagcccttgatacaccagaagttttgtggaaggtgtgttgttctttctgttatcctagtatatcctcttttttagggctttcaaactagaagtggtagatatgtatttcttatttctcttgttcctcaagtggtaaatggttctatagtgaaacgtatacaagcattgttttaatttctaaaatcagttgatttcatattgtagtgaactgttgaattgacattgtctgagacaccacccactcatcacataaaaactttttcctcgttttattggtattgctgtggcgcctaagcattccaacatttatattttataatgtatctgaatatccatagttcaacaatgtatgtattttcaatgtaaaaaagggacaattatattcaccattgaaaaatgttttgattatcaagttaaagaaccatcataacccatgcctactttttgaaaccatgccaattcaaaacacattctgtaaacaacagtagtgggatggttctacctaatacctataccaattcttctatggctgattctttggtcctaaaatacattttacttgataatattggttcatatctgctcatgttttgattaaaggttctgttcatttcatgaatacaaagcaaagttgatatttaccgatcagctttgtttctagatttcaatataatgctataatgtgtttgacatactagctagagagtagaaaataagcttgattggtatctttcttggttgttctccataatatggaaggtgtaacttttatgggcataatgggcatgctgcataactagtcccatttttcttgttttgaacactgaatcccaatatttatttcttttttgagatctaggctttgtgtgttgaagtgtgtattgttttaccattgatctttgcattattatattctggcactcaaaaaactgtggcgtgattgttatttgttgtctattcttcaatttctattctatcagatttacttcagcaaggctagaagcatatttctcttcaactatatgataatatctgctatttcacagcagtggcatattgatgtagttatattattcaatgtaagattttgacatacatgcttatttagaataagcatatctattttagatgcctcatttgcgtaaatcaggcggcactttttttggcattcttgtactcttttggttttttggctcttattcccccttgaaaggtgaagggctgaaccatgtgtatagtactaatgccggctaataggaaactcttttacgctcctttatggtcttgaatttcctcatcctttttttacttaggagaaaatgtgatggactatcaacattttacatttatgtccagaatacagagagcacattctgaaaatttgggccttctattaggaagtttttcaaatagttaggccctgctgtgatggtgaattaaaaaaaaggcagtttctttcagtaatttcactagaataattggaatatttagttactgcaggaataaggataaaattctctatacaaaactgtgcatgggcattgggccgtaaggcgcccatgggcagcccataccaggcaacttagatataagattattagttaggttagggataatacatcagtaagagttaaagataagactaggtcgagtccttacttaagagtccaattattccatctatataaggatgggaagtctattatcattaagcaatgatgaatatcacttagtctaatctctccctccccataatgttcttctccctagcctaaatctacatcccttctccaggagctgatgacgcacgtctatcttcctggctgtgggtatcctgtcatgacctcaggtcgtgacactgttatacatgttacaactgagagagccatcaagcaatggtcttagaaaatctacagatactgacttatttagtccatcctggagtttcatgtgtttatttgctatgtattcttaatcatttcctgttttgtatcttacaggagtacttgcagtttgaaattgatgaaaatgaattcgataggactcgcgaactatacgagagattgcttgatagaacaaaacatttgaaggtatggataagctataccgagtttgaggcctcggctggtttggctggggaagacggtgagagtgaggagattaagaaagaagttagttatcatgaacagcagatagaacgggttcgaaggtgccgaggtaattgagagcaaatttattcatgggtaattgaagttaggcaggtacctctgttccttttgtcattcaaagtgcaataaacctaacttatatttccttttttttttcaatttcagcaatctttgaaagagcattcgaatacttcagaactagtgctccagagttaaaggaggaaagagcaatgctccttgaagaatggcttaacaaggaggtgagctttggtgaccttggtgatgtcaccttagtgcagaaaaaggcgccaaggaaagtgaagagaaagagaccaattcctacagaggatggctccactgttgcgtatgttccttactcagttatttcattatgcta

SEQ ID NO: 75773 - DNA, 1948 bp, Oryza sativa
attcctgcagccccctgttttccatttaggttgcctgcaatttagggaacaaatgtattgatacaatattttgttaaccttaggtatgaagagtacattgattatattttccccgatgaggttgcgctggctccaaacctcaagatccttgaagcagcctataagtggaagaagcagaagacagatgatactgatgatgtctgagctaaactgccactgtttctgtggtcacgaatgagctaatcgttgtcaaaattagatctgaaggtcttctacaatgctgggtaaagttgtgaatgtgccctacctgatcatgtggtgtggtgctggcacttcgatcaattcagttttacatctgtatgtctgatggatagaaactgaaacaagttcatagtctttaatttagttttggcatgcatgatcttgtttcttgctcacgatatttgtctctaaggtccaaaataggagacggttgttccttttagttttcttttatttatacatcaataggtaggcagctccagccatattagtctaagaatggcgcattttgtgtaaagaagctgcctgtaaggtgcggttgtgtaccagtgagatggactgtgaaaacttgtcttgctgatggtatccaattttcctgagcgaggaccgaggagatagtgcatattaatctctctaaacgtcgtgggagcgctggagatttagagtgccatgtcatcgacttttttcagaaaaacccttgctctttccgctaatagtatgtgcatccctgttaacgtggcccgtcagatcacgtgctaaggtcgatctgaccgtccacgtgtcctagcctggctacccttccaccatcgtctgatcgacggtatggatttgccaaaaaccctagccacctcaaacctcgcgccactcaacgcgtagctcggccacccgacgttcttctcacccacgtcgcctcgcccttctctcctcgcgcgcgctgctgccttgccctcctcctgccgcaggcagcccggcctcgcctctctcggtctggtcgctgcagctaccaatgagggaggccagcctccccacagatggatcagaccgcccagatgaaagagatgtgagccgcctccaccttcttcttcgtccctcttggtgtagcgccagatccgttggcgggccatcgatggtttggtttcccaccggtggatccggttgctcggagccttggaagcgagggagcaagctgtcgctgccaccctctactactctccttctctgcacctccaccgcccctctccttctctcagctccaccaagtgttagattcggcttatagaggtcgccgggtttggtaggaggagaaggtaggagcggtgcagctgttggggagaaggaaggaggagggtcgcggcttggccattactgtgatgacgacggttgttgctcggtcaggtcgatggctagggatggcggcggctagcggcttggttaggacgatggtagggaatagcaagtcggcaatggctcagtctttgcttttcaatttatttttctttgggagaggaaacctgatattgacaggcaattaccgcgaaaataatgtcatcctgcctggatcacctggtgatgcttgtattggagtcacatcaaggagcccagagtaattccattctctctctatgcaatatgtgattcttaattcattgtgaatttgtctaattttatggatctctgaaatcccaatttgcatgtccaagatacacagacgaagcaagagctgttcatgaatgtgatttgagcaacatataacaggtaggttgtgttcagattcttttttacttagctcatatgggaaagacaaggtatgcttctttattctctcattggtacttaaaaaggatcagctttacctatttatacatgagtgcttgcagtactaatacaaatcattgccatgggttaa

SEQ ID NO: 75774 - DNA, 15581 bp, Oryza sativa
atattatatattgttagtttggtggaactatttcagtgattatcatatgtctgagatattatattgttgattgcacatttttgcaaatggctgaaacaattctatttttatttaattgctatgccttcgaaactacattattgtttcagactttctgaactttcttgcaagatatcagaagacttttagcattgcccacattcatataaatgttaataaatctatacatacatacatacatacatacatacatacatacatacatacatatatatatatatatatatatatatatatatatatatatatatatgtgtgtgtgtgtgtgtgtgtgtgtgtgtgtgtgtgtgtttagattcattaacatctatatgaatataggcaatgctagaaagtcttacattatgaaacggaggaagtagacaggagtgcgggttttgtttttgtaggcatacatgtcagttcatggagagccccatggacaaacaaagtctgtcctgcaaattctttgggtggctgtcgctgctccataattgactatgaacagcgattgcttgcaattgaggggttggctaaataattatctttttgccaacattgtgggaggaatttagagaccgccgaacagtttaacttgttcctgcattgcctcttttaggaaactggatgcctattaatagaggggatgagattcattattgtacacttgaggaagagagtgaataagaaagcatgtcactctaatatctttgtaaatgttatgcactctctctctctctagtactctcttgcgggaggggttgcactggttgtacaatagttatcatcatgatgttttattggaactagagcagctagttgtaccagttgagtttctagcatcttattaaatatcagctggttttagaaagcgaaagctaagccgtcagttgattaaagcacttattgacagttagcttcttgcttaaagcatcagtagttttagcttgggcaaaaacaagatctttcaagggaggttgattattaaaattaccgttgttgccattgcctccttggtagaacaggcagggctggttccacctgtggcctccttgcggacaatatctattgttattcatgaacattgcttcctcctcacgggtctcgagacagtctgtcccggaatgacctgcattctcgcagacctcacacgtgatgtacgagtccaaggccttgactgtgcctcagcttgttcttttcctagtcgtccaagcgcttcattaggaagtccagttttgcagctaggatttccatctccttgatggtatgcatgccacgggtctggagtcgttctttgctccagcccatgttcgagaccatcttctcaattaagtcgacggctcctctgatcgtctttgagaagaaggctactccagcagacgcgtccaaatggtcccgggacgagggggtgagtccattgtaaaaactcggcaggatcagccagtcgtccatcccatgatgaggacaggcggcaacgtactcttgcagcctttcccaggattccggaatggactcgtcccttctgctagaagcttgaaattctcccacgaagggcattggtcttgcccatcggaaagaactttgataggaatgccgtagagcattagttccaagtgtctatctttgcacggttggcataaaatcactgctttgctttcccatagagggaaaacggaaacagtctaagcctgccggtgtctgggctgacgcctttaatcgtgctcgtgctacagatatccaagaactgttgaagatgagcaccggcatgccatagaatgagcttgcctgtgccatcataatgaggctagtcttcaagtcaaagtcgccatctcctaagttgacgtgcggcccaatgggcacattgtcagcggagggagcaacgaactcacggagggtcttctcagccatgttcttgaagctcgatgacactgggatggttggtttctttgccgataatgttttctgcgaagggacaactcgcggtttgacaatcctaaagaaaacttctaggttgtcttggaagtttttcggcaaattgaaaccggtcatacactaccctgttttcacgacaaaagtgaaaacaaccaaggttagcctgcaaaggacaatgattatacataggtaaatataaagttattaccatataataatctcttaatcattaatcttccctagcaacggcgccagaaatgcttgttgatatttcttaacgacactactagaaatataattcctagcaatggcaccgaaaaattctttgtatattattgttgacggtcattatagaccaatttcgaccgtcaatataactaaaataaaggagaactagctatacttgcaatgcatatttgttttagaataatctatttctaattgtacttggattttattcgattgcagagattgctacacaaatgaaggagaatcgacaggaaaactaatgaatgatcaatcagacgctgttgagaagtaggcttatgagtaaatgggcctaaaaaaccagagaaataacctcaaaaggcccaaactccacatcactgaagtgaggagccaacagggagatggcctgcaaaaaactaggctagttgggccagcccaagcacctgctctgttggatgcagggtttggtgtggacgtttccgacctttccaaccatctcatagttcagctataaaagtacctcaccttctccactccaacacacactcaagcaagaagcacttgatctttctctcaagtttagtttagtactctagtgctagtagagtagaatagaatagttttttttttagtcctctagtctctaggagatttcgggtatggctctagcagtttttctctccttttgtaggacttgtcaaattaatagaatattcttctttatatatcttcggtattttactttatcttagtaccggctttattttatatttgtctcgatatagttgtgtgactagcttaccatagaggtgcaatggtgtgggtttaatgttcatgcaaatgattgctctatgtcattctagaggatatggagtagtatttaataatgtaaacatggtgcttagatttatcattatttgggcatatatggtgatagctcagtacgggtattcctctacgttagtatatattcctaagacactttccttgggtgggtactcctccgtatttgattctggtaggatggtcatgacaggttgtcgtaataaactccgtatttgatcccgattggatggtcatgacgggttgtcgtgagaaactcggcaatcagggttggtctctcaaaacaccaggaaggcactgttagggggtattggttgcatagctatatactagcaattgtaaactaaagatgcatatatactagaagtataggagtgatttgttttctatttcgttcttcacatagcctagatttatttaatatagcctagatttatttaatgagagtatgagtttttcttacatcgtgtcactctacccagcataaatgaattaacccctgcttagactataatgtatataagtaatatataaattattagcatagttctctcttataaatctttctcttgtgtcggaggatgtatataagtaatatataaattaaaattctcttgtgtcggaggatgtatataagtaatatataaattaaaccttctcttgtgtcggaggatgtatatgagtaatatataaattattagcatagttttctcttataaatctccccttgtgtcgtaggctcttcggatctcccattatatttgagagatgaagtgaataattgaagtcatcaaacaaacataatgaaatatccgacgcctcgagagaagaatattagagacattgctgagcctttagcctgctagtcaacttcagcctgagatgtacccattgaaccgctcgaagacgacgaccagatatgttacacattccgagacttgacaatggctaaagatctacaacatctaaaatattcttaattcatactgatgtgaatctagttcctagaatgtgcagtagattcacactttcatcttaagcatgaagatacatagcaaaatacatttaagacgaaagtgatttcaaattacaactacttaataattacaatggccgaccggccaaatataattatattagagaacatcggaagcttaactacccaaacacaagcacaccgactaggggtttaccccattaagttgaaatcctagaaaaagcagtcgaaacccgcatcactcaaattatgccaagtctattccctgtaaaacataagttagacaaatcatggcaagactcagtatattaatttgattaatgtactggcaagagcactatcaaacctgtatacatgaaagctctaagtcaaaggaaggctatttgtggttttaattttcagcataaagcaaattttagttcacaaaccatttgcaacgtaatttaagcaaaacatttaagaaatatgtaaagcataataatcatggcatggtcaacatatgtagataagcatcattcccttaccaatccgaaagtaaggcaatcatacttgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgcccggccccgagggccgaggcgccccgaccccttgtggagttagcgccacatgaatgggttgggtgaacacggtaagcctcacctaaccatatttattgcagtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttggagatggcacgttagccctggttagatttataccaggcttcatcccaaccattacaggcaagatgctacatgaagaagggcaaacatgcacgttgctaagctgacacgtggtggacaaggatgactgatttgtgaccggtctgacactggtcgcatcatcaacagacagccataatcccacgtcgcacctgtttccggcggaagtgggggtagatatgggccgtcccatcagaagggcacccggagaggaaccgtaccgatctccgtccatttatgaagagaagaacagtccagtttggagaggggcatgtggtatccccttgagatataaaaggaggaccttgcccacttagaaaaagagaggacttttggacacgaggccttggccagatccgatcccagagcaattgggggctggttgacactttgttacttgttcacacacaaatccaccaaaacacaggagtagggtattacgcttcccagcggcccgaacctgtatacatcgcccgtgtctcgtgtttcttcctagctggcgatctttccacataccgagagagcttgagatttcaccctaagcccccggccgaaccggcaaagggggcctgtgcggtctcccggtgaggagccacgagctccgtcatctggcgcgccaggtaggggatggtgagtcacttcgctcgtacattcagcggttttgccaagtccgcaataccataccatgcatccctgcacacgcggtgatctacgcgttcagggggggggtgtgcggcacaaccgcatgctcgaaaagatcgcttccaaagagccccagactaccgcggagctttttcagctcgcagaccgagtggctcgtaaggaggaagcatggacctggaacccctccggttccggagtggcagcttcggccgcccccggatccgccgctcagatagggcggcgtgacaggaggaggaagaagaggtcggtctattccggcgacgagggtcatgtcctcgccgtcgagggcgctccgcgggccacccgaaaggggaggcctgcgagcgacaaaaagaaagaggctggtactcccatcagggagcgcccagccggcaagtggtgctccgtccacaacacctccctccacgatctcgcggactgtcgcgcagtcaaaaacttggctgagcgaacaaggaagtgggaggaggacaggaggaaggaacgccgtgagggcaagtcgccggcaactccctccggtaaacggcgaagtgaggccaagcagaaggcccccgctgttgacatcgatgacggtgatgatgacctaggtttccaagaacctggggccaccattgccactgtcgatgggggagcgtgtgctcacatctctcgccggagcctcaaggccatgaagcgagagcttctggccgcggcccctactcatgaggcgacgcgccgggcgcagtggtcggaggttgccctcactttcgaccagaccgaccacccaccgtgcgtcgcccggggagggcagattgcgatggtggtttcccccaccatctgcaacgtgaagttggggcgtgtcctcatagatgggggagcggccctcaacatcatttcccccgcggcttttgatgccatcaaggccccggggatggtgctccagccgtcccaaccgattatcggtgtgatgccggggcacacatggccgttgggtcacatcgacctaccggtcacctttggtggatcagccaacttccgcacggagcgggtgaacttcgatgtggcggacctcagtctgccctacaacgcgatcctggggaggcccgcgttggtgaagttcatggcggcggtccactacgcctacctccagatgaagatgccgggccccggtggccccatctctgtccatggcgacctgaaagtcgcgctcgcttgcatggagcagcgcgcggaccacctcgctgctgcgtccaagcccgagggtggtgacgagaggcttggcacctccgcccccaccgccccgaggcagcggattgtcacatgcgccgaggtcccggtcaaggaggttgccctgggcgacggcccatccaagaccacacggattggtggtcttctggatggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttccaaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaatagggcgtaatgttgaggcttatgtcgatgacttggttgtaaagacgcgcaaccaagagactttgctcttagatctagcggaaacttttgaaaatctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccccagcaaacttagggatgtgcaatgcgtcaccggttgcattgccgccctaagtcgtttcatatcgaggctgggagagaaggcgctacccttatttaagctcctcaagcgctcggggccgtttacttggacggaggaagctgaacgtgccctcactaagttgaagacatatctcagctctcccccagttctagtcgccccggggccaaatgagcccctactactctacttagcggcgaccccccaagtagttagtgcagcgttggttgtggagcgcgatgaagacaatcctcatttcgcgcacccccgccctgtgctgacttggcccgggagcgagcagggaggagaagcccccgagtcgaacggtggcctaaggcccctgacgaccggagtcggccctctgcccgcttgtcagacggtgctgggtgcccccgaccctcaggaaggccccgaggccactgcgggaaggccgcacctatcgccctttggccccgaggctaaccttgtgctgactcgacccgggagaaagcagggagaagaggcccccgagccgaacggaggcctgaggcccctgacgaccggagtaggccctttgcccgcttgtccgacgacgccaggagcccccgacccccaggacggccccgaggccactgtgggaaggccgctcctgtcatcctccgaccccgaggtcatcggcacagaagacgagtgcgccccgagaggccacttggacgaagaacgccccggggatgcggcccctagcgaagaggatcggccccgccgaaaggtgcagcggcctgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagaatggaccccggctccagagaccgtctcaatccccgaggccagcacggacccctctcagctgcctcacaccgcccactgggtgatgcagttcgacggttctctgtctctccagggcgccggtgcgggggtcacgttgacctctccgaacggagacgtcctcagatacttggtccgtctcgactttcgagcgactaataatatggcagagtacgagggactccttgccggactcagagtggcagctggactggggatccgccgcctcctggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatgattgccgacgaactctcacggctcgcgtcctcgcgagcccagaccccaccgggcgcctttgaagaaaggcttacccagccgtcagcgcgacccgaccccttaggggagacggatgcgcctgaccggcccccgaggcccgtcggagtccaggcctcgggacccgaagggagcgctccaagctcccttagattgattgcttggatctctgagatccaagcatacctcacagataagactctacctgaggaccgtgaagggagtgaacgcgtccaacgcatttccaaacgctacgtgctggtagaagggaccctctatcggcgcgcggctaatggaatcctcctgaagtgcattcctcaggaacaaggcgttgagcttcttgccgatatccatgaaggcaagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccatttgctgtctgggggctcgatatcctgggaccgtttaagcgggccccgggcgggtttgagtacctgtatgtcgcgatcgacaagttcactaagtggcccgaggcttatccggtcgtcaagatcgataagcactctgcacttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcatggcgattcgtggatcgaggagttgccagcggtgctctgggcaaaccgaaccacaccaagccgagcaaccggggaaacgcctttcttcctcgtctacggcgcagaagcggttctcccatccgagctcaccctgaggtctcctcgggccaccatgtactgcgaagctgatcaagatcagcttcgcagagatgacctcgactacttggaagagcgaaggaggcgtgcggccctccgagccgcgcgctaccagcagagcctgcggcgctaccatcagcgccacgtccgggcccgatcactctgcgtcgacgacctcgtcttacgccgcgtccaaacgcgtgctggattgagcaagctctcaccaatgtgggagggtccgtatcgagtgatcggtgtcccccggccgggctccatacggctggccacgggcgacggcactgagctgcctaacccgtggaacatcgaacaccttcgtcgcttctacccctgaggggggggtcgagtgtcaggttttggctcgggccaaccccgcacccccctcgggtgtgcagggttagccgggggctaccacgcatgcacattcttatttctcttatttcagcatttcaataaaagcagtttcaatttcctaaaggttgtgtctgtgccgttttttccttttgaagaatcttgacttgaaataaggtcactcgtactcaaccttgccctcgggggctcggttcggtcagctaaaatcgccaaacggggcccagaaccgagccgtgccccggggcgtggtgaacttcgggggggaatcggcaaaaacccacaatcgggtcacccataaccctcggtcaccacgttcccggcctggccagcctcgacatgtggatctccccaggcactagccccgacccgagccattagaggactgggacttgggcacgagcccttaaatcaagctaagacacaaaagaggaccacggcacagatcatcctcatctcatacgcatagcaaaataaaattgacacgaattttttcatcatttttgattgcagattaagttggtctatacaaaaaagaggcatgaaggccttagaagaaagaaaaagaaaaaactggagtctggagggggcctgggggctcagtccgatgcgcccgggtcgccggcctcgtcgtcacgatcgtctgcaccgctggcatcgccctcctcgtcggagttgggggcgaacgcgagccgaggggccgacccctcgaaactgtggacgatgtggtcggcggcatcccggacccgcgcgcgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttgaagagcccaggccatcttcgtgaggtgcggagcgaggccttccaggtcggtggagtgcgtccttgtctggcctttccagaggcccgcttgccgaccggcgcgatccaggcgggagaccgcatcccaaagcatgccgggccctatttcgcccgccaagcggagggcctcggcttccccggcggatgagtctagcgcgcactgcatgtcggcgacggtgagttcggcagctgcgaggcgggcggctaagtcgctttcgcccgcagccgccccgctgatacgcgccctcgcgtccagctccttttcccgcgcctcgaggtcggcagcccgctgctccagtgcggctctctcggcgcggacggattccaaattgcggcgtgcctgctccgccaacgctgcctcacggagggaaaggctatccgccaaccgttgcgccgcggcctcggcctcttcgagagctcgctcccgctcagcgagtgcgtcctcgcggaggcggagcgcggactcctcttcggcgcaggcggcctcgtgcaccgccagcgttgtctcccggatagcggcggcggcctcgcggtccgccaagcccctctccacggcgccggcgtgttcctccaatgccatagcacgggcctcaagggcctcctcgcgccgccgggacgccgcttcgatctccgttgcccgccgctctcgggcagcggcggtgtcaaggaccccttgggcggcgtcgagctttttctttagctccgcctcccagctcccgtgttgaaggcggagggtgtcctgcgcctcgatcatcgcggtggtggcaatgagggcggcctcccgctcctcctccacctctcgggcgatctctgccagcgccgctttgcgggcttcaagctccgagacgtgacggcggtgagccttacggcccacctccaccatgacatccaccgagcgctgcccctcctcgacacgcgcccatgcggcctcgagctccgctcgttccgctcgcagggcctccacttgggcgctgaacccatctagcaccgcggtgtttgcggcggccaaggcctgcagaaggggctcggcgctcagcggggcgacagaagacgaggggaagagccgccttggagagaatgcgacgcggctcggcccgccggaggacgcgctgggctcggggatgtcccccagacccgtttggtcctgggcgtcgcctggggaagtaggcccaagcgacgcgccagcagctttgtcgtgagctgcctcggaagacgccatcgcctcagcctgacgagcccgggcggcctcctccttagcagcttcttcggcttggcgagcccgggcggcctcctcccgagcggtatcctctgcatggcgagcccaagcggcctcccgggcggcctcttcagcttcccgaaggcgatctgcggcctctcgccggtcagattctcgcctccgttcctctgcggccgccggatcttcggcctcggactgaccggacttgggatggcgggaggaacgtgacgggacatcgctgaagcaaaagaaaaaaccagaagacaaacaagatgggtaagagaaaacttgcttttgggataaaagaaagacggtcgcaaagagagtgggacgaacctgcgagggggtcggttaaatgaccaccttggaggggaaatcaggtttccccgggatggttccgtctcccccatcttgcggagccgcttcttcttgcgctccccctcgggctgcgatgtcggcgcggccccctccgggtgccgactgctggcacgcaccgccccgccccctcggggaggagatgggggaggtgttcctcccagcttcctcttcccctgggcgtcggcagggcggctgctccccgagcccccgacgcggggcccagaagcacgaccccctcctggggtagattgttccccccggcggctctcgcccgcgccgtcgtggcccttaggagtttcctcctctgaggccccgacccccatcataatggtcagaatggaggcgcggtcgggatcgctgcaaagggggaggattccttgaggaatgagagacgcctccacggagctgagattcagcaccctttggaccacgatcttgaagtcctcgggagcccaatcccatctgactccctggtgggtccgcatgtagtcttcggacccggtgtactcccaggcgccccgggcgcgccgttggagcggcgcaatccggcgacggaggtagtcgccgtacaccatggcccctgtgagcccctgggatcgcaggcccgccaggcggtcgaggacggcgtcatagtcatcccccagatctaccggcgcccgccagctggagacctgcgccgggggctgacttggaagtcggaggcgcgcttcgttggcgaggggggtgtagaaccagtcgctcttccagtcgtcccacttcttgcggagggcgcaggggatgtagcggttcaacaccggcccccgcggctggaagtagcagccaccaaccaccgacggcggcgacaccgactgcacggtgaagaaccaccggaacagccgaagagatgggcgcaccccaatgaacatctcgcacaggtgcgcgaagatggccaatgtcatcactgcattgggggtgaggtgcgccatctggagatcgtagaaatccagaacatccataaagaaagaagaaaatggcggaaccagccctgccattgcgaaggggaggaagaagacggaccgccccgggtagtctggtgccgggcgtccctcgcccagcatcactatctcccggccggtggcagattccggcataaagcggcgcggcagcccggcgtgcctctcgctcacgatgcgagaaggcggaagtacgcttccgtcgagcagagcggaaccccgtgccatggcgccggaggaagggatgattgagaacgagcgcgtgtggcgaaggaaaggcgcagcagagaaagagttagagctcaagcagcgaaggcaaggggaatagtggcgaaaggaagggagcaaatcctttcctcggtgtctttatacctttgccatcgctgtgcccggctcctcgtttctcgcgcccactatctcgctccctcgtttctcactatctcgctccctcgtttctcgtgcccacgcttccactaatcctattcgcctgcttgcggcgcatgaggtggatatgcggttgtggcagtcgagatagatcgtatcgtgcgcgcgttaattacgctcgccgaccgaagcaacgttaccatatctccaggcgaagcaaatcggctcacccagattcgtacgtcgctcaagtaatgtggcagtcttgaagagaccgcccattatggacagccaagtcaccgttaccgatgtacatgatttgagaccgttgggtttctgcccaaccatggagaccggtcccacctgtcaccaagctttaggagtggcgtcacgcccgaccgcttcccttgagaagggcgatcgccctggcataacgccgggggctactgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgcccggccccgagggccgaggcgccccgaccccttgtggagttagcgccacatgaatgggttgggtgaacacggtaagcctcacctaaccatatttattgcagtctggtcgaacgtgtcacgctgcatgcagcgtag

SEQ ID NO: 75775 - DNA, 2050 bp, Oryza sativa
tatggccgctgctcatctctccaaaaggattcatgccatccgtactcaaaccaaaccgtatgtttcgtgcgtcctttccaaattctttaaattttctgtcgatgtttcgccactgcgaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgacgttctgtggtcctctaacatcttgtccaatttatgggcccccttttcactttcgcagtcctccttggcgtcctgcaacatctgatcaagatcatccgcaacgtcgttaccatcagcatccctttcctcctcgcccgtttgatttccttcaaatccagcgtactgaccaaagtccggaatattgtcgtcttccacttcatcttcttccatttcaaccccttgctctccgtggcaagtccaacagttatagcttggcatgaaccccgactcaaacaagtggaaatgaatagtcctggatgcagaataccccttctgattcttacacttattgcatggacaacaaataaaacccttatacctgttagcttcggccattctcaaaaaataatgcacgccatcaataaactctttggaccgccggtcagcgtacatccattgccgatccatctacatgagatgaaaaaaactcgtacacaaataattattcttacaataatgacagtcatacaataattataaaataattacaaactctttcaacagtcatacaataatgacatatcattattcatacaaaaattataaaatattacaccaaatagttcttatttagtatttctaaagttttaaactaatattaatgtgttgtacttcttttaattttcattttagtttgttttctattatttaagattaactttcactatattttccttctcaactattttataaaaccttctttagcaaataaactaaatttctatatattctttcttccccacacaaattttctctctcatcaacttacaactaaattttggagacaaaatagtatgcaaaacatagctgcaaatgtaatatgacaaaaaaaacattggaggatgaagttgctaacctttttagacacctccgatttgtatataatcaccaaaataaattcactagaaattttggcatgacctcccctcttttttgaagaaattttgaagcttgctcgggcagctggaggaggaagaagacatatatataggggtgggactttagtcccggttggtgttatgaaccggggctaaagatccccgtgatctttagtcccggttggtaacaccaaccaggactaaagttacgatctttagttccgggggggggggggggggagggttgacaggccctaatagcatttgagccggactaaagatcaaatatgcccgttaccctttttaaccggaactaaagatcatctttagccccgatttttattgcaaccgggactattgtggaattcggccgaccaacgaaagattgtttctccaccagtgtctgttgattctaaccaagaatatactatccgtaggcaatttgaacatgtaacggactggacaaaacaaacaaaaatggtcaaaacattaattgtagtagatatcaacaaaattgttca

SEQ ID NO: 75776 - DNA, 36251 bp, Oryza sativa
ggatttgagctcgcgacgtcgctctctctctccgccatcaccgttgagctccggtccaccgccgtcgtcgccccggaccgcctcccacctcggcgccgcctccttcggcttcgccgcatcctcgccgacctcgtccacctctccgtttcggtcgccgaccgccggagcgccgcagtccccgtcgacccgagccgcgccaccgcctccctccgctccggccgcctcctccgtcgccgccgtcgccccggggtgagccgtggaccatcgcctcctttcccccttccctcccctctctcggccgcagctccgccgcgccggtggtcgccggcggcgaccatcggggcgcgggcgcgccgcctcccgccgaccgcgccggcatgaccgccctcgggcgcgccgagtggctgccgcgtggggcccggccgtcagccgcccgcgccctcaggtgcggctgacgtgtggggcccacggcgtcggccggtgtgagcccgggtgcaaccggtccaccgtggaccgtgaggctgccgcgtgggccccactcccgtggacccggtccgcgcgccccctcccccctctcggctgacgcaataaacccatttttaaattaaaatttaaatgaagaaattcacaaatattcatttaaagagcatatgaacttcaaatggacataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcatggaggttgaagccgacgtttgggaaagcgagcaaggcaagacacatcatccttgagcatattgaatcccagtttataaaattattttgatttaaattattgcattatcgctttacttaaattcccgcgttatcactattttatctagccatgcctatttaactttgttatgaccttattattgttattgttattattaccttgttcaccctaggttaaacaaaaccccaactagtggacactctactcatggtaccactagtatgattttaggtagatgcttcgctggttaattaggcaacattaggtggttttacaactctagactttgggatatttatatcacctggacactatggaatggttggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacatggatggagatggacgaagtcgggggttgatggacatctctaggacaaatgaaggctacacgagctgcggcccggtagtcgagatgtcatggcacagggccggtgtcctgctgctaggagctcagtcctgccaacctgtcccgggggttccggccgtaggtggggttggatcggtactcttgtctatggctaggatgggttggaaactatgtcacgtcttccgtccgtataccgtgggggtatgtggcacgtgattacacgtgaggaagatgtgtcttgtgggtaaagatgtacacctctaatcagagtataacctattcgaatagccgcgccctcggttatgggcaagccgagcaatgtacccaagttagtgttttaattcttaaaacctgctcaacaactaaaatgtggaatggttggcctgggttagcttgggacgagctgggacccagggtcgggttgccagttcggtctgaatcatcgtaggccttgggttaaggcaggttcgtgtgggttcacgaccttgattaataatattgtatagctctaggaccatgtttacaaaatagctttgagcaactaagtgtcttttaatgatgtttactgcaaaccctaactccctatattatggctcccttgtactcccttgcatttattctgcacttgtgggtgtgtcttgttgagtacggtggttgtactcagtcttgctcaattttttcccaaacctagaagaggagttcctggaagatgaaggctttggtgtctagctcgtgcctgccgtcaagcacctgtggtcgtcgccctagtcttccgctgtttttcgtttgtcttcttgtgtgctgggccttcgccacccatgtaataaattaattaattacgcttccgcttgttaaactctgaattgtatcaacttttggtgtaccttgcctcctgggacaaggaataatgcacgcacgtaaggaacgcccgttgggttatttccggtcgtgacattcactaagatatctgtgacagggcacgagtactatcaagaaggccaatgccagtccatagactggaagattttctcggccagcggcgacattgaccttgccagatggtctatctccgccggagttctccgagaacgagcaaaaccttcgcggagaaactcgaggtccaggcgcgggcggtgatctcgtaggcaagccagcacgtgccctccggcgtattgactcactcgacgacactcttacttcaaggcctcgtcgatatgcttgccgatgccatcgagttgggcataggccccgtttagccaagagatgtacccggccgtcgactcctcgggatcactgcggactactcgaagttccctgcatactctggccatggaggcacagcaactcttcaagtaagaattaaaccacacctcgcgacctcggagcgtctccacagcctgctctttcttcatggccagcatggttctctcatgttccgccacttcaaatttcgtcttccagtattggatacgacgatcttgatttgcaagggcaccctcgagatctgctaaacatgacgaccactaagacaagctggatacctcctttacaacataaataacctaatcaggaggtcactaagaggtgaaaaggctactcactttaggtggccgttgccatcccggcctccgcatcaagagtttgatccacattgtcagacgaaacatgtggttcaaaatcgagtgccagaatcatcgccagtgactcaggctgcccgcgctgctggacatcctcgtcatcaacatctctacaatggataaaactcccgagatcaacatacaaaattggacaagggtggtaatcgcacgcacgaaggcggccagagttcaagatttacacaatatgtaacaaatacaagaagtcctactcttcaaaaagggggagaacaaactcccccatatcaccgacttcttccatcacctctttacgcgtgtcgcttgccgccccctgatccaagatctcgcgcagatcgagttcaggacgcgacaatcttacacacgcgaggacgtgacacgcctcggtgtagatgtcgttcgacgtctcctccgcgatcctggccgcatgcttggaggggatttcccccatcgccgtcgctagttccgcaagagaggaagtcagcaaaaactcgtcgggattcaccgggatcgtggacttgacgccgcactcctcggcgagctgatggaagccagtgtaggtgacccgcaacgagtgacggatctcggagagattgttcccgagtttcgacattcggtcctcgagcccctttcgttgacgctcgttgccggccaccaactccctcatcttcgtgaggtcctcacgggcttcagctagctcgcgcaccaatctctcagcacgcgtgttcgccgtcgccgcttccgacctcgcctccgagatctcgcggccgatgccgcgagcaccagcttcgagaaggtgccccatctcgacttggagctcttcccaggtgagaacggccgctggcagaccacgacctgcagcgggatcgctgacggggccgctaggcgtcgcctcccggctcccggtcacgagcacgacatctgtcgaggccgtggcaggtgacgcgctggaagctcccccggacttggcccgtgcagccttcgcccgcgcctccctacggacaaccacgaatcaaacaccatttgaacgagaagcacgagaatccacgaatctgtttacttacttctcgccgatcgccacaatgcgctgtcgtcgtggaggtggaggggacgcgtctgaagcctgaaatacaatcaatacagagtaagaagaaaccctccttgctgcacgatctgacgacaagatgaaattaccgagggggtcgctgccttgcggcgatgtccgagtacagacgagaatttcctcgccttggtcgggacttcgctagtggtggccgcatcagatgtctccttgacaaccttctcctttagagatgtcgccacctgatggtccgcgagcggcccgatgatgtcagtcaaaggaagggcctacgcttaatcaggtcataaggtgatttcgaaaggagaatacgggatgcttatcaaatacacttacgttgatggcttcatcacgttccgccgcccccttttcacaaaggggcacgaggatgtcgctagccgtagtcggaccgctgatcatcatttgaccgacgcgccgctctacagcttcgctgctcagacctgttaaacgggaaccaacttttgataagtcaagaggaacgcgagtacaagcacgccaagatgaatacgagaaagataccccgaggagaaacccgggtcgcgtcattcggcccgaaatagttataggttggatgggcccgagcctggagcggctggatccgcctaccaacgaagtctgcagcgacttcatatcccgacaagccccgttctcggagatcatcgatgatgtcgataaacgactgaagagagggggtcaaagggggcttggcggtccaggccggaatcttgtccggttgatcctcgggaacaacgaagacagggttcgagtccttgatctcaaaatagaaccacctattctgccacttactgcgggaagaaggacactggaaggggatataacgtgacttcatgccatcactaagtcagaacccgacgcaaccagacaccctattggattccatccaacgcagttcatagtagaaacggaagagatcgagaaaaggctctaccccaatgtaggcctcacagagatgaacaaagatactaagaaaggcgatggaattaggattcaaatggagaagagaaagaccatagaaattttcaacaccaggagaagaaactccgaaggtggaggaagaaaaccgcagacaacgtaatcttcgatcgcaaccatgcgacccaagaggggctgaggatcagtacctcctacttctctctccatgtcttcatggccgggaagggcgccgtcctcctgaaggttcttcaacgtcgcgccggtggaagacgacttgccgagatccattgctgttccaagatcgccggaaaacgagcctgagttggcaaactaggttttcttgcggcggcggagaaggcaaggagcgctggcaggcggtatgtttcaacaagattggcagacttcaaaatgggctcccaaaattcctttaaataagcgcactaccgacggtgcgaattccaaggaacggagagagatccccgccggaaatctctgggcccgttacacgcggcaattttctggacttcagttcaaaattcactcgtgaccgttgggcttcaaacggcatgctcgactacgttctatctccgcggtcctcgcaccaggaatgacaacgttctcgacacccgaagtcgtaaatggttgcacgagttcatttaagcagaagtcgggggctactgtcagggttacaggtcaggcataccctctacccttcgatatacgttacatatcgacatggcatacccacgcgcacgcggatatttcctacgtatcctaaggaaaactttcacgaaatctacagatgggaagagtccttctcggacagaactgggtcgtcgacgtatcgtattgggtccgatatctccgagtcctacttggagacctccagatctgtgatataaaagggaccccacggggagggcataggggatcgaatctcagagccaacacaacccacacagcctacgaagtcgaagtctgcgaggagccaagtcatcgagagctagtcgaatccactcgactacgatctcgccggatccgacaagttccatctttccctttataatctgtgttttccaccatataatcccatatcaactggattaggtctattacctaccaaggggcctgaaccagtataattcttgtcttttgattgttcaatgtcgtactacgtagatccttgtaccaacgtaccccaataccctctatatccggtctacgggtatcacccgtcgacaatatatatattggaattttctaggctttcaactatttccacatgagatagttgttttagcaatgttactgtagcaacagcaacaaaaaaatatactatgaaaaatattttgtattgaaaatcaaatgaaatatcctgtcgatatacaattcgatcttatacatatatgttttacactgatgaacaaatcccaaaagagaaatttacacatgtagatccaagatgttatttgatttagtttactgcctaggatctctctctctccgtgtgtgtgtaatatctcactggagtaatatccagtgttggcaaaaggtgtgttacaccccaaactagcaataatgacatgtccatatatatacgtgaagaataaaaacaattgttccaacaatgaatgcatttatttttttagtgaagtgcatgagcggtttctaaacttgtatgtgtgtgttatctagatccttgaactatcaaaatgttgtatttttgaatctccaaacttgtcttagatgttatatatataggttcaaacgggctctcaacccgctccatacgctaaaatggcatgccacgatggtgcctatgtgttagtcagacccacatgttagttacatagaaaaaataaaattaaatatatatatatataaatttaagtttaccttttttttctctctacctaagaggagaaaatatggttttaaattttatttgttatacataactgacatgtggatcccactaacatgtagttgtcaccgtgtcatgccacgtcagcatatgggacaatttagaaccggtttagacctatatgctacccaagacaagttcaaggacttaaaaatgtattttggaagtttagatgacacaaatgcacaagtttagcgaccgcctatataattcactctttatttttctagatatgcggaggacataaatacatacaaacatcagtggaggcgtggagccaacatgttaggctattgtcacatggcatcaatgaatcttgatttaacctacgtagacattatgttcttcaatgaattacattagtatatgatttgccttttgacgccaccatgttccggcagagttagcccatccatttgcttagcccataaattgatttaaccatataagttagcccatgtgaccatgttaaaattatctactaaatccgttctaaaataagtgtactcttgtaattcaaatttgaactagaaagtgtactaggagtaggggattagacagggtcgtcccgaagggagtgccacaagtgcgactgggcccccattctccggggtagaaggaatttgttgaagtcgcataggccgaacgcagcacgtctattcattttcgctgcgtgcgttgattccctcccaaacacgatattaatccaagtaagtcttgacctcggtgactctgaattatggatccgccctgttaaagtattgtacaagagtacattaatttacaaatgatagtactccatccgtttcaggttataagatgttttaacttttattaaagttaaactgctcaagtttaataaagtttatagaaaaatatagtaatgtttacactatcaaattagttttattaaattaataattaaatatattttcataataaatttattttggtttaaaaatattactatttttttctataaacttgatcaaacttaaagtagtttgactttgaccaaaatcaaagaaattttttggtttttgtcataagaaattatggaacaagtatgtttgagttttggatcgtagacgtgctccattcatgcaggcacaacgaaaaaaaaatactaacacgcacgcatggctaccaacgcattgctaccgcaccaaagaggctcttgtatataagttagagtaattacacaataattatactccatttatcgaaaagtcttaagcatattttattttcggggttttcaaatgagatgatcatatttgtacctccatatatgtaagacttaaataaagagattgtatttctcgttttgccatattagaataaatcattaaccggaacccgagcaaccatcttaatattcgttagttacaagcacacgtataatttttttttgtctctgttatagatgagttagtttttttttcttgattttgttaacaaaataaacacgttttagttttttttatggagggatttggattaaacttgctctaaaccaaatcacccaatctttcgttccatccgtttcttcgcatgtgacagctcatccacaccgatggagcagtgacgaatttttttatttttaattttatttattaaaatatttacagaaataatttttaatttgaaaattttacaaaactagtcgcccatcgcccttgcccttccagaagacgttttttccgaagtagtagatggccgttggctctaccataacggcgggccatcgaggacgctcaaattttacaggcggcccccttgccaccctcccagagggcgatttttggctctagggggccacctacaaaagggttgggagggctacctagaatttttgcaggcatctcccttgccgccgcctaagagggctattttctactataggggagagggtggtatttttgcaggcggccccttttacccttttgggaggatgattttctacagtgcaggggggcctttcgtaggcggccccctgtaaagtaaaaaatcgccctcccaaaaggctacgagggggccgtctgtaaatttctcctccctcgatgccgattattatgggagggccaacggctgtctgccacattagcaaaatcgccctcctagaggacgatggacgactaatagttttgtaatttttttaaatagaaaattatttttaaatattttaataaataaaattaaaaaattcgagcagtgaccacagcgaagccggcgccacttgtcacgaacaggcgccgtgccacctcggcgcatgcctctctacggctagctactcccatttgtggtcaacacctcgtagcgtccctatttaacgtatccacacgcatcacaagatcgaccaccaccaagcgagcccagcaacagtttcacactttagctgctagctagtgctaccacccacaggaggcaaccctagctttcccacgcagccaatggaggccggctacccgggcacggcggcgaacggcgctgccgccgacgggaacggtggcgcgcagcaggcggcggccgcgccggctatacgtgagcaggaccggctgatgccgatcgcgaacgtgatccgcatcatgcgccgcgtgctcccggcgcacgccaagatctcggacgacgccaaggagacgatccaggagtgcgtgtcggagtacatcagcttcatcaccggggaggccaacgagcggtgccagcgcgagcagcgcaagaccatcaccgccgaggacgtgctctgggccatgagccgcctcggcttcgacgactacgtcgagcccctcggcgtctacctccaccgctaccgcgagttcgagggggagtcccgcggcgtcggcgtcggcgtcggcgccgcgcgcggcgaccaccaccatggtcacgtcggtgggatgctcaagtcccgcgtgcagggctccatggtgacgcaccacgacatgcagatgcacgccgccatgtacggtggcggcgcggtgccgccgccgccgcatcctcctccgcaccaccacgcgttccaccagctcatgccgccgcaccacggccagtacgcgccgccgtacgacatgtacggcggcgagcacgggatggcggcgtactacggcgggatgtacgcgcccggcagcggcggcgacgggagcggcagcagcggcagcggtggcgccggcacgccgcagaccgtcaacttcgagcaccagcatccgttcggatacaagtagtaacagcagcagaatggcgatcggtctgcacctgcatgcacacgtatcgcatgcagatcgagctagtagtgcaactggctaacttgaaccagttaaaaacttaagacttagtgatcgtgtgtggtttaattaatttgctacgttcaggtagtgatcgatgagattttaatttcctactgtcagtttaattcaccgttcatgtactcgatccagctagtactactcctagttacccttgttctaatcttaacgcaattgtgtcgatcggacgatcgcacgtttatcttcaagtggaatttgtcttataacactaattaagcgcctggaagcttatgtacacttactcaattgtgtattgatccctcaagagttgtcaattactattacaaggttcatataaaagcaaactcatacagtgagtaagtagccaaagtaacaaaactaaaagtaaaagcaaactaataaaaaccaaacaatataaagactaaccattactgaattctattggtgaatctccaccaaaagttggtagaatgctgcataatcgttgactcaagtttacgacacatatcttttattagcttgatatgatcaccgtacctttatagttgagcctatttctgaagtcagtatgtctctaaaaagaacctacaaataagattttgactgctcaaaataaagttaccaaaacaaagttacacttgcgcactcgcactgcataccaacccaacggagagagacggagagagatctagagagagagggagagagatacggcgccatatacgggtggagtactactggagtgtcgcgtgatttgccttccccggccggacggacgcacgcgtgtccggtcaaggactcacggtcggtcgcctgatcgacgttgcgtcgcgccctcgtcgtacgtactacgttccgagcccatcaccgggcaccggcgacacgcacgcacggcgcgtacgtacatacggatcgtgaatactaacatatctacccaacccgaatagattgctacgtatccaacccgagtgttcagtctgcatacatacgatacgggcatgtacagacacagctgttgctcgtcgggtccgtattatgatactctaagaaacttaagcacagtaattggaggacgcgatagagtcatatgcgaatcatattatctagtcatatgtatagcaggattctcagatcgtataattgggcacgcgcgcgcgctgccacaccagcggatgttaatttggatggcgcgtcacacgaactagcttgcttgcggagggtacgtcgtctcgctgccggcacacggacgtatacgcgtcgcggagggttgcccggttcttccgccgcggcccgcgggcgtacgttaatatatgctgctttcagccgcgtggatcagtatcaggggcttcgtttcgtttaccccctgcatcggtggccagtgcatgcccgtctcggctgcccgctttgggaaccgcaggccgcagcatcgcctagttttgtgagctctctccagcatcgatcgcagctagtagctccttccccatgtatgcatgcattgcctacgggggccctgtcgatcgatcgatcgatccatcgatgcatcctcctctgtatgtctctctcccctactgtacgcacgaccgggtgaggtcaggtcagatttttttttattagagcaggtacaatagtatgctataagccaactgtaatataatatattttaaagagataaaaaaagagagagaatatcagcgagctacatatatgtagctagctgtagtatggactccaatacataatatgtgtatgacagatgagttattaatagtataataaacaattattgcatgaatgggctattcccaactcaaaacactagacatagttttcataaactccacatcatcaagaaactagtattatacactactatttcaatgcaaacaccactattccatacttgactttaatgctacttatctcacatgatatcttggatgatgtgtagaaaccatgtctcatgcaagacatggtttccttctctttcctcatttattcacttgtcatattattttttattctaagtgacagcttatttaattctatagacaccatattagtcattgggttgagaatgaccttacattgtagagcagtggactataatattaaacttgctcttattattctctttctttcttgtggctgctgcacctgcactgcacccgcaacggcgctgaatgatgccatgcgtgcgtgacgaaacatctgcgtcccccccccccctgtgcggcgctgtagccatgcatgcaggtgtgcagcgccctgcattcgccatgcgggagagcagtgtactcctccccattttaccaccgactgtttactagctgcttccaggggcacgcgcgcgctgctagtggtacgtaccacgattcctggctccaacgtgcgcacgcatgctttagaacgaatttagctgtgcgctgccgctttcgggcccgtcaacaatttgtaccaaccgtagtatccttgtggctgtaccctcttctaggttctagtgatgacatgcatgacaactttcccagtgaacactgaattgcagctatcatacaggttcctaaactcaaaaactactcgagggatgtgatgtgtgtttctgaatttacggatgagaagaaagcactctgttcacatttgatgttttggattcccttgggtaaacatagttttaaatctctcgctatagctggcgctatctcccgctatagttgtttgaaaaagattctagctatttgatctcatgtacaatttagccgctatagctctatttagcctactataactgtttgagaagctaaccgctaaatgtcttagcccgctatttaaaatattggtaaacatcactggccaaacgcttgcaggcattgcaacgggttcagggctaccttgttatagtcatcaatgacaagagtaggctgtcaaacacgactgagatacacgaaaagagagcgctccaaacaatgtacgcccgagttaaaaccccgggttaaagaaaagcagttctacagaacagtgatcatacacctgcagtccagtcttcttcagtcatcggcaccattgctttctttactctgctcagcctgggggagagcgcctccggtgggtgtcgtcgtctctgctgctgcaccgggagagtgatcctcagctggcctggtggaggcatcctctgcctcaccattttcatgtctaatacactgctttttcttagccatatcggtgtcttcctcttgtagttcttcatcaacaacatcgtcatcatctacatcctcatcaaaaaccttggtaaggtcaccttgattctcagccccttcggcggcatcaacattgttcatgcttatatcgaccccatcatttccagcttcagcttctcctcttttcctctgtgggatcacatgaaagaacgaagtcttccagtcccttgtttccacaaactttagcattatctcgaacacttggttaactgtcagaacctgcataaattacataaaaggagagtcagcaatcttcaagtctttagcacaaattctccaacatccaaattccgggccatttttataaactagggttgttctaaataaccctctatttagactgatccatgataaatgattgccataatattaataataagagccaatcaaaacacataaaactcttactactgcactaacacgtttgaagcctttggagaagatcttaaaaaaaacgtttctttttctaaaagaattttcaggatcatttaacatgcggagagataatataacatatcactgtattatctgatagaagatgtcacaacatgtaggcatactggattattttgaacccttattggaagtatggatgaaacacaaaacaccatttgattgaaagaaatcaggcaagccaacattctgtactgggaaaaacatatccatatgatcacctgagaacttgacatctttaaataatttccaatagggagcttggcacattgaatcccctgatcaaccgcctttttcagtgtaatacctttccatctgttccggtccactaggccaccgatgatgtatatttttgacatgtctagatcatcaagcacagtttcagcatcggctgtaaggtacacaaggttttctttacgatcttcaaatgcttcaagataagacttggcctccttttcaatcatccacttatcatacccaggaatcctttgaagatgggttgccatttctccattgcaacctgtcaaccatagatgagcagggttcgtagacctcccattaactgcataacagtacatgatctgtaacttgcattagtacaagggtaacaattttgctcgaactagacattaatgaaggtagaatgctttttttttttagaaatttctaggtagaaggcattttggtacataaagacattttgatattaacttttgtcaatatcagaacatacttcagatagaataagagatcaatgctatagcattagcacatattgatatatatgattaaaaccagatagcacaagccaccaggttgtcgaaatagaaaaatcatatatgcaagattcatataactggtttctcttacaggtctacacttaacatccagttgacacatgaataaaagattcatacgtgaaactgctaacatccagtagaaattatggacaagtaataaaagtataaagatttatttatttttttggaaaaaaagaatcaggatatttttttggcacctttaacaagccatgccaatacaaatatgtgatctgccatatacatttcacaagtaatcaagttactggaatgtccttcggatatcatatatatcaatacacacatgattcgcatattagcattatttcaagcatgaagtttagtttcagcccaaaatgtacaaaagcgagaagggcaaagcaaatccacctgctgcgtgaggctgtgaatctcgttgggccgcatgagatctccgaactcgaggtccagcaccaccttctgcccggcgccctcggccgcgcggcggagccgctcggcgcgtgcgccgcgctcctccgcgcgccgccccacccgctcgcgccgcgtctgccgccgcgcctccaccatctcggcgcgggcctcctccgagggcgccgcggccagcgcctcctcccactcgcgccttcgcctctctatgtcggcgcgccggcgctccttctccgccgccttccgtgccgccttctgcgccgcctgcctctcctgcttcagcagcttcttcctcgcgcttttcgacatcgccggaggctgcccttcatccgcggccccggccgcggccacgtccgtggcttgctcactcgccgcgtcgtcagccatctcaactcgccgccgccgccgccgccgccggagcagtggctcggtttggagaggggtttttggtttctcggcaccacgtgaccgaattaccgaaataacctcaaacgtattacaaaagtacgcctcctagtgaagttagcgtacatcaaaattccgcctcaatccaggatgcaaacctatgggctacgcgaatcttatttgccacggcccaaatagccatgtagatgaagcccatcttggagcccataagcgaaatgtgtgtgctgtactgctgttccttcgagccattgaccggttgatccgttcggtagcttcagagcggttagactccccccaacgatctgcatggtgtggcatctcttaccaagtcaatcgccaatcacggctgtccatacggaagccagtaagagatcaacggctctcagtgaagcaacgtctcttctccaaacccaaccgcccggcgcgtacgcagtccactaccaccacttccgccggcgccactcgctttcgtgaagaaaacctctatataaactcccccggccagagacaccgccacggctcacgctcgcaacaacacaaaaccctagacttgcacagatcgagacgagagaggctagcagcaacattcttcgacaatggctagccttgcaatcttcgccgctgtagccttcgttctcctcgccgcctcggtgtcgtcgtcgtcggcggctttgtacaccgtcggcgatgcgagggggtgggcagtgccgcccacaggctcagagtcgtacaaccattggggtctaaagaatcgcttccgcgtaggcgacgtcgtgggtaagtacaagatcatcgccgatctgcgaacggcgatcattatcacagttcgcatcattttgcagagttcaagtacgtgaacgaatcggtggtggtggtgaaccacgagggctacaggaactgcagctcgctgagcccggtgatccggttcacggacggcgacaccaagtacctgctcgaccgcccggggctcgtcttcttcatcagcggcgtgcaggagcgctgcgagcgcggcctgcggatgaggctgcgcgtcaggcccgccgctccggggccggcgcaggcgccggcgccggggccaacgagggcggcgctgacgctgcgtcgtccacccatcggcgctcccaggccggccgccgtcaccgccgcgttcaccccgacatcgccgtccgcttcgcgcccgagcgccagaaccagcccgagtcccagccctgggccggcacaggcgccgagcggtgcatctggccgcgcgctcacgggcttctccatggcagcagcgcttctcgtcgtgtgtgtcgtctccgtgttcatcttggtttgaggttatttggagaggtttaattagctctctgtcggtcggtagtatcgtcggttttgataggaattaatgctataattctgagatccaagaagaagaagaagaagaacgtgtcatgtcatctcgcggtagatgacaggatcgagtccatttttgttaattagggtgttccaatgttttgtctagggtacttaattaaacccttatggccttatgtacgtaaacccattccctcaataaaatcccaccagttttattgtgaagatcgacttggcaatgccctcagatccactggagtgattgtttgatttgccatggaagttgaactgtgcagctccctatgtttaacggcggataataattttctacttaagtgtcatggcacctatcatttacatacaacaaaaaaattttaaaaaaaattcagtacaattgatgatacaaatttatacacaaacatatatgactatgggcctatttagttcgcgaaataaaaaaattttgggtatcaaatcagatgtttgaccggatgtcggaaggggttttcgaacacaaatgaaaaaactaatttcataactcgcttggaaaccgtgagacgaatttttaagtctaattaatccggcattagcatatgtgggttactgtagcacttattaggctcaaaagattcgtgatttccttcctaaccgtgcaattagtttttcttttaatctatatttaacgcttcatgcatgtgtccaaagattcaatgtagagaaacaaaaataataaatcttatatgtatgacgcagataaaaattgttatttattgtttcttcacatgtagattaattttagatttgcatgtttgtaatagtgtcttatattatcatagtttatcttatcaaattttataaaatttttatataactacttaaattacatgtacatgtgtagaaaatacattcatgttaaacggcccagtcgatctcactttgaacaggcgaaagaaaagtccggaacagttcagttccgcgcgcgcgattccaccggcgaaacgggagctccacgtccgcgttctgttgcgcctcgcacgcccggttccaccgctcgcgccgcgcgctcggctcccgtctcgtccacatcccccgcgaccacgtacgctgccacgcccgcgcccatgcccacgcccacgcctgcggccgccgggccaccggttggttgtccgcctctagtttccaggtcgtccagaacctgggaaaatcaaccgaaaaaaactcaaaacaggcgaagtaatcgtttgaaaacgaaacgattttaggcagcgtcgcatgcaaagcatgccacaagaaacagggcataagtaggcgcctccatgcagcgccccatgaaaagcattccgattcctctgctcctcttcctgttccccccccccccctctcttctctccccccggccggggaagaaattttgcccccaaaataattttctgcacggacgatcaaagaaagggcaaaatttttctgcgcctccggttgaaggaagccgtgatccatgtcggtgagtgctcgtcctctgcagggtttgttagaggcgttgcatctacgtacgtgcaatttgatttggattctcggttctttctttcttgaccatatgcattgattgatcgatcgatgctgccatttggtatatctttgcattataccgtttattcctttgaatcaattgagtacctgatggcaattggatgtgtggagaaacgttcaggggttttccgattagctatacaaggtggtgatagacgatctgggttcgaagcctcagccctcctaattatttgatattaagtcctctcctaatatccatgtctttttattggatgtgtgacgaggaacttctcgcaaattggatcgacaggagcaacctagagagattgattacaagaatgaaactaaatctatagaaacgtagattgggactttttccctctgttctctaatcgggacgaaacagggcaaacggtacaatatgccctcacgctattgtgacccttaatttgtattgtcttcaactcttcatttttcaaacttgaccattccgatttgtcttctaaatagcccaattgatatgcgtgatacagaagcaatctgcaatagcacgctagcttactcgtatcatgcataatcacactgatcttgtcatatacatgggttggtttttttttttctcatcaaggacgagactggccgcaccattccaaagttcggcgcatgggacgtcaacaacccggcctctgccgacggtttcacggtgatcttcagcaaagccagggatgagaagaagggccccgtcaacgtggacgccagcaccaggtcaaactctgacatgaaagactccaataacaataaggcaacagagaagatcaacccctaccaccgcaggacaaactccgcatcagtatatatatacttcctttcttccatttccttccttagcatcacattattgatctcaatgaaaatgaaaaaaaaaagagatcatcatcagatctttggcttgttacatgtaagttactattgtttattgatctgtttttgcagaagaagtggttttgctgtgtgtcgcccagccccacccaaccttgaggaagcaaaggaataccaaatataacatgatgctgctactgccgccttgttaatgcatatagtaatgattatacacacccagttgaaaatggcccggtgttattctgtgatggttgctctgttgttgtgaggaggctggtcttgagctcctcaagcctgtctgtcagtgacaacagcgccatgtatgatttgttttccgccgggccaaccatgtacgagtgtatgactgttacatgagaaatttatgggtatatgatgattaaaaacgtcatgattttgtgtgtactcgttgacgtttgattgtaattatccattcgctcttgtcctttttcttatggttctgcagtgtgatccttcctcaacttcatcaactgtcaactagtaattctgaaactgtactgcccagtgcccaattcagacttctgatcctgctgtaacttcagtaaggttatacattggtacccacttttgttggaacctgcatgggaaaaaaatgtagggagaacctagaaactacctaaagagtaaaatgtataggtggtatcacaacttgtgaggtgggtgcagtttagtcactcaatcttacaaattgctcaaataagtcactcatcttacttcgatggtgcaaattttaccgaatatattgtcacatggattatttgtttttagattggaggtcgtattagttttaaaaaaacaattggaggttgtattgacctcacatcttacattttttttaggaaaaattggaaccatgccattataatttcgcaaaatttgagatatgccatcctgacccacgtgtcattcttttttttaagccatgtgggtagggcaagcattacaattacaaattagcactcatatttttcatgtatatactaatactcccgctttcaatgaacatggccatattatgcttgacaatcaataaaaaattcatctttaattggattttaatactggtagtattgtacgttggcttatttatggatcgtgtgaccatgtttacaaaacaaattaacatagcacataacttcattgcgaacatcccacacaacacatgttttgtatgatttgcatcctaaaacaagatgagtaacttgtttgagtattttacaagatgggtgactaaattgcacccatttcacaagttgaggtactagcggtgcattttactcctacctaaaatacacaaatacacgtctaagatttatccatgtcatcccggcaataaaaaatttactcgtggtgaattactcgggtgatgtgaataaatcttagatttctatttgtgtatcctaggtaattttcaggttttcattacacatggatacatattttcccggtctgcacagttttcagaatgtaacctcagaagagaacatctatgtgccacccctccacagtattgaagctcttttaagtttaatttcttcctgatatatagcattgtacatactgtacgtaatatcatttacatattgagagtatacagagtggcaacacaaagcaaatggaaactcgagcgacagaagctggcaagctgcccttgtccctgcggaggaagagcgcctcataaaccggagaattgatggctactatcagtacacacagaacagcctggagaaacaaagtttccaaaccccctgggctttcttgtaacaaaactctactaattcctaacaccatgcatgccaggttgagcagcgcaactgtcgtaaggattacaaacatcgccgagaaggatccgaattccatcatccccttcttgtacctctccaaggcctgcaagtcagtgaccttcactgtcaggttgaatccagactcagagatgcccaatattctgcggaatgtgtcgatggttgccaggaggtatgaggtgatccttctaatgagccacatcctctgtgcattccaccactccactgcactgtcaccacattgcagtgactctgctaagctgcaggagtatgcggccaccataacgtacgcaaagggtatgaaccaggggctagttttctgagttaattgcagatgtaaatcttgtgttaaactttaagccaagtgcgtacaaatgtctgaacaaacgttaaagcatatggaaacttacctcaggaaagagggagatgccattgaggaagcaaagagaaggaattgtgacatagtacaaggtggggaagctgttcacggcccagaagccgcagacagagtagcccatttgaagacccagcttgatcttcccatgacctaataagaaggggctgtaccgtgagagggatatttggaggaacccttctgtccatctcttgtacaggaccaggatctggcctagtgaggtgggtgtcatgcctaagaatccctttcttttggggttgtagtacactgatctccatccacggcattggatttgtaatcctgtagttacatcctccagtgggcacccatacctaacccccttctgcaattcagcaacttgaagtcagtagctgtaatcagtacaaaatgaacaaagttctgtaactatgcgaatgcccattgctggttgatggctatagaggataaaatccaacagtttacatgttcagggtatgaagtaagagactaacatacctcaattccccagatggtgttatgctcatatgtgcaagtcacaagtgacctgcccatttcttccaactcattagcatcttctgttctccctgctaccctagtccaatcttccttatattcttgactatagattcgtccacatagggcctctctccgatggaagcatccagtgccatagtaacacattccaccccaaccatccaagcaaggatgatccaactggtgatcaacggaatgaaatcacaaacaaagttaggtccaattgtgtaagtatgtccactgaaatttcaggagatgctatgctatcttactactgacctcgttgacaacattgattgggtggccatagatgtcattgtgcaccacattttcaaaattctgaggatactgtacaaaaccaatatcttggccttgctcttcatctaggaaaaaacacaatgcgtctctgatggactctgaattgtttgagtacatatcacaatcaacattcatgatgattggactgttgcttatcactgatgatacccttatctgcaaatattgaccataatttaaggaattctagaaacacgataaggttgactctaaattgttgcggtagaaaatcatggaccatagagtggctaaaagacccaccaaagcattcaaagatccagctttgaagtgatgctgtttctggggtttcttctcacgtgccatatatacaagtgttggcaatgcatttccatcaatatcaactgccttttgtttgttactatcgattaaaatctagccatggagaacactttgatcagcagaatccacaaatatgttgcagacaagaaaaacaaatttcatatcccattaaagtttcttgtgcatgtacattcttatatgttagcaattatgattagagccaacacaccagctttgttttaaaattttctaatcatctcattattctgaattttgaattcaattaaatgttcttcatctgttaacctggtcatcaccacataacttttacctgaactatagaagggtgatcactagaagtgaaattctcattccactgtgagaagcctctggaatggcatcgtggaacctcggggatcctacctgaatttactactgagttcacacgatctgtcatgtctttgtacagttcctgaaacacagaaaaaagaaagtaaaggtaataagtagacatgtaaatcactagtagtgcaccaaatggaagccagtaatagtgcacagactaaattgataacctgaaaacaacctctcgcgtcgctctcgcgcgggtggctcagggggcgaaaaaaccctagccgcccacgcctccactccctccccaccgcctcgccgccgccggagctcgccggcggcaaagccggcagcgagcagggaaggcggcggcgaggttcttcctcccggcgactccccccggcgtgacgtggacgggacgacgacgccggcgaagaccctccaccgcggccggaggtggcgatggcggcgcggtgtggggaggcagcagatccggcgcctccaaggccggatccgaccaccccacgcctggatctggcacaacggcggcgcgaggtggctgggggggcggcggcagcggcggcagggacggcgcggctggcccggtgcggcagcctgggcgcggtggcggtggctcgacggctgggatggcggctgcctagaggcggcggcggctgggagcggcggcggcagctcggcgcgcggccggtccgggcagcccgggctcgcgcggctcggcagtgcggcggcgagcccccatggcgcaggcaggcctcggcagccgggcagccagggtgacgccgcggtgccctcctcagccgggtgggctatgcggcgcggccagatggggtgcggcggccgggcgacgggggcgccggtgggttgcgccggagccggagcagcagaagcgtctctggcgtcggcgcaagcccagatggcagtgtaaagggagctggcggcggtgggtcgtcttctccgttgccggtcggcaccctcgcccttcctggagctcctccccttctctgtggggagtttctatgttggattgaggcggcagctcgtcaagcgggggaaactcaggctgccaaagcaatgccatccagtcccggttctccttttgtccaaagctggcgaggaggccggcgggtggtggaacggaggggtcctgggccagctctcaggggcggtggttgatgtcggctgacggaggggcgtcagtgcggtgtggttcgatgaagtcggtcgatggaggggcgtcagtgcggtgtggtggaagctacgtgttgccatttgtctgtgtagtggttctgagttggtggacggcgatctacagtcaaggttgtagggtcccaggcaaaagcctagtccggtaattcactgggccggcagcggctatgtcttcgggcgtcgtaacctccttggggcgttgtcaagggttaccctcttcctttctcgataagcttctctgggtgaaaaccacatcttttttagatgggcgatggcggcatcctggatgtcgtgaccaccgtggtggcttcgttttcggagtcttgtctctgtggtgttgccgtaggcctagcggcgttcggccattcttagcgggggtcatttggtgctaggcttcaccctcagcggtttgtgcttgggtggtagtgcgtgctgtgaggtcatgcaccttggtgcattgtgatgttttttttttcttgtaacttttactccttcttaatatatttggatggcctccttcggccttcccggcgaaaaaaaagtaatagtgcacaacagcaatttagttgaagatgaactacattacatcacaacagtttcaactctaccttcatggtaaaccactctttaggtccacacccatcaggaggggaagctactttagcaaagtaagcagctggtgatctgggttccaccttgtacttcttgcaaaatggaatccaatgctttgcaaactcggatgcctcgcatagaacgtagaatgttaaaaccgaaccagcatcatcagataagtagatgttcagcttctcaggcaggtagtcataagccatgacagacaaaacagtggagatgacaagcatcggtggctctgctgttggatccgctgtacagacaaaaatgtccacactgggaagctcgtcttcactgtagctgtttgcaatcaaaattctagcatcatagcatgtctttcaacaacaattctacatatcctttttgagcaaacgtaatcaatactacatatcttttttgagcaaaggataatcagtacatatccaatgaaagaacaaaccaagcaaggagaaggaattgcgacacagattaaccttgatagcagttgctggtactatcgagagccgggaggtacctttgagcgaggcggtctttgaaggtgcggcggtagacggggcaccaccgcacggacagcgtcaggacccagtagaagccgaaccagagctccgccgcgagcatcccgagccacgcccaccgccgcacgccgtcgccgccaccgggaggcaggtgagtggctctgtacagccatatcagaagaactcccgcgaagaccgtggccgcggacacccggtacgccgccatcgccatccgccccggtttctccgtcgcgaacagcgggggcccgcgctggcggccgccggagacgacgccgccgccgctccccgccatgctccctcctacctgcgaagtatggagcagatggcactgggacttcagaggagtgggtgagtgctactgctgactactgagtagcctagtagatggtcaacacaagcgaacgtccaaggcttgcacccacccgcggctgcgctgcaaagtttgacgtctagtagagcagcattactgttcatcaggagaagatgatgaaatggacgttgcaggcatggaagttggggtgaaaacagcagaaatagaagggatattatgctatagatatcgaggggaaacccctgaaacaaaatatacacgagatgactccactggtacattgttgcatggtgctatagtagatttaaaccaagatatggactgttcaatcgcaagttacaactagtgtcttctattgagctgtgaccacttctagtcttctagcatcagttgcttgtcggctgagattgtaatctgatttgtcaatttccttttcttcaacagtctgagcttcatcagcaacaaagacaacctgaaaggaagaagctgcagaatatagtgcccagtcagtaatatggtatccaacagctgaaagtggcttaacatgagatatattgagaattaccaagatactagagattaaacattgtcctcgaaatcttcagctaacattgaaaaacaaatccatccttttatttgaagagctttctgagcccattgaacaatgacagagctttaagttcaccacctctcatgtccctcagtctcctacgcaatatctgtaagaaaaaagagggttgtaacttgtaagaagttaagaataaccacatgatgaacacagagaagtaacaatatagcatgcattattgacttacatattgtgtacgatacaggattctccgttcactaatgcaaagatctcttgctagttgttttagcagtaacgtccggttggcttgctttgaattggttgaaagttgcagagacccactgctaccctgaaacattattgattggcgtacattagtttgttagcactcacaaaagtatccataggatcatcagagaactagtttgcataatgtactgtttaaatatcacgataaattaactagaagttctgcaagatcttccatggaaaggatctcacctctaggaactttgtgtattttgctatgttagactcacaacagtccaagataaactgaagagcttgttcctccagttcaggataattaagtccaggcttggatggacttttatttgatgcagcgacagccatctgaaaggataagctttgggagatcactcatatagaataagtgtaagctcaatttatcttcaacaaacccctagttttacctcagtcaacaagatcccgaaatatcggtgcaaaacagaaatgacaaacctcttcaaaacgttggctcatctcgggagggctgaccacaagaaaggcataagccatcaactcaactggccatcctgtgacgcgtaaagggaaactttcaaacctgtaagtaatgaatcagtgatcagatccacttatattgatagcaaaagtacgatttgatagtgacagagatgtgcactgtaagataatcgcaggggagttgaaacaacactgcatattctaatatttatgaaattttactcatttttttttcttctgcagaccacaccagttacacaactaaatactgttttcagacttcgttcttgatggcatgttcaaatggcgataagagagcaaacatgccacaaaatactccagcctaaggtctaatggatgttcattttagcaagatgatataaaggcacaacaacgcgacagttaagagaacattttctttcactcactatgagttgttagcacgcaaggatatgatcgcttactctgacaatccatttctttttagtgcttgtagcttctctttgtagcacttatcagacttattaagagacaccagcaattcaactgaatcatttgggtttgttccctcttttggaacaaaaccatatgaaagcaatagctcgccactggatttcttgccataggatataaacacctgaagaggatattttagaaacggataagtttaagagttaactgcatgaaataactacacctagacataacccacagaaaaatctcattaactccattttaaagaaaaggatggctgacagatccaaatgttccatgaatcacacttaagtacagtatgctatgtttgcacaaaacaaaatttataaaatggatgaactccagatgttttgggaacgcatcctaaaactagtgtcaagattcaagatgatttgcttactactccctctggtcacaaataagtaacgttttggaatgcgtccagtcaacatgttctctttaaatatttctttaatcgtcaccatcaatttctttaaatatcttgattcaacttttgaaagtgatatggttagattcatcttcaaaaaatagtttccaaatattataactttgatatatattttatgagttttatactagtaatttgtataaaacaactgtaatggtgactgtgttgctgtctagaatgacacttatttgtgaccggaggtagtaataggcagagataccaatctattggtagaaaacaaggatcctagtaagttgaattttttttgacgtaataatttttttttgacgtaaagtaagttgaatgaaacagtaaaaaaaattgctatcatattcacaaggttaagttaaaaatccccaatcttgaaacagcaatatagggctaaagcataaatgaaaagcgttacctgctcacctggttgatatgaacgatcggtagtgaaaactattccccctgaggatttatcataatccaagaatgtttccacctgaaaatttattttgcaaaaaacttatgaagtaatctctaacaataagaatgtcatgaagacctatgaaattgtacaagtaatgaaaactatgggagacagagtgcttaaggaattctgtgcactattcataatgattctttgttactaacatacaaatcgaacctcaggactatggttaagcatatctgcccaaggaactagtgcaacccttccatccattgatggcaatcgaacctgcaaatcattccaatgaacattcttgtttagcagaatgacatcaacagcaagcaatgcaaaagccttcaattttgtaacaaaacaggtaactggagaatacatggtggaagtaaaaaaaatgtttttactgcatttggtaagttcatagtactttagcttaccaggcgtgagaagaggatgccgaaggaccatctaaacgtctctaagttgtaaacctaaaatagtaaagttaagttatattagataaaccaaccaggttacactaaaaacacatgatattttagaagtaatatgtgatatctctcatgtgagtgaaccagtacatttcttagtgcgtagtatgtagaccactttcacatctttgtgttagtactgaaagctaaagaatgatataatccttagccttgttatatattttaacttgctgagacttaaaaagtagaatctaggtcggaaaggcctcttgtgtcattagtctcaacaaagaacatactaacttttgtgaaacatacctcctcagggaacaaatctgaatgcttagaaaatattctgtcacggagatcattgtatctgccaaaaccaacagagtaagattttacaattaaggctaaatgaccatcaggactacagcagaaagaaagaaaaaacatacgttccgaccacatcagtgatcctctgaattgcgcgttccctgatcggcgaagccaccaagtatgcatcaagctcaggcctagtcctgcaacaacaaataaaggctgtacaagattgagaatgcaatctccaagccccaccgaacttcccccatcaacaataatcgtcaggctataccagtacaacagagagtaaggctgccttggcaacgccgctatgtagctgctccacctcgacgaactctctaaactagcttcgcttataaggtaggtagcaataagcggccaatccggcacagaatttctcttcaacacattccccacctcagggcagccccattcctatacaagaagcacaacaaaaatcaccaaattgacagtaaattcatcacatgaagcacctgaaatccaccattaaagctatcaacgagcgggggtagtgactagtgagagggaggctagggctttcttactgagtcagctgtaatgacgagggagggaggcacgaagagcagcttctcccccttgcggatgttcttcagcgcgacgaggccgcgctcaccgacgtccacccgctgtatccccaacctctgctcggggagccccgaatcggtgagccacctctccagcgacacggcgctctccagggactcgatctcgcagccccacgggactcccgcggcggcggcctcccgctgcgccggcgccgacgccgacgccgacgcagccgaggcgcggacgggggatcggatgaggactcctgagggtaaggctagatgctgccggagacggcgaggcgagcgcggcggccggaactgcgtgtggagcgcgagcgccgcggcggtggccatggcggaaccgcgaaatggcggtgcggttgtgtgcgggcgcggggggcttatccgctttgccagtcgcgggcttggcttttttatgcgacacttttgtgggctggctgcaattattgggcctttttgtttattaggccgtgaggtagtactacacggaatgaaataagttcaatattactcccatagctagtggtggaatctgattcgtatcccaaaccataatatcgatatatcgacccccaactattaaaaccggtgcacatttgacttcctcgatgattttggaggatggtttcgctgatgtggcgactacgtggtggtgttgacttagtcttcgtcctacgtgatgccaccgctatgttgaccaagtctcggccagcttcacatctcccccgtctctccctactacaagctctcccggcgacggtagccggcggcggtgccatgtaggataaagaccaggtcaaacaccgtctcgtagttaccacgttagtgaaactgccatccaaaatcgttgagggagtcaaattacactgattttaatagttgagggtcgagatatccagtattgttcttcaaggatacgaattagatttggccaatagttaagggagtcaaagtgaacttattcgtccacggaatcttactgacaggtgtggcccactggactgacagtgtgacacgcgctcctagttgacatcaatcgccctcctcttgtgggccccgctctcgccaaaaagaaagcaacagaattcaaacgcaaaacgtcactgacaagtgggaccctatacgtgggatcactctttcccctctcgcaagaacatctcgagcaataaaaaccccgagagaaaaaaaaaagaatgctcgccattttccccaagctcccgaagcgatttccatttcaactgctcttcctcccttcgcagcacgcacgtcgccgtagccacatggccgacccttccagatcctcccccaccgcggccgccgccggcgacgccctcctggcggcggcggcggcgcccggtgacgcgccggacgcgaccgccctcgccgtggcggccgatgcggacgcggagttcgggttccagcgcgcggagctcgggacggagaagctggccggcacggtgcagttccacgagcgccacgtcttcctctgctacaaggggcccgaggtgtggccgtcccacgtcgaggccgcggagtctgaccgcctcccccgcctcctcgccgccgccatcaagacccacaagtcggacttgaagaagaaagtgagtgtttcttcaccccctcccccttttttgggggctgagataagctgattcggtgctttcatgtcgtattcttgattgtggtaggtgtttttttttacttagatcggtgtgtagtgggaactgcttggtggttttggcccaaccctaggattgtgctcgccaatagagttcgattagcttgaactatcatgtggagtagtgtgattttgcttgtcaggtggcagcatatgatgaggtgatatttcgtgtacgaggttttagcccttgctaacaaattggtcgatttgatgggtgttttgccagatggtttaattgttacctgcctgtgattgtaaattgagaagtagagcttgttgacgttgcagtgatccaaggtgcagtgctgttcataagctgatgtttcatgtcagtttatgctatatggtcctcgtgtcacttgttaccatttctattattgtgttttggttaacgatgtggttatcggtattctcctttaaggttagggctatttcagttggacatgtgaattgtgttttgggagtttggacattttcaggattttacttattctgtttgtgtatattgtggctgtgcttactaaaataaacggtgattcagtggtatcatatagtattgcagttacagagttaccgaaagtgcagcaaaatgcttttggctgttgttttgtcctaagagagtattcgcccctgtgttgccaggttatagaggaggcagtatttattgtttgttagaattgggggtatggcattactcagtattatcaaccaacctacagttgcttattacctggccttatgctagcttcattctcattagttatgaagaaaattctaggattggaagtatttctaattggtatttttcttgctaatgagtggtgtattcattcctcagaccaaattgaccatttgtgaaggagaagatggcactgagtcatccaatggagacgtgttgatctttccagatatgatcagatacaggtaagttctaatccccaaacaaaataaacatacaatctttcttcttgtgttagatattctgataaataagccagttgattatctctattcaatttgtcatgtaatgtttgcagagggctgacccactttgatgttgacaactttgttcaagaagtgcttgtgaaagatactgaatggcttcctggatctcctgaggctataaaaggttcctatgtttttgtttgctgccatgcaagcagggataagaggtgtggtgtctgtggacctgctttgattaagaggttcaaggaagagataggtgtacaaggccttgctgatcaggtgtcagtcagtgcatgctcacatgtgggaggccataagtatgcaggaaatgtcattgttttcagtgcagatgccaagggagaagtgactggtcattggtaagaacgaaagtgtaattaaatttgtatgcaccattgaacttaatgctctaatgtagctcctcattttaattatatgcactataactcagtgcttgcttacctaaattgcatttgtaggtatggttatgtttctcctgatgatgtgcctgtcttgctacataaacatattggacaaggagagatcgtggaccatctatggaggtaccctcttgtacttaaatcacaggctgatgtcaacaaggttgatattagttctaccaatcatttgtatcttgtgctgtgtggtgccatttaggactgtcaacatttcaatttacatctttctcttgctgttgttatcagcatgcatgtcacatgatatgcttatgcaaacgcacatcacagcatgtcagcatctatgactaatagtctaaacactgtacaaaatctgctttgttgttctagtttgatactttggttgtacgtcttgcagcatttatttttttatcttatataaaaaaatggttaacttcaagtgcccctcacaatcttcaaaattattattattttattatttaagggagatacgataccgtatcagaagtctccatttgaaattttcttgagcattataataaagtaggccaaaaccatgtgctacaagcatgtgtggagatgaactctgatgtagagttgactttgacttcatccagctgaattgttattcattcaggaatgcttatttttgtttgattccatcgccaaattattgtttattctgccttctagtttgttcaaattacccccttgttgatgtgagtttttttttctcaaatgagtatggttgaagcatcggtgcctatattatgtgtttgtcggctcacatcttgtctataaatatacgcaaggataaggatattttgctatatttgttgcatttacaaatctccctgtagatttaattgtggcaacctctgaaataaggaaataacttttatgtggttattcttttccgcctcaaagaatcacaattctcattctaatcattaacaaaaacttgtaatcttgctttccatatattatgcaaaacccaatatgtcaagtatgttcaagtgatccttctctttgtggttcttatatgtatcatcctattttgcaggggtcagatgggtttgtctgaagaagagcagaggaaagccctggagtctaaacacgtgacaaatggtgtgaccgaggatggtgcccatgaatcccctgaagaaactaccaacggttctgcttgcaaccctgtcgctgcaggtggttgctgccagggcaatggaggctttacctgctgccagagtgatctgccaaaggaggataagagcatcacagctgagcagaaccagaagagctccgagaagggggctgacaaagagtgtgctgctggcagcaagaagaggcacatgaagatgtgttccatgccaacctggtttgagacatgggaaacggctgacacctatgctgctcttggtattgttgcagctgctgcatcggtgttcgtcgctttcaggatctacaagaacctcaattgagaatcctcagaacagggctaggttttgtgcactaaggacagtctactgctgtaaaacagtctgctgtgagaataatatactacgtgtgcatagtaatgcaagattagaactttaaagtagctaatctgaagaaagtgaccaaagttgttttgggtaatgtcgtcctcatgtgaaactctgcttaatctccaagttttcccacgccttgcctatttgtttaccttcgcaaggcagtgaccctgctgttcgacatgacgatgttatctttattttgaactggaggtgttcttcagcatgtggatgcatgctattcagaaaatggtcagcttgtatttttgtcgctggttgctgctcctgttgttgaatgttttgagcactccatttatatggtaataaatatttcattttcaatttgccgtggaccccgtggtggctctgatcacaatattaagaggatctcaagtattctctacatggcaattctgttcttagccccctttgttctcgcagaaaggcaccggaggtggctgcggcgtctggagagtggagtggagactgacgctccggcaacacagcgtttcaggtccaaacataaccgcttcgtcaccactcaccagcacgcccgatgcaactacttcactgctgcttcttcctggtacgcctctacagcgcttgattttactggcaagatactgtgctaaataaggggattgggatcggagaaatattaggtccataaaagtaagaaaaaaatattaggacaaatctaagctggtgaagaagcagtgaagaaaaaaatacagtacattatttatcacaggctcatactataaagcatcaccgttccgatctcagaaatctcctctgtacagcaaatagctgtggacaacagaaaactagactgcacgtctgcacaggtagagatgagagagcacatgcccaatgcagtacatcgtttgctgaaatagtgaaatggatacgtgatcgattggtatctgtggtccgtccaagctaggatgtgtgtaagcagaaatggaggcggcaagcaattgctgctgcagatattgcagtcgcagatacatgtgctgaactgccagccattcttaaatgatggtggcaaacattcagagatatggtgtgcccacgatttaactttccatttgtgttgaagtgtgatcctcagcttaaatgttttggttacatatagtgcaagccgttgtaattctggcatgtggccatcaaggcatcaaatagttacagtagaatggccactggcctggttagcaatcacatggcatcatgaaccccctgcattggactgaactgggataataatggctcacatgcaactttggcatactgcttggccagaagattagggctgcaggaat

SEQ ID NO: 75777 - DNA, 7043 bp, Oryza sativa
taaattatatcaaaattacagtgagttgtatgtgttgattagagcctatatgaattttcccaagattttatcttgcacgaattattttatataattagcaagaattatatatatatatatatatatatatatatatatatatatatataaacttacttttttccaatctttttcaaaaaatctattcatgctttttttatccagtttcgattattctcctcaaaggattctatcttaaaatatatatatatatatatatatatatatatatatatatatatatatatatatatatatatatatatatatatatatataaaagagagagaggacggctcttcagtacacctaggtgtatgtactcctcctttttaatggattatccattagcaaatcactgcatgcatgtgcacagttgctcaccggatttggtgcacatttgaacgagagcgttggcatgcaattgctttcacccctcccctagaataactattctacacccccctctccctcaactcccgatccagcccagcccacccctccttccccccagtccccacgcgcgcccccctccctcccggtgaccccaccctgtcctggcgcgcgtcccctcctccctccattagctccctcccggttcccagcgaccccacggccccacccactcccggcgcgcgcgccttacctccttcctctcgatctctcgcccgatctctccttcctctcgatctctccctgatctctccctcctttttttcttctccctcccttctcttatttttcctcctattcttttcttttcttcttctccctcccttctcttatttttcctcctattcttttcttttttagaaaaaataaaaataaattgctgaattcaagactagaacccatgatctcatggttcataacaaactctcctaatcaattcaccttacaacactttgtgatttaagatcattgttttctttctctatatatctactcaaattttatgaacacaaacccgttatgttattgtaggaaatcataccttgttattatgattcggtagtaacattattgtagaactgcagtaacacgatacattactgtgaaaattataggccgttactgcaaaattcataggtcgttactgcactttttgcagtaacatcatgatgaaattgcagtaacagagaacatatggtatactactacagtaccactacttgcgcatagctaaatttttaaatctcaatcttatacaaaatacaagtgctaaaaaagtgtatttgcatggtcacaagttaacacaagtgctaaaagtacttctctttatccatacaaagatacaaagatacgtagtagcaagcttagtacaagtgaacttttagaattgaagtctttaaacaataatatctctcacatcgtaaattattttttagaaccgttttcaccataatgctttaaaatgatgttacaacgagacaatagtcctattactacacgatgatcgagacaaaaatgcttttataacgttgttactacggaaagtagtcgtgttactgcatattgatcgtcgcgttactacgccgttccaacgagacgagaactgaaaaaaagtaaatctcaatctttaaatagcaatatctctcacgttatatagtatttttctaatccatctgcactatgatgttcgtaaaaaaatacttaacaaaactagatccatcatgactattttttgatgttgttactgcgagaaagttgtcctgttactgcatgatgaccgttatgttactgcggatttcctgcgagacgtgaacagcaaagtggtgggcgggggagggagtcaatgggcggtttgactcgggtttgaccgtcggaaggaggcattgaccagcctttgactgagatgggagggagatttgggccctacgaatggtgggggaggtgggattggctacacacaccgccgcgcgctagaaaactttgtagcgctactcacgatagtctccacatccggttttcccgttcctctctgctcccacgcgtgcccgatctcggtgaaaaaattactctcccctgtccccaccgagcgtgatttctgtttctgttttgacatgagattcaattccccaccgagcgtgatttccgtctgttttgacgtgagattcatcttcctgatccacacgtggcaccatggtccccacgtgtgctccccaaatttcttttttcatcattgttgcatggtcagtaaattaattcccagcaaaaatatacctcggtaaaattttcactccctatatattagctactcggtaaatctctctaaactcagtaaaatttttactctcatacagttctcagaaattcttctgctcacatatattttacgagttctcgtagtaatatttttactcggatatatttttctcgtagtaaaattttttctagtacatcctcgtagtaatatttttactcgtgttattgtagtaaaaattttactcttgtattttcattgttattacatcattaatcacagcaaatatttgaactaatactattttaccatacatatagttacatcgttacatcgtattagccactgtacgggtaaaaaaaaatgaagagagcaaacaagaaacacgttctgagcaagaggccatgaccagttcccccgccggtagccgatggacctcgtcgccatcgcctgaccaccaccggatatacggcagcgccacctctgccaccgtaccgcatgaccgcatccctcctacacaggcaccaaacgaccaagggcacgtggaaaacgaggagatcaccaccgttcaccaccagtccaccacgtccgccttctatccagggtctgaccgctgcctagctcctcccggccggtgctgctgcaggagatgcacgatggaggcatcggcattgtcgtgcttgtccccgaagcagaaattttccccggagcggcgattgtccccggatgccgccgatgccctgcccggcatggtggccctcctccccgaggtgtgacgctccgttgggtctgggcgccgctgtcggccaccacgccgcctccctcccacgggacacgcagaagatgaggagatcgccgccggctgccgactccacgccggatcctgccgcccaccaccccaacgccgatggacgcctcgtcccgcgtggtgcctctcctccgctgcccctctagatccggagaaatcggaggaggtgggtgaaatgttttggaatataccgtactgtacaaatgtgtgtatatataggcaggtatattagtgttaaaaaattactactaataagttggataacatcaaataaaaaatttactcagactatgggagtaaggggaggaggcgcacgggtgggatcgagattggtcatcggtgagttaaattttaactgcgcactatagatctagtggggagctgtatcaggtgccgtttaatatgtagcgaattagggtgatatatatatatatatctcccccccccctactaccaggtgtagctactccaatggtccgttcaatcgttaggatgtgcactgtttttttataataacgggtctaatcgagttcaatggtctaacccgattcatttaagcacgtctaattttctgaccaatcgtttaatatttatattattcgtggcatttgaaaattgaatgaacctatccgagtttgttagctttggagtaactaaccagatatttacccggcctcttcgaacgtattttggacgtaatttctagaatatgttctgctctttgaacgaattgttcttcagtagtttcgttacagagacaagacgagcaattgcacatcacaatcagttccaaggtatcagacagaaatcataccaattttattatactgaccaacaagcagatgatacatatgctctactcaaatctcactatctcagttgcctttcaatgacataatttaaaatatcctactacatacaactactcgaacactgaactacaaactataagcaggcattcagaaagaacgctactatttggaaattttcctttgattggctcggtgtctacatgggttcttcattggcaaatggtcatgtgctttaacgctacaccggatggaatcgcgcctagcaaaagacaccgcttgaaatacaaatatctagcaatgaacaccatgtccatctcttctcagccttacttgaatctgctgctatatatctgaacagcacgatcgatcatatctctcctgtaacaagttgccagaccaccagcagagaactatccctaagatttgaacagaacacgcttcgttacaaactgctgagagaactggaacaaaaaaattgacagactgaacgcatatccattggctcctctacgaccacatgcacctgcgtcaagaacctgctgccgtccctcacctggttctgctccaaagcagaaaccagcagaaaccaccgaatatgtttctgcttcctccttgcatggtttcttcaccatcgacttcagagcattctttttcgacgatattctgacagaaccaagaacaagaaatttaacagaacgtacacgtgccaaattggaacctccacgatcactatagcgcctgcgtcgagaaccttctgctgtccctcaccgccagccagagcagaaaccgttgtcgatgtttctgcttactcatcgagttgtttctgctccatcaacttcagaggaaaattagtgcttacccgacgatattctgacagaaccaacaacaaaacaattttgacagaacgtacacataccaaattggatcctctagcggctgcgtcgagaaccttctgctgtccctcgccgaaccaccggccacagcagaaactgccgacgatgtttctcctccgtcctccaacgggtttcgctccatcaatgcttgccgacgatactgtgccgcagaacgccagctgcttctgctctacacgactactcgccggcgatgttgtgccaccgcgcaccctctgtttctgcttctgctcttgtggtatgttgagtaccaacgatacctccgggtcaaacgggcttgcattcatgcagaaaatgcaccggataaagctcgtgcagttgattgattttttttttcaaaacttcaaatttaatattttattttaatttctgccgcctataggtcagtgaatactttctgcttttggtgagtgatacaggacccgaacccggtaagtgggacacgtgttggatgtctattgcaggagtagctactctcgggagtagtatataggcttcatatatatatatatatatatatatatatatatatatatatacacacactcaagggccacacccacctccccattcttttcaaggcccaaaaaccacctctcactgcggtcaaacgccggtcacagcccctcccgccggtcaaagctcagtcaaacccgcctactaactcccctcaccacccatctcttctcagctctcgtctcgcgaaactgtgcagtaacgcgacggtcaccgtgtagtaacactatgttttacgtgcagtaacaacgctcaaatatagttgaaatatagtcatgatggatctacttttgataagtatttttttctagcatcatggtgcaaacaattttaaaaaaccatacatgacatcaaagatattgttcttaaaagcttttctttttggaatttgactctccacaagtagtaatacaatagcattacttgttactactgtacgttactacagttctatcacaacgttactataagagtctagtaaagacaataagctttgcagtaacaaagtgtcttgcatttcttgaatagtattactacataaagtaggaattgaaacaaaaatatatgggttaaagcctcacatgctaaccatatatttgttactacacataagtagaagtgttactacataataggtgcatgttaccacttctaagtagctatgttactgcatgataaatgcagtgttactatgtcatttttacgagatgaagatcgaataggtgagccataggtaaagtttgtaggtggctttgagcaaggtctgattgatgtaggagtgttttgaacaattttatacatttggtaaaaccatgttactgcatgtatatacccttgttactataaattacacattctgttactgcatgtggagggctaaagttcaaaatgtcaatatttgaaaagcaatatctcacaagatatgtattattttttaaaaccgtttccaccatgatgctatagtgttactgcatatggaggattaaactttaaaatgcatctacgtactcccctcctcaagaaccgttcttcctccctcttctcaaaaaaattggtctcctccctccaatatagtgttactgcatgtatatgacgttattgcacttttgaccgtaatattgtggtgaattgcaataatttaggaattgaaacaaaaatatatgggttaaaagtcttagagctaaccatatacttgttactgcacaaaagtctgcacaaaagtaaaagtgttattgcacgacaattacacgttaccacgtgtttatgcagtaacactactcaaaaaatgtagttagacgctttgttactgcaaaacttatagtcttgtagtaacgttatcgacactatgttatgtgaaacttataatcgttactacatcttgtagtaatgacatgatgtgattgcagtaacgcaaaacaggcagtagtaaaacttttgatatagtattactactagtggagagttaaatcttcgaaaacaaatctttgaagggtaatatctctcacaccatgtactatttttaaaaactgtttgcaccatgatgttaaaaaaaatgtttaccaaaagtagatccatcatgagtatattatgactaaattttaattttgttactgcaagtaaaacattgtgttactacacgatgaacaacacgttactatgtcattccgagacgagagctaagaagagagagggtggtggggaaagtcaccgacgggtttcacactcatatggggcaccatcatggtgcccgggca

SEQ ID NO: 75778 - DNA, 9434 bp, Oryza sativa
tagttttaaccattagatctccatctaaaaggaaaatgaaaaaaagtggtacccacctccactgccgtacgtatgtacatccgtgctccctcccaccctccgatcctcctttcatctcctctcctatttttagctaacttatcatattttctaactaacactcaatatattaaaaaataattcggaaatgtaaataatcataactctcaagttacatttattttgttatttaaaaattagatcatgcgaccgttctaactacaaatgtctaggtctgatggtacctataagcgctcttaagtcatcacaatgaactctaataaattaaaaaattctataaatatgagtgataaaataaaacatttaaccatcgattttcacttaaatcgatggaccttatatggttagatctatctttaagaaaaatcgcaaaccaacctccttccctcccccgtaccacccatcctcccgttcctctctccctgcccttccttctttgtttttttcactccacaacaacctctctccatgacctttcttctttgtttttttcactctacaacaactaaaataaaaattatctttacgggcaaataaactcacaaatggacctatacctaacacatctagcgggctctccctctattacgtgattttcctctctttctcctctacctatagcacggctctccctctatcacgtgattttcttctctttctcctctagctgcactgtagaaacaacacaaattagactttaaaataatcataattctttaaatcatatatacaatttatgacatgtataaactactgtaaattttaattaaatcaataatttaacatgcgtattaacttacattgtggaacatatccaccttcaggcctccactaaataaataaaatactaaaatttctcactaaaaattaaaatatcccaccttttttaaataaactggtcaacctattatttataccctactagacatctaatgactttctaccaactctttccatttcagattataagtcattttaaatttggtcaatgtcaaactcttaacttagtttataaaaatacatagtacattttcaacgcaaaacaaacatattataaaaatatattcaattctgaatttaatgaaaactaatttggtgtcgtaaaaaatgatatattttttccgaaacagaggaagcaattaatttctcttaacatgcatataggggctatttacttatacttgatcttagatgtgcttttgtgaataaattatcttttaggagataaataaatgttcctaagatgatcatagcatataaattatacataagatatatggtgtcactaatagattagagaaaaagcttttgattatatattttttagtcgtaacgtgtaccctgtgtagggtctatttgtcatatatatagataacagattgaaaataaccaacatcgtgcgttgaacatcatacaagatcgtagcaaacacatgggttgtgccaattatagcagtgaaacagccatatatatcaaatcaattatatatagaaattaaagaccatgtatatttgcatatttatttatttggtaaaacttgctacactgcattgtaaatctagaaacactccagtttagtggtagtttagttaaaaaacattatgactgttattttaatatttcatacttaattggagagagaaatgttgaaaggatgccattaccccatgccaagttgtatgaccttaacccacttatattttcattccaaattgcagagatcaaaacatttaaagaatgcttgacggaatgaaaatctagaaaagaaatttaaaaaaacatgaaataaaattgaaaactgaacatttattttttctaaatctaacttttttttgggaatttgaaacacattctaaatagcaaagttcaaacattttagaagtactaatataatgaaaataacaaaaaaaatcctaatgaaatctaacagaaaaattgacttttgggggcattaatttggaaataaaatctaacatactttcaattcgaattatgcaaccctaaactataacttgggagcgataaaagtatccttttctaatatattctctgtttgagaaaaaacatttacttctaaactttagttttctactgcaatactatattactacaatcaataaatcaacagttcaacatatccacgtcatttaattagatgatgtggtcgtattagccatatttttaatagaaaatattttcaattaatatatcctaaaatccagaaagacatatatagtatacaagacaaatgttactcacagtttagaactaaatattaaaaaagaaatgcattgtgtacaactccatcgtgacacaatattttcttataaatttaaaactaaaacagttttaagtaatttagtttagaattcatacgccacattggtaattaaaaaaaatactagcactcaaagaaacccaaaaaattattggaaaaacatgtttacaatagagtaatcataaacattcgtaataaaatttcaaacacattaaataagatgcacgcataagtgtgcgggctaccttcctagttgagttctaaaaatacaacaaaaatacaaaagatatgtcatatttgcatgatatataaaataatatagataataattatattgctagtgggtgatgatgcgataaacttgcatgtgatttaaaatactttagataataattgctagtgggtgatgatgtaatacacttaggggctgttcactttgacgccattttcaaccataccgtttttttttggcaaagttgccaaaagaaatcctaccaaaatttgataatattgtcaacatttatttacaaaatttgataaggtttattttgacatcaaaagtgaacagccccttactttaagtgaattaagtgggtgatgatgtgacacatctactttaagtggagttgtgtattataataatgtagtatacttctctatgtatgtatggtgactcagagaagattaattaattgatggcatgcatgctgactgcagcttcaatattcttatgaaacggttgagattcgttatgaaggcagcagtgacttcttcacctcggcctggtcaaatgcgatgggcttgttgaagagcccgaggggaacggtgatccgtattgaggttcttgtggtgttggctgcttgtatgcttatattcctcgccgtgtttgggtttctccgacggcgatgcacaaatcccttgttccagacggctgtcatgggctcctatgtcctgtcctcctccctggtaacatacacgcttggttcaatgcagtcttctgctgccaagagtggcatgtaccccatttgggccttgtcactctttatcctttctgggtgcgccgattcagtcacggcatatagcctcgaagacaacaatcagatacagagacagacatacaatgcttgcctctaccatgcttacgtcctcctgatatctgcgaccatcatcacgcaaggtgccggcgcaggactacttattcatccacaggattattgcatctcagctggcaagcgtgtcgtggaacctgaacaagatggttgccgattacatgcatgaggagcacgccaatcatccaatacgggagtacgacgcaggcagcatgaagggttaccgttacctagtctactggcgattggacaagacgtccaagattgaagctgcgacatcatatgcagcacgcgtaacaacaacagatgatgatgcccagatcatttgcatcgacgacatatggctccgcagcgacaagtcactgagcacggacctgaaggatgcctgtctctccttctctctattccatttgttgcggaggcgcttctttgggttcacatgtgctgaatctgcacaccccaagactagtgatttcgtcttcaagggcctgctgcagttgaagaatggcagcacaggcactgtagactacatcagagctttcaaggtcatcgaggttgagttggcttttatgtatgacttcttcttcacaaagtatgctctcatctactacagttcaacctctgctgcagtttggtcattggtttcagctgccttcacagttttaactgcatattccacaaccaaactccattggcttcagggtggatccactgttgtggttcagggtggacccactgttgtgggcgacaacaaagctgacatttttatcaccatgctcctgcttgtatctattgctttgctagagctgcttcagccactgctttactggaccaccatttggggcagagtatcttttgtttgtcagtatatcagacaacaacagccattgcggcatggcttcagctgctgcatgatgagagttaaggagcttctcaccaagatcggtctgcgtgtgtcgtcaaatgggagctactggcaggacatgcttgggcaatactcgttgcttgcatcagtcagccgcaataaaccgattaagcagctggggagaaaacgtagtagatttattaagtgtatgaatcttttggactacagggcacttaatttttatccagcgattgcctccttcaagaagaagaaccctgtagacaaacctatcaagttgtccccacaagtgaaggaggcagttgccaagtccctgctgcaacatgctgctgctggtcatggtaatctgacgaacggagtgtcatcattgaagtccaatggagctcatcacctcttatgggcttgtgacccagacccagctgcacgcatcttgcagaatcagacgccctctattttgatatggcacatcgcgacatgctgctgcgagaagaaaccgcccaactaccagcatgaagaagagctgaaaaatttccaggtcgccactgcgctgtccagatactgtgcgtaccacagcttcttcctgggcaccactatgacacagcgtgtgtgctgcatgcggtcggagaggaatccgtgcagtttcttcgtgaacgtggaaaaaaggagttcgacgccatggccctgcaaggctatgagccaccaccggagggcgagccaactaagggcatattcgagagtggcttgaagctggggaagcagctggaggagatgccagagaagatgcgttggaaggtcctggccgacttctggcctgagatgttgctctacatctcgccgtcagacaatgtcaaagagcacatccagcggctcgccaagggaggcgagttcatcacccatctctgggctttgctctcgcacgccggcatccttgagcgtccgaagcaggagcatcaccccggaagcagcgtatgaccgagtaatataattaccactccctgctctgcatatgtatcgctccctccgtttcgtattataaatcgttctgacttttctcttaatcaaacttaattttttaagttaatttgaccaattttaacaatattttcagcacaaaacaaacatattatcaaaaattttggtgttttggattgctatttttttttactaatttgatgaaacttaaaggtgttttggatgttgctaatttttttttacatattcgatgaaacttaaagaaatttgattaagaaaaaagtcaaaatgatttataatatgagaggttatcaaacggagggagtaaattgcatctcttgtcaccttcttgcttggaccattgcatatatgtatatatgctgatgttccatcgccatgcattctggaatattttctgcatacctgtgttggcttgttccggtggtatatttgtttgtgcttcaatgtttatttacctcttatgacgttcaatgtttcatatataatatattgtgtgaataatcaaagaaaagggtcaatatcaggatactggtatcattggtatctatagatcatatatcatgaatatatgtctttgattcagtatttatttacgccacgtccatgtttatatatatctctgtatgtaaatgtgaactccatgaatgtttcctggattaatttcgtataccattggtttgcctgtaatataatgtgctggatattgtgtcatgccttcattggattgtttttgcatgcaaggtgtgtttagttcacaccaaaattggaagtttggttgaaattggaatgatgtgacggaaaagttggaaagttttgatgtgatggaaaagttggaagtttgaagaaaaagtttggaactaaactaggccgcagtttcataacaagaagggcttttctttgtaatataagttctaatttgtttgtggaccttgctttgccaagctggcatcccagagaggagtgatgtgaaactggaatggaaatataatgtgccacagtcccagagtcatgaggaatgcctgcaacttttcattgagttttgcagaagaaaattttaacaagcattgagcttcgcagagaaaattatgcacataattctgtcagaagtaagtgataagggaaaaaaatacttgaggaactgcaacgttttcaattacaagggaaatggggggtctcagttttggaaggggttgcaggcttgtaaaagttggctctctaggatggtaacaaaaaagatccatgatggtagggatgtgagtttctggaatgatgtatggtatggggatgtggctttgaaagttaagtttcctgagctttttgagttaagctacaatcaaaacattttctgtccaggaagtggttgaattgagcaattgggacatggagtttagaaggcatttagatgaacacagacaaaatgatttgggggagttaaaaggtttggtgggggatattcagttggaagaagggagggataaaagttgctggccttatactaaggattctttgttcaccacaaagtctatgtacagaatgcttacttttggtggaattaaggatctggcaatgaagggtattggatagtataggaggagaggaatacaatgtaacgtggattgattgtattgagcctcaggggaccggtatatataagattgcattggaaggagataaagaaggattacagatatgaaaggagtccatacaaatcaatcctatcctaatatgactctaactaccatatactctaacacaggggttatggaaaagcaaaatacccttgaagattaaacactttttgtatctagttgggcgtgggagattgccttgtgctgagcagttagtgaaaaggaagtggagaggaggggatgatctatgtaaactctgtaaaaaaaactgaaactactaatcatataatcttcaggtgttctctggctgtgtttttttggtgtgttttgaagaaagcttttcagcttcagtctatacctagagatctttgagagtgtatcaatcttgtcaagggaaagggagtttccataatttgggtttttctttctgcttgtctctgttgggctttatggatgactagaaatgattgggttttcaatgatgtcctggtgaaattacctttgcaagttgtttacagagctttgtctttttcgcagaagtggagcgtgttgctaaaagaggaagaacgcacaattctaacagagtggcgtgatgctgtgctggacaagctaaagcaagtgaaggctcaaaatctacctaactcaatctagctttgctgtcatctggttttgataggcgtctcttagttcttagactggttttgctggctgattgctttacagcagcttttggtcctgatcttgtaagctggtcggccccagcatttgcttatgtgtgcctgttgtttttgcgtttcagtataatactcagtatgtttaactttggctttctccccaaagccgggtcaatgcaattgatatgttctaaaaaaaatatctgtcagaagtttaatgccaaaatgtctcctttttttttctttggactcatgtatattcttatcagttattttggtcgttggccgtacatcagtcatcttccttgtaaacccaataactctaaagtctgaaagcaccttgcaaactgtcatccaacctcagctacatttagttaaagatcagtatggatactctgaactagaaacgcttttagccctctttaggtcgctcagctgaatcatttgcccttgtaggctactgtacttcacctgtttcaacaagattattggaagaaatgagttttcctacagagcatatacatatcagaactgaatcaaatcaagctatattatgtcctacttacgtgcatcagtgctagtgtggacagcaactctctgcactgcgccattagaacctgttcttgtctggtaattatggacagctgagacaccaacacatttgtcctggctagctacagaaagaagcagatgacttcaggataactcacataattaaggtgtagagtagtttataatgttcacttttacatatcatcacttcagtagatctcaatgccattatgtagatttgatttgtgctttcaagggtaaaaggaaacacatgaatgattcggagagaacggcaccttaggcagtagataactcattgagtttctcattgtctgcatgacatcaactgcagagccaacagcatttttgacagactgaaaatctgcctgcaaagtatgagattgcaatgccaaacatcagatataatcaaacttgtatgaaacatggaggaaataggatcagtgttttgtcaggtttcaaaccactgctccatcagagacaggaaggcgaagaacggtagcattcagagcttccactgttcctgacagcgaattagcatacttgttctccagtaaggaccactcttccagatatgccatctgtatagtcagtgtaatgcttaattatcagaatttcatttgagttaccattcataatggctgatctatctaatgatctgggacaaatcatgacctttcaactagtctgcctagtacacgtgtacagcttcattagtccatatattaggtgtaactactgttgaaatcaagtgataaagagatgattattttcagctttacaactaggcttaaccacaaaccatgtgcttaccatttggacaggcaagtaaatctgcatgtaaatggcacggagcaactactcacagtcctgtaactacctgaaagaaaagtgttctggtgcagactgctgagactaccagactactaccgatattgttcaaatctcaaaaaatgcattttcttagagaaaaacatgacgaatcacaatagatgaattccactgaaacataaaacagagggtgaaaattttgccaaatagatgaattccactgaaacataaaacagagggtgaaaaatttgccaaaatagcagaattcttacttggcccttcagagtattcatgactttacaattttgtctcagtaactgtagctccaacttcttgagcgcaatcgatttgctcatcccgaggatactaacccatgcaccacacaattgtttctgcaatgaagaaagg

SEQ ID NO: 75779 - DNA, 42127 bp, Oryza sativa
aatctcgacctgggaagaaacaaaagatcaaatctgttagtcctgatgatggatttcatgagagatacctaaaacttaaaaaagaagaaatagatcgatttgctgcaattgaggagaagaaattggaggatccttacagcatcaacaagtgtatcacagtgcttgaaggtttacatggtctacaaataggagatatattggtggcagctgatatcttcaaaggtaaggataatagggaagttttcttgtccttttcaagtgatgcattacgcctggcttggattagaaaggaaatcgcagcattagagtgagtacttttgtgaaacatatggcatgcaagtagtaggatagtacttttgtgaaatagatggcatgcaaatagaaggatagtacttttgtgaaacaaagggggtacttttgtgaagcagatagtagtaggatatacttttgcttagagggagtgcatgcaagtagttacttcattaagtagaatgtgacaaacttggagtacaagactagtaattgaccttgaatgccatggtggtcaaatgcaatatattatttccttcgtgctacgtaatggttccacatccgttgtgccatgtcatctcgttttctattcccagcttctctagagttgttaaattcttgtacatcaccattatagttctcgtctccatttggcacatcaacaatatgatctggatcaatctctaaacgacaattacttggccacaccaaatctccattatgcaggcgtatgaagttgtgtagagcacaacaggcaaccgaaatatcaacttgtttatgagctgggtggtgtgagccggtctttagtataggaaatctcatttttaatacaccaattgctctctctatatggtttctgagttgtgcatgccgaagattgaataactccttataattttgtggcttttgattagctctgccctgttcctttaaatgatatcttgtcccacgatacggtgctagaaactgtgttgtatttgcataaccagcatctacaagaaaaaatttaccaggaggtacttcaaaaccatggtttagtgcatcttgaagaactcttgcgtctgaagctgatccctcccagccggcatgtacatgtacaaatttcagatcgaagtcgcaagctaccataacattctgagaaattgtttgctttctattccggtatggttcttgctggtctagtggaagtatcattggtacatgtgtcccgtcaatagagccaacacaattctatacaaatacaaatataaccttgattaagtctttttatgtacaatgattggtttaactcaaagtaaaaaaaaatcaaaacatgaatctgttcatacctcaaaaaaggggtgaaattttggtcttctcaagatatgatgggggtgtaggaaaggtggccgtatatatacacatgtaagttgcttaactgcatcaagcacaaccccaaaatacttgcttattgtttgcccgctgtgttgaaactgatcttgcaaggtctcattacttgcattttttgctagtgcatacaagaatatagcaacttgttcttctactgagacatctcttgcatcagcaagtagttgtttctcacgcaacttatcgactaaagctcgaaaaacattaacttccatgcgaaaattccttttgcttaggctctgatgacctgttaagatttcattaacacgacaagcccctgaaagttttgatgtgtgcatcggtttcctactagatgatggttgtgacgaatctccttcgatggtagggagaacaaaaagcatgaactcatcttcattctgtgaccgtcgtcgataacttggatccatgacaatcacaggggaaatcaacaacaaataataaatctgatggtttggtctaccaatatatataggagagcagaagcaagcaaataagttgttaatccttacatacataccaaaaagaaaaaaaatcatttatgacttaccaaatgaattgccacgtttgagctcttgtcatgcttggccgatacaatcgaaggtgaggtgagctagttttgttgatgtccagttgcagctacagcaatatatataaggacatgcaacggctagtacttgctttgaacgccaacggctatctgttcaaattcaaaccggaagagaaatcctgtatttttcctatagcactatcaaagggcacctttcattttttcctatgtttttgattcctgcgggattgaagaatcatactacttcaattcctgtgtttttcctattcctgtgtttttcctatcctgcgaatcaaaggggcccttaaggtatgccgttttctgctttttttatcttagtagcaaaccaaataagatgaatacaaatatttatcctatcaaacaatttgtagtatcaaaacttaattacctatgctaattttggcaccaccctagagatatctgaaaataaatgaagcatatataagtttgttttagccacacgtaccgtgcttctcattttcttcccttgctgcagcccgatgtatatgggctacgtagtacgtatatgtttcttcctctttgatctgcagcactcgcgcccgctggtgaccggcccggtcgatgtactgaacaaccaccccttctctctatgttttcagtgctatatatacggcaaatgttgagtagatcgaacgatgtgattaatactatatattagtgaaggatgggatgctagtagacattaattaaagagtaaagtttagaaaaatcaaagtttgcggaaaaccacatgtattataacgtgtgacacataactagagatagcaatgggacccataactcgagactcgatggatttttactctattagaagctaatcatgttctaactcttatagctatgggtctattgacggacggaaactcttacccattggatacgtggtatggttttattctttacccacccgtacccatagcctaaaactatgagcaatataagtctcaatgactactaaatcagcataaaactcatttcacataatcacatcttaagaattgttctagactagttatatatgaaattgttatttgattcgatcgccagcgagtacatacctcctgttagaatatatgattagatgcttaagatcgaatcatacctactgcactatacaattaactgtttggaaaatcagagtatagtatagtacagtaggtatgattagttgttgtttgtgcaatcccttccctaattgtgctgctatcccattttgcttgccttgctagtttgcttataaatctaagattttcaaaaatatctgaaaaatatttggaaatatccgaaaagttcagcttccatacttacttaaaagttttaaacgcctattcaccctcctctaaacaacatcaagatcctttcattgatcctcctccctttcacttccatgtgttcaactttgtgtggaaggtccttcaactactggaaagggcttgtgcatgctcctcgtctcacgaggatgattaagaaagtcacccagttgactcacaagttgcatctcaagactgatgtttcatcaggggctggtccttcctcttcctctgcttatccgagtatagtatagtacagtaggtatgattcgatcgccagcgagtaattaactgtttggaaaattgatgatccactagtgtagtttagttagtatagtacagtagttggagtcgctcttgaccgacagaagaaagtctgaccctttgaccgattaacaacatccacattgccattaattatatattacaatccattggagcttaattactctcaaaataacgtgttcaactaccggaattaggcagcattcatcgcgtatgtaaccatccgaaaatttcacaatttggcccttttttaaaacttatttcaaatttggtccctaccgaaaactatcaccagatttagaccccgagctcagcgccagacccgatggcgctgaggtagaacgcctcagcgccaaccgcatcggcgttgaggtcctaacggccatctaaaagcggtggggcgaaacggcccatgtggcaaaggtcagcgccaaccgcatcggcgctgaccttcgcgacctcagcgccaagccgccaacaggcctggcgctgaggtccccacatatccctcggggccgagccggccccaggccattccttcttcctcctcgcacctcttggttgagaaggcgtggcgccctcctctctctctcctcctctccaaaatcgagcaaatatccacaaaatcttcgtattttggagggaaaatcattgggggacatagtgccaaggtattctcctccgaatcttctcgttatttgtccattttttgcttggatttgctcattgagggatgaaccctagaaacacgatttggggtttattttctctaattagtttgttctctacattgtggttgtagtagttgttggcaatgcaatgattagatgcgcatagaaccgttaaatgtaggactatggtgagggtttaggcatttagggaagaaccctaatttttttctccaaattatagaagaaccgtatttattttattttaatcataatgtgagagttcaaattaggaatggatcctttgaaatggaagtttgtgtatgcttagatattaatggacaatttcattgggggacttagttgtaggttagaaaaggccattgtttttactattgcaaatttagcttttaaataagggcaatatgctgatatgttggttaatgtggttggtgaagattccatatggcatacgatggagatattgtgtgcgtatgtgatgcggtgtcgaatttggaaggagtctaaatttggtatgattggagtttgtaaattttgtttcttgtacgcgaaggtttcctaggtggattagaacttcttgtatgagtttggctcgtggctttaggctgcctacctcaagtataaatagagagggagcgtgaggtttcccggtatcacttttgagagtattgagttgtgagtttagttagggtttcgagtttagtcgagattttcgtgaggagtgctgttattgcactttgtaaacacagagaggagtgctgttctaggatttcactgttatgttggagggcttcctctagtcgcccattcatccttcgccgacatccaattcctctccacttcctctatatctcgggttagtttattttcgaaatgttcctcgttgatgatgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaaggcagaggttccggagacctgctctcccgatcgccggtgcacgccggcgagcgggatggagtagtctacgagcgacggcgcagtacagagtaggaagcaaaccctagattgattttgcgtatgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatcttttggaacgtttccaaaacaaaaacgaatccgaatttgcaacaaaacaaaactgcaaaaggaggctgcatctgcgcaagggtgaggagccaatttttcggaccattcgacgtgcacgcgcgccgcctgccctgccctgccctgccctgccctgccaggcgaggcgaggcgagcgagcgcgcgcgtgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacctagtgtgaaaacatatccactagtggctttgatctcatccacatcagagatccagttagaatcactataaccctccagtaccgcaggacacccagtatagtgaagcctcaattccacagtacctttcagatagcgcattactcgctcaagcgcacgccagtgatcatctcccggattagaggtaaatcggctcaacttgctcacagcaaaggagatattaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccctcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttaaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccacacaggtttacacccatagagtcgctctgtcacctcccaagttccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaagatagaatcacgagactccataattgtaccaacatgcatgtccggtacctcggatttaactattaaaaatctataggcaatgctatgatgagcatatcccagaaaaacacagtccacagtcttaggaccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcgattcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcatcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggtctccgcactcataacctttaccaataaaatatccatgtttagacatgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattggtgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacagcggtgaatttatccggcctcagtgcatcggcaaaaccagccatagtaaaatcacagtgcctataataaggtttttggattgttgagattatagacatgtaatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaaggcagaggttccggagacctgctctcccgatcgccggtgcacgccggcgagcgggatggagtagtctacgagcgacggcgcagtacagagtaggaagcaaaccctagattgattttgcgtatgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatctttcggaacgtttccaaaacaaaaacgaatccgaatttgcaacaaaacaaaactgcaaaaggaggctgtatctgcgcaagggtgaggagccaatttttcggaccattcgacgcgtacgtcgtgcacgcgcgccgcctgcccggccaggccaggcgagcgagcgcgcgcatgtttcccctcttctctccaccacacatgcttcaagcgactaggagggcatcctcccttttaaggaggtccccctctcctagaataagcaaagtggtactaaactccatatgcatgccatcccatgaggtgggcttttgtgattttccaaagaattaatcttcgagtgggctaaggcccattcattaattccaacagatgatttggatttgctagctccccttagcgagctaaagggattcgacctgggggctgagggcaacatgcactgacgcgcatgctccggcagcgatggctacctcaactacaacatccttatcctccagctgcaccaggttcctcatccagtcatccacttccatgcaactaggctagctgaaagttgcctccattgctgttgtttgtctgttcattgagactgtgcatgtcctctggccgtcttatatgaaatccatcagctgggcagctcccttccctttcacacacacataaaaaaagaatatatattattttgaagattttgcatttatatacatgattttaaaatattatcgaaaatattccctggccacgacttggggatggcatgggaccgttgctatgtggtaccgcggtttacccgtgccgcgacaatgcgcgacccactcccggtcacttaagcgcggcaccaccgtggtcccgcggctcggccatgcgccaccaacaagagccgaccgtgttccgaaatttatgtaatttggatccatttgaatctttcatatctcaattcaaattttaaaacttccatatcgaaattcaaaacattcagctgaatttttttacaaaattaactcacaattcgaattttgagttgaaagtttttaaatcttgagttaaaattctcaaatttgagttgaaagtttacaattcttgacttgaaagtcttcaaatctaagttgatagttttcacatatgagttgaaagttttcaacgagggaaggggaaagagattggataaagtgtgcgctacttttcttgtcatcatgtatgcactaaataggatgggcgagcaaatcgtgaataggaggtggggctaggaggagaggttgtggttgccgtcgtcgttgtcactccggtgtgaccggcaactacctctctctggtttgtatctagtgatgtaccaatgtgagggagggggaaattcaatggtgtattgtaaatgtagaaaacctggcgtcgggtaagttcataaaacttaccgagtggatgctgggtataccaaaggtaaggttataccagagttcacaatcttctttgttttcttgtcggtctgaccgccaagaaaaaaacttttcctcatggctagcagccaagaaaattagatttcccttactctctagacttggtggttcgccaacaaaatatatcgccttggcggtttttttttaacgactcgcacgagacggtgcgaagttctattgatagagcaggaaaaaaaattacaagattgcaaccctggagggtcgtaaccagaaaaaaagaaaaaatataggttttgatgttatccttggcggttttagctgccaagaaaattcaggtttcttatagtgtacgtaggtaaggtttaatcgagatgcatattttagatccaatgatccacatgtttccaaattttcatataggtataggtctcaactacatatttgtctcgtttattacgattcgcaacacaagcaggcaggtactgaggtacatttgtgtctcgcttgttagtgcaaaaatgacaaattaagaaagtgcattaccacgctgatcatcaccatcatcatcatatagtgaaagaagaattgatgttaacccacccttggttttttaccttgtgaatcacccctagcctttggtcggacgggccaattaatttggatcgctactattgatatcaattaaattcttgatgagccgtactagctgtaggcctaatcttttgcattctggagacatcgttgtttaacttttttttctttttaaaactttggagagcatcctcagccgtgcatgtcattactttgcttatgctttgttgtattcgaaaaccctcgcttgagcaaaactctctttatgcccttcttctgcagcacagaatatgagcgcacgatatatgtacacgcactgtccatgctatcactgttctcaatttaatttgaagctagctaccgtgcctgcatcttgtcaatgtgatttcccctgaataatcccacaaaccgcaataggtgtgaaaaaaaatccccttcaattcctctctatagagattaaccgaacaagatctaattcaatttggagagaaagacttatctcaattatgtcgattcccggagagacaagattcaagcatagagctagttaggagagatatcagaaggccgcaacttatccttcaggtatatatatccgttcgtatatatataaatatagttgacataggattgtatgcttacatttcaataattaattgccagtaatgctttacttgcaaattaagtatagctaatagtgcatgcatgtattatgtgcatccttatctcctaaataagtaattaattaattaatactcttaagaaaaatgtccattctcaacatttaaaccatttccattttcttaagaaaaatgcatattcattcttctcaagctagaaaagtgagaaagatcaatctgcctattgatcttggaaaggtggtttagatctagcaaacttttgcagtacaatatgttgccactatatattggtagtatatatatgggtaaattaggaattttatagaaaattagaaagttgatgagttaatccggtttaattgggactcgttcatgcatgccaccgccaccgcttggtctcatttgtgcacctatgagagatgatggcacatgttgcgacgacatgattcctggccgattctaatcttaattgaaaatctaaaaagtttacaagtgactaattaccagtcaaataatgtaagttatatcatatatagcatatgtgtgtggaaggccttacacattttaaatcgtgctagctagctaggttaacacattcatacaacctgacgtgaaaccaaatttttttttatctagattagctactttctttttaacaaaaatgaccccgcggaataactgcaagaaagacaaattaacccttcaattttatactatgatctatataaatgaaatatcaaattaaatcgtttatactaattgtaccgtaaaagttctctagatctataacaatgtagggattaattgtattgcatataagaaatacaacattgcaaaaaatgtacggaggtgcacgtgcgcgatatataatcaattgagtaaaatatacggtcggttcttaaatttggaccgatatatgaataagaagaaatgaagaggcctgtgtccgtttgcagttttgtagttcaggtcaagcacaagatttaattttgtcacgcacgaggaattaattaatttcataagctcacccttaattagcgatcgaatgttatcacactgaaagtcaatttttttttattttaaactaaaaaaatgcccgtgcgttgcaacgaatgaaggcaatctttctatcatttatcttcttccatgatatatatataggcatttaaaattagagagtttatttttttgccatcaacaaccacctggttctacgaattgtcatcatcaaatgctagtatcatcacgagctccgttagcccttgtctaaataccaatttacccttgtaaactatagaacctcctctagttatgatagtttactcaaactgttccaattacaataaactctcttttattcattcataaccaaaaataaaatcagcatcatatttttcatcgattactgaatcaaccaaaacatatattatgacattaaaaaaaaaccaatttcaattattctacgatcacatcaggatacagattacaaaaaatggaggaaaaaaaataggactcttttcaaaaaataaaagaagtgggacagcagcgtccatatgtccattcagatttcagaccatttatagctccatacatgatatatacatatacaaaaacaacggctggtaagttgttcaatccttcaaccctttgttgtacgtgcttctctcagattgatactgctttgcaagtcgacataaaaaaaaacaactcaggagaactgatagaaccttggtctgaacaaatttaccaaaatatattccaagatgtttctgatttacaagaacaagtgactgaaaaccaaagcatatataaaagcacaaagaaagcatggattaattctatagaccgagctaaaataacgtaaggccttctatgcatattccatagaacaatagaagtaaataacaaaacctggttgataaaggagaaataaatcaacgatcacatagtcaataatctagttaagggggcaaggtcatcctcatctcatcagctcctactggttgaatctccttaaattatatccgtcgtcccgtccaattatttgattcctcaaaccgttaaaatacagcaaagggtgtgcatgcagatatgaagaaagaatccaataagggcctgtttagttcgcgaaaagaaaatttttggatgtcacatcggatgtttgaccggatgtcggaagaggttttcggacacgaatgaaaaaactaatttcataactcgtctggaaaccacgagacgaatcttttgagcataattaatctgtcattaacacgtgtgggttactgtagcacttatggctaatcatggactaattaggcttaaaaaattcatctcgcgatttccatacaaattgtgcaattagtttttttatctatatttaatgcaatttaagattcgagttgaaagtttcgaatctgggtttaaaattttaaaaatttgactttagatataaatttcattttcaattttttaattaaaaatatcctaactactaccatcatttatatctaactgtaattatactactaatagattactaacagccttagcgcggaaaaggagggtggccgcgtgcgcccctggcgcgcacgtgccgagtaggactcccccgagacgtgaacacaaaatcggacgcgccaatgacgtaccaaacaatactgcaaaatctttaaatcccgcgtcatacagggagggaatcggacaaaaaaaatcaagcgttatacgaggatgacgtactaaatacctggcaataacattttaatctattaactaactagagtaaaatacccgtgcgttgcaacatgtaaactaaaattataccaaatataaaatattatattattagggttgagttttccatgatatgggcctttaagaaaatatctttctagagaaataatgaaagttcaaaaaaaaagaagaaagaaaatgcctctttaaagtttagacccgctggtatgctagggcattcgcacgcgctgcccagcagtgttgcagcccggggagggaggccggcccgacgcgggatcaacctgagccgttcattttcatcgatggctcgaattgattctgatttcatcaaaaccgccaaccctaaccctaattcactatcccctttccttccccactgcgagccgcctcccccctctctctctcggtgccgcctctccccctccgccgctcctcctccccctccccggcggcatcgctccccctccacccaccgacggtgacgctccccctccacccacttgcggcgccgctccatctccctctcttcctcccgaccgtccttcccctcgccctctctctcgcctctcgtgcgatggatccggcaacagcgaccacgggtggatccaaccgtggtggtggcggtcgaggacggattcggtggcggtggctctgtccgacccctctcgcctccctctcgcggcagatctgacagcagtagcagcgtgtggcgacgcggccgggaacgccggtgaactgtaacatcccggcctagggcttaataggattaatagaatactcatatcaacaagttgcaacttcttttccggaagccaatctccaaagaactccagggttaagcgtgcttggcctggagcaatatgggatgggtgacctatgaaagctatcagatgtaagtgggcccggcctggaccgggaaattcttcctgggtgcacaagagtgaggacaaagtgtgctggagcaatatgggatgggtgacctatgaaagctatcagatgtaagtgggcccggcctggaccgggaaattcttcccgggtgcacaagagtgaggacaaagtgtgcagaaaagatatgtgttggtctgtgagggcagtctatgacctatgaaagctatcagatgtaagtgggcccggcctgggggaggcgggacgttacaaaatggtatcagagtcgactctcgcggtttcacgggcgcgtgtgtcgcagttgcgcaggcatggtgcgcatggctggtgtagaccgggagtggttacatagcatggcacatgccactggacacatggacgtggccaagagatgacgttcctggcctagggttgatcgacgggggcgtcgatctctcttaagggggtgagggtgtaacatcccggcctagggcttaataggattaatagaatactcatatcaacaagttgcaacttcttttccgaaagccaatctccaaagaactccagggttaagcgtgcttggcctggagcaatataagatgggtgaccgaccgggaaattcttcccgggtgcacacgagtgaggacaaagtgtgcagaaaagatatgtgttggtctgtgagggcagtctatgacctttgaaagctatcagatgtaagtgggcccggcctgggggaggcgggacgttacatgagctcgggagtgacgatgggctcgagagccggtcgcggcgaaaggcggcgatgcggacaacgttgaaagctatcagatgtaagtgggcccggcctgggggaggcgggacgttacatgaactcgggaatgacgatgggctcgagagccggtcgcggcgaaaggtggcgatgcggacaacggcaacgacgacgacggtggcggcgaccgcgaggagggcggctgcggggaggcggctagggttagggttaggctgaggaagacaatttataaataacttaaattcaaaataaaaaaacaaaatattgaaaacgaatttagagtccttatagaaatacaattagaaataacagattgggagttagaaatgtggaaatattagaagaggagtctacggtccacacacaaaggaatttatagaactaactgaaatttagaaataaaaaaaaataaaagtagagtttagagtccatatagaaatacaatttagaattacaaaaaatgaaaataaaaagctatctattatcttattaaagtaatagaaaaagaagccatcacgtttgctctcacgccctaaaaattcccatattaatcggagaaaaagaaaaagtagagtccatatagcaatacaatttaaaaatagctgaaatttagaattaaaaataaaaaatattgaaagagtagactagagtccatacaagtatacaatttagaattaattaaaattcggaattaaaaataggaaaactaaaagtagaagttagagttcatatagaaatgcaatttaaaattaactaaaattaaatattttttaaaaaagcaagattaggagaagagtatagagtctatataggaatatataggaatacagtttataaataacttaaatttaaaaaaaaacaacatatcaaaaaatgaatttagagtccatatataaatacaattagaaataacatactgagaattagaaaagtagaaatattggaggaggagtctacggtccagacacaggaatttagaaattactaaaagttagaaataaaaaataagaaaattaaaagtagagtttagagtccatataaaaatataatttagaattaaaaaaatcaaaattaaaactaaaacatattgggagaagagtctagcatccatataagaatactatttataaataactgaaattcgaaattaacaaataaggaatattgggaaaaaaattctagcgaccatataggaatacaatttagaaattactgaaattaaaaaaataaatattagaaaaagaagtctagagtcaatataggaatacaatttaccaataattgaaattcaaaattaaaaattaagaaatattgaaagaagagtttagagtccatatagaaatacaatttataaataactaaaattcagaattaataaaaatgaatattgaaagagtagtttagaatccatataggaatataatttatgaacaaaggaaattcgaaatttaaaaaaaaataagggatattaaaagatgattcttgagtccatatagaaatataatttataaataactatcacatatatacaatacaataaaaatatcacacatttgttagttcaaccaagaatttaaaattatgttgtcattttaatatattttaataataaaatgtgaaaatatttaagctattatatgagaaaaaaaatctaatgaggcaagccgcgggccaccatgctagctaacttattaaaggaatagaaaaaagagactccacgttcgctctcacggcctagaaattctcatattaatcggagaaaaaaaaacagagtccatatagaaatacaatttagaaataattgaaattcagaatcgaaaaataaggaatattggaggaggagactagagtcatatagaaatacaatttataaataactgaaattcggaattaaaaaataaagaatattagaagaagagtatagagtccatatagaaatacaattaggaaataatagaaattcagaattaaaataaagagtattagaagaagagtatagagtccatatagaaatataattaagaaataatagaaattcggaattaaaaataaggaatattagaagtagagtatagagtccacataggaatttaaaactaactaaaaatcagaataaacataataaaattaaaagtagagtttagagtccgtataaaaatacaatttacaaatagctaaaattcaaaattaaaaaaaacatgggaagaagagtctaaagttcatataggaatacaaattagaagtaactgaaattcgaaattaaaaattaaagaatattgaaagatgagtttagtccacatagaaatacaattagaaataataaaaatttagaattaaaaatgaataatattggaagaagagcctagagtctatatagaaatacaaatttacagataacaaaaattcagaattaaaaaaaaatattgaaagatgattctagagtccatataggaatataatttacaaataactaaaatttgatattaaaaataattaataactaacacgtatataaaatacaacataaataatacacattagtagtttcgtaaagttagtaaaaagtttaaaattatgttgtcattttaatatatttgtataatacattgagaaaacatatatcctattatataagaaaaatataatgatgctagcgcgcaatctacgcgggtcaccatgctagtttttataataggcaaagatagtcaatctagtctctcaagttttatccaaggcaatttgatccttgaggttttattagcattctcaaattaattagttggatctcaccttgctaaaaaaacttacgaatggaaaagtgtgcacacatacgtacgtacatacaaattatgtgtgtaaattcatgatttgtttgtgtgaatcaactcatatgtaataactaattactgtatgcaaaaaatggacgatcatatgcagggcgggtgcaggctagctagatagatagaagagatggagcaacatgtggaacggaatgcatcaagcgcacaccacctgagagatgtgtggctgagcattggagggacggtggtccgcattgaggtgatggcaatggtggccatctttctcaccttctacgccgtcaccttcggatcctgccgccgctggtctagccgatggatcatccaaaaggttttcctggctgcgaatgcgctgtctgtgtccctaggaacatacagcatagggctgatgcagtcatcgctggtgaagagcaagatgtaccctgtgtggtcggtgtcattgcttgccctctttgctagcattgactccatcaacacattcggcctcgactatagtggccaattcctgaagctgttgtatcagctcttcctctactttgggtatgtgcttgtgatcagcatctccggcaataccaataatggcatggtggccgctgcgattggcatgctttgcagcgtcaccctatgtaagggattccataggctgatggcctatgtgctcccgaccaggctgcggagcatgaacaaagagattgcagatcgtatggaagtggtgaagggggggccaaactttaacgcggccatcatgcaagggtatcaatacctggttgataagacttattatccatccataaccctggaagaattgtggaagcctgacaatggcatggacaaactaggaacagatgctgatgcctacaaggacatatgcctctctttctccctctgtcacctgctacagcgacgcttctttggttttagttgtgctgagtctgaccggccagagacccgtagctttgtgttggaaggcttgcttcaacctgtagcttcaagtagttcatcatcacaaggtactggtggttctcgtggtaactacgagagggccttcaaggtgattgaggttgagctagccttcatgtacgactacatctacagcagcaacgccttcgtccattactatgaagctggagcttgcaccgcctgggcaatagcttcaatcctgaccacatgttttctatgtgtggctgttgccctacagcaaaaagaagccattattgcatcatctgcggtcactatgttggactcggaggtaattagcacaacgatgacaccagacattgtcatcacccttgtcatactggtgtcccttgcttccctccaagtgttgcagctggtgaactccttgtcgtccaattgggcaagagtctcccttgtctgtcatcttttcaggagaaatgccaacaacctggagccatcgatgggcttgaagctgaggttgttcctttccaggatcaaactattggacaaataccagtggcagaacaagcttgggcagtacgagagctcatcgtggctcaagaaagctctagggtttgtcagcttcaagataggacaatgttgctataagccagtgtttcatttcatgctctactgcgtgcggtgcatgatgcgatggccaaccatttgctgcccatgctatgtggtgtgctctccgctctgcaactgggtgttcaaattgcagcctagttggcagttgctcccaggcccttgttgggtgatatactccgccctctacaagttgtttggcctgcagtacattcaacaggtgctgacagacatgttgggcattagcactgcaagctccattcagctgcccattgaggtgaagagtaccgtgattgatgccctcgttgggatcctcatgcccaggcccaaccatgacagtgtcgtgttgtccagtggatcaacatcgctagccaagaatggcttgcaggacaagttcataaggcagtacgcttcgacaagttaccatggcggtagcgctagtaccattatccccgaatcaaagggcaatcaagccagcatcatcttgacctggcacgctgcgacaggttgctacgacaaagactatgagcaaaggaagaagatgaaggctactacagaatcgccgctacagcacaggcagtatcgtgttgtggccaccgctctatccaagtactgcatgtacttggtagcttatgtgcctcagctgctgcccgggcagcagtcctacacaacatctgtctacaacgattttgtgcgctcgccgtcctacatcttgcagagtggtacccagctgaaagatgagctctgcgaggcggtggtggaagatgaactgaggtggaaggtgctagctgatttctgggtcgagatgttgctctacctcgcgccttctgacaatgtcacggctcacatcgagcaactcgcacaaggtggagagttcatcacccatctctgggctctcctcttccacgccggcatcctgtaccggccgtacaaggaggaggaggagccagctgcagccgggacagtgtgacgaataaccacttaattattaattatcttgtgtttagcagtttgtttccatactttttatgtttgtagatgcatgcaagatgctgatttgcctgcgggaatcccaaaaatattgcaaaaaggaaacggataattaagcaagtttgtagtctcttctgtccactctagcactagcactgaacactgatgagatgtagggatgaatcgtgctgcgtgtcgcccgcggagagggggtggcggacgctccgcgcgggagaccgacttttccgttttttttttctttttctgtgttttccgtttctgttcggttggctgttttttttttctgttcaaattggttttccctttttttttctcttctgtttttttcggttttttagatgtatgaatacaaattttgtattcgtacatatacaaagtttgtatacatgatgcaatttcttgttttttttatttttttaatacgtatatatataaagtttgtatatatcgtacacaaagttcgtatacatcgtatacaaagtttgtatatgtcctaaataaactttgtatacatcgcatataaacttgtatatatgtatatatttttatgcattaaaaaatatttataaatatatatacacacgtgtatatatatatatatatatatatatatatatatatatatatatatatatgtatgtatgtatgtatgtatgtatacgtatgcatatgtagtatatgcataagtatagtagatacagagaagagactagagggggggggcgaactgaccgtgcgcgtgccggggcgcgcggctgattgcgtatcagcgccacccatatatgtctactccaatccatcaaaaatctcacggatggtcgcctggtcggttttctcccacgatgatcagtttgttggagcacacacacacgccactgaaataattgcatgccaaagcagagtaacatcagagaagctcccggtttcagtttgcccctcctccacagccacatcatgggccttttactgttacaagcccatatgtatgtattgattgtttgcaaactcggcccaactagacgggccgcacattcctcaaattgccgttccggcccaactagaccgtgctgttggacaacatatggcaccggcaacaaagcgtttccgggagttttgaattatactagaaaaattacccgtgtattgctatggaaagctaaaattataataaacaattgagtagagttcaattttcatgatccaagtgctttaagaaaatatttttcatgttgcgtgcgaacacaatctcgtgtcaatgtctagacaccaggtttttttttcaaaacaatctatttcacattacaacgggtaaattattttatttgtacaagaccgtggcacaaaaaaattgaatacggacgtactgttacatacagacatgaccttagtggtgcgcaatcatttctcgcaaattgtgttcttcactcgagctgatcttgaagatgaaagcattgtggatattagagatggcggtgtaatcaaacatcgaaacggtacctcggatataggaaggttgttggttattgttgaactagatattcagaaggactagataagaatattggtaagggtttattgcaaagattattatacttaacttacaaagctcgcattcctcgcaacagtaaaatcataatcacaagccgatcagacaagattgcgaggttaggaaccacaccacctctcagattacagctccttccaaaagaagcttactggtacttcttcaaggtgtgcacatttgggagcatggatgcttcagagcatcctgaaattgcatccgtagccatggagctagcaatggagtctgaaaggagcttcatggttgccaatgtctttggtagattactgaggtcgaataccaacacgctttactggagattggttcttgcatccctaagagagttcaagaagaagattcgagttgttctgttaggaggtgctgatcagcctcaaggaagatttgatgcacttggatggaaatcccagatagcacctaactatagctacacgtatagctgtgagatacagaggccaatgtgtattgttagtagataaaccttgtgtgtttgcattttaaatttctgttatgcatgcgcgcgagctccggtttgtggaagccgtgcgaatagctgtcatgccgcgagaatagctcggcgtggcgctagcaacggggagtgcgcgcgtactgcggatccgtggggatggacacgatcaatccgcgacgtgggaacgtttctgaagcccatgtttctttctgttgcatacctatcccctgtattgctctgttcttcattttcggatcagctacagtgcgtttgcaaagtgttcgtccaggtgttcgcgtgtgttccactcgccgattcgttgggattttcctgacatgtatggtcgccaggaagaagaaaatgcagaggaatggcggctgaatggctgaccatcttaggaatttatctgatgcactctagtattgttacatgtaggaattgtgtctttatatgtaacctctaatatgtaaaactttttccgataaccaaagaaaatactccaggcctctacatcccaagtatacatagttgttctcttgtggtggagcctattcatccgagttaaggaattaggtatggtgctcacgtttaaggctattttttttaaagtagtaagtaaagtacccattgacagcaatgcgtctgtgataactttatcaattgtaatatatgttggcccaatatctgaaggtgcttatattgatatggtttgcgtgtgtacatgcatttgtaagcatcggcatttgaactgtactttttattaaaaaaaaaagtataacatatatagctagagctaatattcattttgcatcacattcaaagtgagttttttattatgaatggttattataattgttattttctggaaaaataatattatggttgttttaatgtattctagtactttctcttgatgataaaagaaacttgacataaaatgagtgtcaaagagaaaaaggcacaaacggactacttcctgcatcttaaaataaatcaatctaacataaaatgggagtttacttagtacatgaatatagacagatgtctatctgcattcattattatataggtatttccattctattttaggctcgcttattttgggattgggacggaaggagtagtagagaaagatgggaagcacactgtattgaagtgctagaagatatgattgaggtgagatcttgtagtggtaaaaagtaaattgcagtattggaagaatacacataaagtttagagtcaaaatgttgaacttttaaaaatctatagcgtttcaattctggaactgagaatatttatcttgtttttttctgaatgaaaccagcacaagattgtgcttattcattaaatatagcaggagaaaaatacagcccctaaggaaaaaaggaaagcaagaaccgggaaaagctgtacactattcaaagcgcggaatagttgaggtttgaggttgcggcctccttgtgctcatatatccaccagtttcgctccatccaaatttcccaaacaatgagaatatttatcttgtgaattacacatagcaagaaacaaatgtatttgtttaaaagaatcaagaaacaaacgtacaaaagatattttcagtaataaaattttttaaaaataaaacatgtaggtatgatgtgaccactggcatgactagtctattttggtcaaaaagcttgcaagagaaacatataaagtcaattgaccgacctacattgttgtttctagaaagcgcaacaaaaaactgcacatgaaaatcaaaattacccatccagtagttgactgattcctatacatggaaatcaactttccatataactaactgcattccaagtcattcttccaaatctggctacattaagacggctaattatttcatttaatttgtggcagtcatctgcgcaggggtatacaagactattacactacagcttcgttattcttggattaagataaaaattttaactcggtttgagttagtgcttccgaaattactaaacaatctagacattgcttgataatattagataaatttattttcaaatttaaatttattaatacttaattaattatgtgctaatagttttttttcattttatgtctggagtttgaacgggacaaattaggggcgtgttcggtaatcattcctttacgctgcagtgcttgtgttgtgcggctgcagctgcagaaaataccagccgaataggtcctaagacaccaaaatccagccctgcctaattggattgggcttatcaacacgccaggccttacacggcccattacattgtttggaatgcgtgaactctacttttttttaaaaaaaagaaagaaaaatgatgacaaacaattaattcacttctagcaggagcgtacattttttttaaaaataaacacaatgcaaacatagatgcttaagtgcatctccattctaagcatgatgatcgtacttctgaaaatggtaaaggaaaaatacaatcatccatggtcgtcgtggttttggcattcaccatggacaagagcaccctaaaatattaaatgtgagaggaaacgctattaataatattgttgtgtggtggaattatatatgttgtccataagtgcatttttagttggtactggtagaaagtagaagcggggccagacatgggtcaacttaggcttgagcctcaggcttgactcgaaaaactccatataaatcctttagaaattatatagacatttcaaaaatatataatctctaactaaagttgtcatatttagtcttacaaatattttttgggctccacaaagaccataagtaatactccatatttttatttttttacaaaagagacttatagtgaagaaaatagaaaagtaattaatgggccattcaatctttatcatccatccaaacatctaatccaatacctaaaaacccatcagatctttcaccaaaagatacccaacgcccatctaatccaaccgcacgtacgagagcactaattaacaagttttttttagcatgatcaataattggggtcatcacaacacaatgcacctagccatcaatacatgatggaacatctaaaggtaacacactccaattagacaaatcacattagccccatatcatggaattaattaaaaggcatggcactttgtttttactagtactaaactagaagctactactaccaaaaatgggaggtatgttggtgccaggtggaagacaggtgggcccccaccaacccctgcaaagggcaagcagacatgatgggcctcgaaagcgtagctccatgccagtttgtgggccaggcctcttcttcttcttcttcttcttcttcttcttctccattcgccggcaaaaagaagagaaggcgacttgcaatttcagctccaatccgaaatggagatggccaatcaagaaggttgtggtgggcccagcatgtggcccaaaaggcctaccaagattaagaaaagaagttgtaaaagaaaggaaggaaaaatgaaagagaaagagcttgttcactttgatgaaaaaaaaccttaccgaattttggtattaacttcctttcaaaaaaaaattttggtattaacaaaaaaaccttaccaacttgctaaaattttgacatgatttcttatatagttaccaaaatttggcagcaaactaaatgtagccacttttttggcaactttatcaaaatttggtaaggttgaaaatgacatcaaaatgaaaaggcccgaaatttactcaacagcaaggctaataaagaaaagaagagatttggtttctagagagagaaagagaaagatgtctccatgatctttgctctagatttctgttgtaatatgatctctcttttttaaaagggcaagggtgttggaaaatactagtgattcttttatttcctttttcttgcacttatcaagcagcctgccacgctgacctgagaactaccggaaaacaagtgttgtcaaaattgattgcttcctgcactaaatccatagagactttttaaggtccaacagtactttacggtactaaatcttggtcgttggatctggtccgatccaacggctggtagtgtttggtaccgcgaggtaccaaatatgtccctattgcggtacctctcgcgtagaagagaggtggaagagcaaaaatgtaactttgtgtgcgatagatgggaggaatagacgggcggaaccaattttgtcacattttacatcctcttctgcgttgccgtcgcgtttctcttccccccgccgccgatgtgttcctcttccgccccaccgccgccgtgttcttcttccgctgccgccatgttcctcctccggcgccgcgacttcgatctgggcccttgcgccgaagcgagatcgattgcggcgtgcagggttgtcccctctcttctctgggattcgtggtcctccgccagtcactgcctggattgatgccatcaacgccgccgccgctaccgccgcctagacgccaactccgccgctgccgggatcgaccgccgccgcctcctcctggacgtcaactcggccgccgctgggaacaacgacttggacgccaccaccgccgggaacgacaacttgaacgccgcatccacccttgctcatcttttttctcccgctcctacccatcccagattcaacggttagatatcgatgtgttttggtaccgagcagtaccagtaccgaccggtacaacctgctggactgtaaagacgctcaaatctataacttaaacatcgcgatcagagtctacttagtgagtggacaaacctgttgtcgcagacatatggccacatatataggtggcctttttatttttctctctttttctctattaccttaaaagagggagttttatatgtatccgctacctttccctatccacacgacgcacaacaataatattagattatattagattgtatgggacatgttttgttgtttcatagcaattcataggtagactaattaaatgaaaattaatatttattttttatatggcgcctgccacctggtgagggggagaaggcatgtgttgctttctttttttttttggttttgtctgaactgatgagactataatactcttcatttctatcactggaaatggggagcaatgctctcctagtttaaaaaatatatttttttaagataatggaaatgagttacatatctaacctctgtaagatagggacataaccatagtattcagttttctaataacttgtatagaaagtatttacatgaaaattgctgcgcaactataactatgcagactatatatgcatgcacttccggaaaaaagaacaaatatatgattgatacccatgtatacataatgcatatggtgaaaccgtgaggagtcaaagtactgtcaaacatcagtttctcaaattcctctgaaactgttgagccatctgaatacagaaagagggagagagaaaggacacacagtactaccactgataagggaaaacaaaacagtagattaacgaataagcactgctgatgcaacttctgcaatcatcatgtccagggagctaaaacgaccttactacccttgccactattggccgccatatatcaatcaatccttttctctcttttgtggaagaagaagaagaagattaagatgctggtgttgagtcgtgtggcttttgctactgatcagattgttcagttcggaattcagataagaaactcatctcaggatcagacaaacaatgggtgggtgccagttcagaaagagagaatatatacggcagcaagtcagcaaccatatgcagaaaagagcagcatgctaatgtctttacaggatgcgcataaaatcactctttttcagttcttttctagcctagtaaagattttatgccttggggacagatgagattattattgagatcagaacatcatgctaaggatctcatcttcttctttgagcatccgaaatataagtctaaataagctagattccatattttaggactagcacaaagcttagactatatattcctaggatttcacttctccatgccaagtaaaaagcacataatatatacctcaataatacatctaaaaaaaatatacctatccaacatagtaggatttttctgggcattttacaattctcccatatcagtccagatgttaaccattttttctcttgaattccttcatttcaagctacatgtgcatatataggggaattaatctccctgagttaattttgaagatagtattttgtagtaaaataaatattaagtaataagatatgactatgttcatggcatgatgcagagtttgagatatttttactccattatttatttttgaatgaaccgatatcggcatgtctatttcattaaatatagtaggaaaagaaaaagacatttacaggtgtaaatagaaaaaacatggttacactgtaatatttgccaaaggactaagatatatagaaaggtgactttaccattctttaaaaaagtatcaagatgtatcatattttctagcgtaaaatttagtgcttttggatactaggtaactcgaggttgtaaaatttaggtttctcaataaagaaccgtaaaatttatcaagatagaaactagtcgctttgcgccagccatgcatctttttactccattatttaggatgtcaattattaatagctaagggaatttcactacttgtgtgatgcattcgatctctccattaacaagatggatgtggacctttgatgcctatgcaaacaccatgattgagtgtgtccatcaagtagctagtcggttagctaggtcaatatcttcaagttaaacacgtacaaatcgatctatctagcttcatctctttctttctcttccacagtgtcaaagacaatgtgtcggcatggcagacagctaccgtccgacttgaaagccatatatattactaattgctttcttcttacttaattattctatcctaattaaagtaaagatcgagataataaacagattaaaactattgtcgagatggattatattccctccttgggtaatactattaacatgaaagagaaagagataattaacgatggagatatatatacatacggatacacttgagcatcaacaatataatgcaagttcatgggcaactactacatatatagctgactaataagagcaagttcaatactatagccaactactagctccaattcatctatagccaatctaatagctcattcatacaatagttatatactacactattaatacctagtcccacatgtcatagacacactgcgtcttggagtccgtgctacagctggctataaatctgtagcccgctgctcttttctctcctgatttatcttcttaaaatatgtttgcagctggcttatagcctgctattgtacctgctctaatagtttaaattatttggttttggaggagtgtgtgtttagctttcgttttcccgggacttttgctgcaacagattgcaagggcccccatgcttgaggctgacacgacggctgcaattggccaaattcgagtgtctctctcatggcgcacgcttattagctttgcattgttgcccactaattaattaatctgatccattacatgagtaaaaccaaattacaacttgtgttcaatttatccaagtcgatcgatcattgattaattaacggcttgttcgatcttcatcgatccattttaaatccgctagttgctaattattaataagtttcatatgcttaatatacttttacttagtgcgtgctttttgtttatttgtcttatatatacggagagagttcaagtcgttttcctcattgaagctattttgtatcaacttaaagttttttgtacattctaaatacaaagacatggaatgtaactgatcatcttttaatttaattcttacctaaaagtatctcaatcatcgtaggatacacacaacccccatttgatggaggcactcaacctaattaaaaacaaatcaagatgtatatatatactagaaactaatccatcaatctaccccccatcaagccctaattaacttgtcacttaattgccgttaccgatcaatcaatcaatacaaataaatccatcgtccatgcattgcaatgtattgcatccatatatctcgattgcgagtggctagctcgacgataaagttaattaactggtcgacgccatggcatggcccagcaggtctctcgatcaagatgttgaaatggaagttgaagggcaccatgaacacaataaataaaaatccccaatttgagatgctgaaagagacttcataattagcggtaactatgatagcggcacactatgtccatcgccgtagtttgtttttgacttttcagtgccctattcattaccgtcactatatactagtacgatttaatgatattcccggtgataagaataataaataaattgcatatgattgttaatatatactccctctgtcccataaaaaaaccaacctaatactggatgtgacatattttaatactacgaatctagacatacctctgtccaaattcgttgaactataatatgtcgcattcagtcctagatttttttttggacagagggagtatatgtcaattaacttatatgggaagctcgttgttttcatggatttccaccaaccaaactatttggtgagaaaatgatcattcctaacctcttaacataaatgtgtaagggttcgttttccttccttcctaccttcacctctagtggagatgacgtaatgccaaacatcggtgccttagggttcaaaatgaagagcaagagttagggatcatacataggtgcagattgatatatagtgagattgtatgataatggcactattgaagctatcgacgaggaagctaatagttggtaggctctacaagatctataagaatgagtggttttgaagcgacacctaatggtgccaacagctagacattgctaaataagatgacgaaagggagctagtaaatggaagatgcatgtttgtccgcaatgagagggccaacaccaatagtaattttgtcgaaaatgttcgagtggtttctaggagaggatatatataggtggtcgtggctagaagtaggagagggaatggctagaattgtatagggatggagtggcgggcttgaaccattcgataacacaaattcaatgccccaaaatttaatatagttctttgagaaaatcaaatagctgtaacataaaatccgatatatatatatattttttggtgcacgattaattgatcagttgtcgcagttttggcactattggaaactccaagtagaatggcatagctcacctccttattaaatgcatattactgtgcacaaacatgtggtttaattgtgcaaatcataacacacaccacctgcaacatgctgatggtcaagattctatttcatgtctcagatgattgtgcagttgcacaagtacaacacacctgttgctctgatggccctactaaaactcttgacactgttttgctacatgcatgtaaaacaaacagctgcaagattttaaaattagcttggaacattccatttccactagaacttcgtttacacaaaaggaggaaaaaaaacagaggaacatttcactaaagcatgcaaagacaaccaagatcacaccattaacacaaataattaagccaaacatatatttataaaagtccattggtatattccactgatgtaagtatgaacacatcattaattacaccctcacaaaaaaacagcgaaattacacaaggctcccctcgacaaccctgggccgtcggatgcgtgatctacggtagaattagcatcaaagctaaaactcccttgggtctacgaagatggaggttcccggcggcgccttgctccagtcgccgagcgcgccgtcgccgtagccgtcggccagccgcttgatgcaccagaggtcgtcggcgccgaggcgcggccagtgcggcacgccggcgcggagcggctcgcacgcgcccacctcggtggccaccacgcgcgccccgccgcgccgcgccacgttgtgggcgtgccggaacagcgcccgcgccatgcgcgccgccgcggggccgccgccgccgaggccgtagacgaagtggaggccgaacggctcgaacaggttcgggatggacgggatgcccagccacggcgcggcgcggtcggcggcgcgcgtcgcgcgggcggccgcgcgccacagccgcggcgcgccgcgcacctcgaggcggaacgcgtctttgcagttccacaggctggccaccgcccacgacgccggcggcgaggccaggaacccctccacgccgcgccaccgcgtcccgcgcggcacggccaggaacgtgccgagcgacagggcgttggagagcacggcgtcgatgtcccgcgggaagaactccacggagccgaggcggcggcggtacaacagctcggcctcgcgcgcgtcgaggcggacgacggcggcgcgccgcgacggcgcgaggtcgtggccgaacaccgggtgcacgagcaccgacggcgtgcggaacttggcgtagccgcaggcgccggtgaagaggcgcaccgagggctcgttgtcgcggtcggtggcaacgtaggcgtactcggcgcccatctcccggaaccactcctccatcctctccaccagcctcctcccgatccctcgccgccggtggcgcggcgagacccggaggccgagcaggtacgccaccttggagaagagctggctgcgcccgcacgccacggtcttgacgcagccgcgcacgacgccgacgatctccgtgccgagcgggccacccacagcctccgcgacctgaaaaccacattccaatacccgatccagcaccagtgtgaggtctcgcgatcaacaatggcggacaagcaacgccccccgacgagacgtacgagcatgaggtaggccggcgagtggcggacgcggcagagcgggtcgccgaggaggtcggtgaagaggcagagcttgccgccgctcggacccacctcgcaggcgcgctcaaccagttcgacgccgggacggtcgcggccgccgtcgaactcccgcaccaggaccacctcgccgccgtcctccggcaaacaagccaccgccatccttgctccgatcaatcaatcaatcaaatccccttcttcttcttgatcgatcgagcggtgcgttgcaatttatagcggcgatggagtggcgggagaggagaaggcgcgcgcgatcgatggagatggaggtagtggcgcgagtggaggagtgggggagtgataggatgggggccacgtccccactttcccgccatctgtacacctctctctctgtgtgctccgggtggggcccacaccccaagttaaactgccccttctgctgctccatgctaaaactggatcgacttgctaattatttgtgtgatttaacaatgattagtgttgttggagtactatcatttttggctcatcagattggaggagtaagagagagctagataatgtaagattcgatagatctttgtttgctgctgtccgatcttgtcatgattattagggtaattaattagttgtttggaaattatctcttttctattatcatactcggggggatttaggagaagttattttctttttctatcttaattatattgaatgacctcctctaatcattctcacataagttatctttttttctagaaatataggagtatatgacatgttgaaattttgtagccagtattttggataatctttttccttaaaaatgaaaatgtttcacatcttccaatagacacatgttctaaaagcccaataaaaagaacttttcaattagagccagaaaacctttcaaaacaataggaatacaaaagaaaaatgtatatatcacaataataagagactctcggttatcctctatgtcgtaatactatatatccaactaaatataaactcaccacatgagtacaaaattaaaaccgacggctaatgaagtcagtcaaacacaacagtgcatacaatgactaaattatttggttggttagtctcattctctataatcggctgttatatctaaacgtagtcttgtcgctcgtggagaaagaaaacacatcgctacttttaatattgtcgttgccaatcaaataggaaaatataataattaagacgaatgctttaaaaagcaacaagacgttgcagcggcgatcggtagctaacgcaaaacaaacatttggtctgagttatcttttttggaataataattaaaaaatggttcaaatatttggcctatgctaaataattacccatgttgtaaatgtcaaatagaaaactcttaaggttatgggagttaggaactatctttgacacaatattagaaacatttcaaaataaagaaaaagagagtatcataataattagaaactctcgatgatccaaattatccgactgaatataacctcaccacatagaagcaaaattacacagctatatgcatcacatgatgtagaggctgagatttttatttgactatcttaaatatattgagtacaaaattgcaactatatatggactaacgaagctagtccaacataacaatatatataggtactacatcgtcatttggtcggttaatattctaatcaagcaggtctcactccctataattctatattatatccgagcatatcctcatcgctcgtagagaaagaaaacacatcgatacttttaatgttaccgttgcccatcaaataggaacggataataattaagaggaacaattaaaaaagcaacgatgaggacgacgacgaggaccggcagctaaagcgaaacaagacattcggtcaatcggctgctaatttcctcctgtaggtcgatcgatcatggggaagaagagaactgtgcatcgaccatgacaacaaacctatctaatatcgatcgatcgatcgacaaaattatcggatttatttatactacacatggtggttcgccatttttctgttgatcacacctgcaggtgtagtgtgcacacgtcagcattcgatcgggtggccgcagcaaattaccccgctctctctgtccccttcttccggaagatctcgtccgtccgatcagcagcggacggcccggatgacttgatggagtgagtccgggtggggcccacaagggggtagtggtgggcccgcgagagagagagagcggcggctttggctgcgcggcgacagcggtggggcccaccggagtatcaacggtcgggaacgcgacgacgagagccacttgcggcggcgtacgtggcggcggcggccgccgtcgatttggccgccgtacgtcgccgtcgacgtacggacacgcgtagcgtagatccggcgcatttggcgccataaaattaaatctctctctctcggagagcagtagagagatgatggatatggatggatggattggtcgagaaattgaaacgatcgatatcgatggagttaatgattagtagtgttgatgacgatgattaaaggcgtactagtgattgatcgagatgatggatcgagtgtagtacgggtactggtactagtcaatgtgagagcaagtttaataatatcacccgctgttagctgcaatttctttccatgtcatctgtagccaacatacatactaatatatacaatagggttagctatgtatttatcctccttttactgtagcaaatgatatttaattgcgttgcgccaagcatctcctctcccgcgcaaaacggacgcacttttttcttggagtacgcatatcggcgggcgactatttagtcgccggcctgtactctctctcatctgcgctcccggccaagtcatcaacagaacttacgtggcttgtttatcgccggcttttctacccctattgaacctgctctgatgcaatgcaaaatggtgtgttatatcatttattaattgcaggaatatgatggagcaggacataacgtgtatactccctccgttaaaaaaaaagacacacctagatttccgtgtccagcgtttgatcgtctgtcttgtttggaaaaattataaaaaaaatttaaaaagacaagtcatacataaaatattaatcatgttttatcatctaccaacaataaaaatactaattataaaaggatttcatataagacggacagtcaaacattggagaaacccatagtttgtctttttgtaggacggaggatacgatcaatgaaaagacgctccatcaaacatactagtatacgtatacacgacacgacgggatcggcctgccctacatcattattttgctgctttctcaaatcattataaagacaacttttcatgatgaaaaagaaaatccattttactccactacactatttaaatgatcacttaatcacacttgaactatttttttctcagtttacccttaaactattaaatatggtttactttacatattaataatgtttctcttttcttgctcttcatatacgttgtattttaagtttattttttagagctatagatgacatcattattaaagttcaaaattattttcaaaattttcttggttgtttgcttcaactttgaaattttaatatttaaattaaccttaagtgctttcgaactacataaatagttagacaaatttacaaagatgttcagacataagttccgaatgcatatgcattctaccgaattttcagtgcaaaatatgatttgtacagagtgaaacaaaaaaaaagagaaatagtgttatgggagttaactgaaccgttttcaataccgataaatagtttaggggcttaagtgatttggtggaatagttcggaagagtaaaaataaactttttcctttcatagaactacatagtttcatttctaccagcgggccataaaaaaggttctacctatattttgctttctcaaatcattataaattaaagatggcttttcctgacacgtaggtttaatttctaacatcggaccataaaagaatgattttcgtagcggtgattatttttcttaagtagccatgaaaatttatgaaagggtcatcatgaaaccttatggacgacctctctctctctctctatatatatatatatatatatatatctcttttcttgcttatatagttggtacccactatatcatttattgctataaagtttacaccatgttgtgccacatcattgtttattatgagccgttggattgttctacgaatcctcagatcaacgatatcgctaagttgggccggtattggctcagctcccgttggactttttagcccagcccacatcacgcatgcttctactgtgatggaaaaaaaaaaccaaaacacatctgcatcatcagcgatgcttgcgagggagaaatttgtgatgaaccaggatgagtacggcatgggagtggggacgcgagcgtgcctgttgcatggtccctattggctttccccctcattggcccgattaattggatgtcactccatgtcttgccttagtttatgtctcttctttttccttggaaactgccttaaaaattcaccggatgaaatccgccacctttccctcttcccctctcattttgttaataaaaaaattgataatttattggaggatatacttttagtccaagtagagtgagaaaattttcaaatagatgagaatcgaatgtctctgggcgaccacatgcttctaacatagtgttggaataagaatttaaaaattatgcaactctaaatcttccatcactatcccaaatatgttacttgcatgcattatatttcatcttcactctaatactaagttagaagacatctttggtcttagggatatttttgtcttttaaacaaattcttatccaattaggttgaaaatgacctgtaacaaattatcttttttaggtgtcctttatccgcgacacttttttacaacgtctactagcaaattacataaacttaatttgatcatcctatagcaaaatttacctcactttacgcatgcctaaaataacttatatatgcttgtttgatcaaaaaaaagagtgagagacaaactagggagggaacgtacgtgttgtgccaaaagataatcattttccccaggccctagaaagctaattataagcttaactaatttcagcgtcaagtcggtcatgatcagtaccaatgattaattagccatcatatcaatatttagcgcagctagcgtaattcacataattaagctaataagatgtgtttgcctatcccttctaattaagctaacgtagtaatcatatatatgatccacgacatgtaggcccagttcttcccttgggattaatattttagctcatgaatgattaattatatcaggcatgg

SEQ ID NO: 75780 - DNA, 730 bp, Oryza sativa
ttagagctacacatttctagttttgtggttaagagacttcaaacaatctcgctgttaagttgagggacctccggcgaacttattccaaacagaaaacacgcatggcctgcttggcaaatgataacgaacaaatggcccagaaactttcacagttgcttggttgctgcttccgcttgtagcttccatcatatagatagtgagatgttatgatctcaacttaatgaaatgaatggattggccaattatattgtattgtatactgcatggttaccgtcacaaaagatgcgtgatccgctgatccgcatcatccagagttatataatgggagaccaaatggaccctgaacaggtaaaaggaagcatgtcgggagctgcacaatatttcttctctttcgttctcaagcgcaatacacatccgatttgtgctctaccacttacatcaatcatgcacacattcatacgcgaaaaggaaggaattgcttcgacgagcttgaacatgcctatattattctcgtcacacaaacacaaaagtcaatcatagcgccaccggaacaacgaggagccggataagatgacttcttcatcatttcataatagcaaacaggacgccagccaggcaacgtcaaagaaataaaaaacaggagcagacaatatcgtgcatgcatgtcactttcagttttggcaagcaggcaggcaagtattccagcctttcttatttctcttcgaccaca

SEQ ID NO: 75781 - DNA, 1225 bp, Oryza sativa
agcaggcggaggccgtggcggtggaggcgggacttgaagcaggcgatgaggaggtggttgcataggaagatgtgggaggaagcgaggaggaagccccgcttgaggagcgccgcgtggagggagacggcgaggcgggggtcggaggtggcggcgctgcgccggagtagggaggcgtaggagtagatgccggggatgatgggatcttgatgccgctggtgcgcggcggcgtggaacgcgcgcaacgtggtggaggcgagaaggcgaggacgcggcacgagagatggcgcgcgcatcgtggccgcgccgcagagtgctagctagttgcgtaattcttcaagggaagtcacaaggcggcggccgaattgcctgcgacagcagcgagggcgcgagtatacgccgatatgcgcgcgccgcgtctcggcgcgggcgggcacatcatgaagggattgggatcctctactttcaaagtgactatgtctttgtcacagatatgtgtgtccgatggttagtgtacatccgactcctatactaccatgactagctgtgaaaaaactggatctacatagaagtaagctgagcaatgtgattagtcttgagacgtgcgcatgggccgtacgtatagcacttctcttgataaaagcgcgtactttgaaggtagaggagtacgatctatggtgaagtggtttatggcaaaaatgcattgttagattgttaatgttaccggtacgtattttatggcaattggtgaaatgatcgatcaaaccaactctcatcggtgcacatatgccttcaattcaaatttcggtttgtgatggaatacatctttggcttgaacattttatcaaacatgcagtattttgcgtaggaatgtgcagtggagcgaaaccaatatctcgagtgcctatatacactgtgaaaattagtctaacacattaaaatatctgattagctagttgtttgttttcctttgtctttaagacagtagtttagagttgttctggagctatttttgtttgtttttttgtttttttgagggaacaccggggggaaggccccacctgaattggattgcccctttaaatcataagattgagaaaacgtaggaatagaaaaaacgtaggattttgatagaaatgtaagtgtaaaacagaggattgcaaaacgcatgataaacacaggaatgaccatctgattgaaccacgggaaaaacacaggaattgagaga

SEQ ID NO: 75782 - DNA, 1447 bp, Oryza sativa
agcataccatttgttcacattgattggttcacactagttttgcgcacgagtgagagtgggtggggagtgggtgatgggtggggggctttgaggaactgttcagcaacgaaaaagaaaatgcctcttttcggctcttcggtcctgtccatctgttgaatggtttgtgctcagcacatagagtatgggaagtaatgacactcaactacacttacaagggttcctttttttacccctgtttgtatctgccaaggtcggccattatgttaagaatgatatactttgaactgcaggtcataaatgtctcttccccaaatactcctggtcttcgcaaattacaaggtagaaaacagttgaaagatctcgtgaagaaggtcagtcatttccttgaagtgcatcctttgtttgtcttcatacaaactttgtttgacctatgctgcatgtacaggtgcaagctgcaagagacgagatgcaatgggctgaagatggtcctccaccattgcttgttaagatcgcaccggacttgtctaagcaagatcttgaggatattgctgcggtaacatagttaacttagccttgttttctgtgctcttccattattgagttgaaaattttcttatgctttctcattatgttctctaggttgctcttgctcttaggttggatggcctggtaagctatggaattcttccttattgattttactgacgttaactagcacactcctatttaacttccatgcccaatcattttacgcttctcttctggttttgtactgatgtttgtttattcttttattatgttgctaactgcacagattatatcaaacactactatttcaagaccttctcctgcagacacacatccattggctcaggaagctggtggactaagtggcaaacctttatttgacctatccactaatgttctcagggagatgtatatccttacccgggtatatttgttgcccctattgctttcttggatatatagtagcatacctctttgaattaacatgatttttctgtcattgtattttactccaatgtccatgaatgactcctgcatttctgttacagggaaagattcccctcataggctgtggtggtgtaagtaggtaatgtcagtctctgcatttgcttttttaaattaaaataccaacacccaatattcaatcaaagtttatttatgttattacagtggcgaggatgcatacaagaagatccgttctggagctacacttgttcagctttacactgcatttgcctatggtggcccagctcttatacccagaataaaggtcataagtgaaacatatttgttatatcccaagctcgcatcacatgctcactatctttgtcataatggactatatatacactgctagcctcttcttttcccttctattttttttttagagaaagaccatacggcccatcctatattgaag

SEQ ID NO: 75783 - DNA, 706 bp, Oryza sativa
acttttttttttgcgggtactatagtatacagttgtttatgagttgtatgcaagtttaggtacctacatcttatttaatttgctcttgatcgtcaactgtgtactcctacattctagaagtaaggcatgcatgattattttcctcactcagctaaataaagtgtacccctccgtatttgtaaaggaagtcgtttaggacaatgtttaagtcaaacattgggaatataaatcatgaataactctcaagttgttgagtttgaaaatgtaaaaattatatgaatagatttgtcttgaaaaatactttcataaaagtatacatatatcacttttcaataaatatttttatagaaacaagaagtcaaagttatgttttggagaccgtgtcgctgttctaaacgacttcctttacgagtacagatggagtactcgacagttaaacttgcttgaaaagctgttacagcttcaccttgtctatgccatgtctgcttgcttaaacttgactatggttctgttcactttgatgctatttttaaccttaccaaattttagtaaagttgttaaaaattagctatatttagggcatgttcactttgatgccaaaaaaaaaccttaccattttggcaatgccaaaattttggcaactataccaaaattttgataactcgccacaattttgacaggatttcttatataattatcaaaattt

SEQ ID NO: 75784 - DNA, 7881 bp, Oryza sativa
  unsure (1)..(7881): unsure at all n locations
gggcttttagaaatccagtggatatggatgtggatgcggatagtatgatgcggatgcggatatggtatctctaaaatccggcagatgtggattatccgacattttggtcggattatccgataggtcgtttgccaaataatccgaaattatcaacatatgcaaccactctatctattgtataaacataagttggtacatccaatgggctaattcatcaattaacatagtttttttagtctaaggcttttatcgtctcatatcacactcgcgtagctactccctccaggttgataatacttgtcgttttggacaaggacacggtctccaaaaagcaactttgacaattattttccattataatatgtatgaaagtgttaacaaatatatgattttattaaagtactttttaagactaatctatacaagtagtcaccatatttgaaagacaaatattttgaaaatgattcataatcaaagattataaagtttgacctcacccttatctaaaactacaagtattatcagcccggagggagtatattttatattatggacatcatgtatgttgtttagcacttaatcatataattattacgatgggtcatttattgattatagtattattgttccttgcattgctaactcgatgttgcattgattgcatatacacgtaacatcagataaatttaatccatttcccaaattggatcttggcctcaactgggggaccgcaccaaagatgtcatgtgtgttgaacaccatgcaccacaagaaaaatgctttgtagaaacatttttcgagtactatagacacacttttcaaattcctttacaatactgtggaggcattttaaaagtgcccaataagtgccttatggtgaattgtctctacaaacgaagatgcattttataaaatgtctataacatggtagaggcattttctagagacattaaattgtatcacaaccatatgaaaccaatgtaaaaatgagaataaaatagtttcccttgtttttgccaatccttgaactcatgacctgttaaacaaatcattcttatcttcaaggcattaaccaactcaaccccatgtcattcattgtatgtttgtgccttaacttacttatatatttagtcatttagtatatatttttattctaagaagtatctctacatagtttaaagtgtctcaagcaaatgtctttacatgttaagcacattttaaagtgccgaaagaatgcgtctacaagataaaatctaataaaatgtgctaaaaatatttctaaagtgtctctagagtaaaagttttctagacaatttttaaagtgtctctacactataaaactcctgatcttagaggcaatatgcaaaacacctctacaaaagtgtctttatataaggttttttgttgtagtgatggccaccagcgcaacctcttggcccttgccaccgccacttccagatgtcatcatcatcgtacatcatggccaccagcacagccttgacccttgtcgtcaccattgccaccgagaaggaggaattgggagtgtgttgaggttgcctgcttttcccccgtcagatctagataacaacctcatctcctgcacgcccatgatgaactggggctgccactccaaagaggggctcagtgactggtgctaccgtcaggagaggagctcgctatccatgattgctggtgtagccatggccctcgccgctgtcatcgacaaggaggagaaagtgagaggtcttcgaggttgttggctttgcccccaccagatttggatgttgagcttgcccacgacgatctcgggtcatcgctcttgacaagggctcaccgcctagggctaaggagaggacgacgatctcatctagaaaggagagagagggtgtggaaggtgacctcgacaagaaaagaaagaaaaaggaagggtgtggattgtaacatcttgtttgtgttactaaaaatgttgtaacactttttggcatgctaaacactggttacgtactactagatactcttgcagtaacatgacctataagaatacttattggttgtgttactggaaactacaataacacctctttagttatatatatagtagcataaactacaataacacttttttagttactgtatagtagcacatgcttagcccatccccaatccagaaactatcaagtagttttcatacttaccatgttatatagacactacataaaaactatgtatctaatggatggtgtctcaaaattaaattatcatccaatcatctctcttttctctccttttatccatctatccccttgttttcattcttggttcttgtgtagagatggtttcttcatctttttatctctcttctcattaactcttttgctatattagatttttgcttatgtgacaatgtatttaatactatgggcactatatgacatcgagggttggggatggccttatgttactacaacccagtcctagggtagagacccttaagccttaaagcaagtttaatagtatagctaactaaagctaacatatataatgggttaactataaggttcactctattttttccctctcctctctctttttttcactatgaatttaatataaatttcttggagtaagtgcatagctaatttctgcatgagatttcaagtttaatagtatagccaactactagctccaaatcatctatagccaatttaatagcccattaatacaatagtttcctacaaatatatactacaccaataatatatagtcctgtctcatacacacacaacgtttagaatccctgttacagttggctataaatctgttgcccgctttccttccttctcttctcttctctcctctatatgtgcttacagccgacttgtagcttgctattgtactcgctttgagagccaacactattcacttttctttatctttcccttccacataagtttatactagttggcttacggtaagtactataaaatatctttgtcggaggcgtagttggatatggctagaaaagagaatcgaggtggtccaaagtgaaaaaaaaagagagagtaaatttaactagtccaaagcgataatattgagaaagaagatgaaagaagatgaaagaaaaaggggattggagaaacaaataaaataaaatcatttggattagtatactagagatagtgtagatgtggtgtatcgtttatatcacctcttatcttacattacatatagaaaattagggattttttaagagtacctttgggtggatgttggctgtctatgagatgagatcgtacggaggagatcaatttgtactacagatggtagcaagtgtagtaggtgtagtaaaagggtaaatgtggaaaaggaattcgtgggactgtttaactttgcagttaatagagggtgtaatccgtaatttaatcacgggagcaagcctggcacttggcccagttggttcaggggcggatgctaggcttccgtcgagacgccgtcgtgatgtggaggccatagatcgctcccgccgccgccgtcctcttcatcgagcaaagcgtgagacacagaaatcaccgtgtcccatgccatcactggccgcccttgccttcctgcagtcgcgctcgcttgcgtctcccctgtgggctgcgaccagaaagctcctatgactctcctctcaaatactagatatcttaaagctcctagctttgccgcaaccagggcgatttggactccgtcaactaatcgtatcgtgacacgtatctgcaaacctagttgatccacgccattaatttttgcagaaaagcccttataattttggtatttacgattgagtccatcgaatcagagccgttcgatctcacccgtggacataatctgatcgttcgtctcctatctagatggttccgtccttacccagacgtggaatccacgatctctcgtctctccacgtcgcatcccaatccccatctcgcttctcgcttctttgaccggcggcgccgatgctcctccgccgcggcgccgcctcctcctcctcttccatggcctttccagcgccatcgttttacccgtcctccaacagtgcttccctaaagtgtacggtggtggctgcgctcgatggaggggctcaacggcggtttcaacatagccttgaggtcggggacctggcggcggcgtcggagcctctagcacaggggtttggcagcggcggctgctgctggaggtcccagcgatttaaggtcgctgcggctctcccaacagttttttggaggtcttcgacgtggtgacgacgcatcgagttcgacgggtcactgtcgccgctggcggttaggtgcgtgattagcagctccctgtgttttcccctttcatcaatgggcttgtgattcaagcgattacattgatttaaatgtggatttcgagtttctactgtctactgggtaggccaatggcatagaggaggattaggacgagaagaagctgtcctctctgttgcctctcctgtacagcccaacatactactatcatattgtctgtaggtgagtttttggagcaaataatgagttctctttgattgatttttttgcaaataggtgtgtgccaaacaggatcgctttgcactgaaaatttgttctatctcagagcaaacatggtgcctaatgaaatgatttatgtatgctgtcatgcagctagcacatgcagaagatagactggcaggatgaggtggtggtggttcttccccagacccgtcactgctctggttgcatttattaccttttgggttgttgtcctatgaattgagcctaattagttgatattcaacagctggaggttatatttcctttttacattgcatcttcttggttgttcaacagcagtgatagcatttgttcccttagtgaaacagctatcttgttgtagcagtgatagcttttgttcccttagtgaaatagcttttggcaaattgtactatcttgttgtattggctagatgagtgtcctagatgtttaatatggcccgaggagtttgctaagatgtgtgacagaattcaaaatatatttcaatagaatttttgttgttacctctaaataaagaataatgttctaaatgataactatattatgttgaatcatctctaaagagttccttctgtttttgttcccactggttccatttacatggtcatgaagcagtttgcttgctggaccttttgcgtcgcttacatggctcctcccattatatctggcttttaggtaaagactattcatttctttgattgttggataactaagccagggtgatgtgaattgctgattgctgattccactgtatttaatacaaatttttcctatctttttaacagtgcttcagagggcaataaattcttctgagttcttccattgttacctgtttttagtttcagtaaaaaactaagctcttcaatgtaaatgggacaacaatttgaatagttactataagatcttttgggatcaaaagatttacttgttgcaggcttaactttcatttacattgcagaaacttatcattggtagataaggatgtgttaaaaggggcttgcttagtacaactcaaggcgaggctaatactatggtgggtatgaatttaaaattacaatatctgagttcaaattatttggtataagattgtagtttaagatgttgactgctaataattttaaagttgtaattgcatagctcactggccaaccacgtgctataatgaaatatttttttaaaaaaaaattgtaagcaagtactattaaattgaactctatgttgttttgcaaatcatcctaccatgtaatttatgatggttctcatgatcactaggccaagtagctctacaatgatgcactacaaagaatccttttacacaaattatttgtgggttttcagcatatgggtgaacagacggctagacttgccccatttttagagttcaacatttactagctttgtaaaatattagtgttgcttattaatgaaattattatatacccaaattaagagcaatcatttcatacttttatccatcgcatgagcttcttgtgctacttccttgccaacctctgattcatgttcttatgtagccattcagaacacgatagccatgacagccaggcaaaggcaacggaaaaaggtaagctgcaggaatttctctttttacctcaccattaaacatttgcctttcattgtttgtacctttttatgatatgccatttgcatgtctgatggccacagatggttctgaaattcaattatatttttgtgtaactttgcaaacagatcgccatatgcccatatattgccattctttgtaaatgacaggcgtagacatcaatcactcagtccagtaattgcataatagtagtatttccttgtttttatcttatcatgtgaaaaagtcccctataaaatttggctttctcactattattgctttgcagaattaacatggcaagttttgtacaggaactacatatgcttgcattgaagtttctttggggaaccaggagatgctttaatctttatctcgatgggtattgggtncctataggnntttgtctggatagggtcgatttctcacaaaattannatcctagggcactcnnccaatattacctnnacaacgagagtatnntncttaggatagggctacaacatgttacgntcttggttcggncttttgtcaactgacanaaatcantgaggatttctagatcgcctgctatattcatgtgatattatctataatttgatatatattaaatttatctgatctatacatgagtttatatatgcgacaccattacgaactgctactatagtctccccgtgttctcttcatacacatgaataaccatatatggtacaataaaagagaattgtagtttcacagcctctgtgcaagtagctttttaagtttaaatggtaaatatttagttttacctaagagaagtttaccaaaaaaaagttctttcaactgagatgcttatgatgtgtgcttgatgtcgccttagtcaatcttgataggcccaagatccccgctcaatcttcaaggaataggtttacttcatgataattcatgtctcatgttaatattgggagaggcaacccactatgctcagctcatggatcttcaggaatggagctgccagcatcttattgacaaacaaatacaaggtaaatatgcattggagatcctttctgtgatttgctctctgatgttctccttagagagaaagagaaaaaaaaaaggttaatccttcctattatttctttttattcattaattatatgtaattaccattttgaccaaaaaaacgagcactccatctgatcattttctaaaccatacaggaaaaatactccatgcacatcaacggttaatgcttttctatgagctggtcttaatatctctaggctgcactgtgttaggctggagcaccccggtccaattcttttgcctaccaaataaacttaccaacaccaagccagttgagtgctgcaatgtgcaaattaaacaatatggtctctgtagcctgctcagcaggaaaaccatttgaaatacctgtggaaatatccctaaacatgcattaaccatgatgatcatttttttttaaatactgtacggtaggtagatcgatatttgtcaacgccttagctatactagaatacgaggggcatctaagagaaaaatacaaatattgaaggctctcatggtagtttggtagctaattaatcacataggtgatgtatatttgtttctagcatttatatcagtccattgattcacagtggatactcagttattgcatttagatgtctcttttcaggaacctttatatttaagttcctttacatggctatt

SEQ ID NO: 75785 - DNA, 2856 bp, Oryza sativa
accccccctacccttctcattccgtatccctccctccctccttcagtcgctccccctccctccctcccgatcctctctctctctcttcccctccctcctcccgccctcccgatccccctcccgccttctctctcgatccccctcccgatctctctttctttttttcccttttttctgttttttttcttcctgaaacattttttctcttttctagaaaaataaaaaataaattgctaaattcaagacttgaacccatgaccttatagttcaaagcacattcttctaaccaattcatctaatgattctatttgtttcaagaattttgtgagaaagtaatatgattatcaattctaatatcttttactaccgaaactcataacatgttactatgctcgaatagtaatattgttataaaagtacagtaatacgtgacgttgttgtagaacacataggatattactgcacttttggcagtaacgtcgtagtaaaattgtagtagatcaggaatcgaaacaaaaatatatgggttataaccatatacttgttactgcacaaaagttgaagtgttactacataataggtgcatgttaccactttcaagtagttatgttactgcacggtagttttactatgtcagttttacgagatgaagatcgaataggtgggctataggtaaagtctataggtggctttgagtgaggtctgattgatgtaggagtgttttgaacaattttatacatttggtaaaactatgttactgcgtatatatacccatgttactgtaaattacatattctgttactgcatatggagtgttaaagttcaaaaatgccaatatttgaaaagcaatatctcacaagatatgtattattttttaaaaccgttttcacaatgatgctatagtattactgcatgtggaggatagaacttgaaaatgcatctacatatttccctcctcaagaaaccgttcttcctccctcttcttaagaaaaccggtcttctccctctaatatagttttactgcatgcatgtatatgacgttactgcacttttgacagtaaatcaggaattgaaacaaaaaatatatgggttcaaagtctcatatactaactatatacttgttactgcacaaaagtaaaagtgttactgcacggcatatacacgttaccacctgacagttacacattaccgcatgtttatgcagtaacactatccaagaactacagtaaagcactttgttactgtagaacatacagaacgttactgcatatttggcagtaacatcgtggtgaaattgtagtaaactagaaataaaaaaaaatatggattaaaacacacgagtaaaccgagccaattccccatattcttgtagtaatgttatcaagtaattgcagtaacacactatgttaatatgaaacttataatcattactacattttgtagtaacgacatgatgtgattgcagtaacgcaaaacatgcactagtaacacttttgatatactattattgtttgtggagagttaaaattttaaaaacaaatctttgaagggcaatatctctcatatcatgtactacttttaaaaaccgtttgcatcatgatgttcgaaaaaaagtgattatcaaaagtagatccatcatgactatattatgactgaatttcaattctgttactgcaagtaaaaacacggtgttactgcacgatgaacaagatgttactacgtcgttcccggacgagagctaagaagagagggggtggtggggaaagtcactgccggtttgaccgagatttgaccgacgtgggggacctttgactagcctttgactgaagtgggaggtgggttttgggcccttagaaggagatgaggtggtttagagggagggggggtatagaatagctattctatatccgggtgtagaatagtttatatatatataatgcacaaaattactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggctccatggctatccaccatccaaatgttttaagatccgtgcaacgcactagtggataacatattaatattagcgggtctaacccaataaaatattgcatgcacatactttacatatccatttttaaagtattgcgtgcatgtgtttgcaaatttagtatcctcaccaatcatgcgaggcactttccattttctatatccaatttttcgaaatattacgtgcaagtgtttccaaatttcgtgccctataatcatgcccaccaattataatgagcactttctattttctatcacattttccatacaatgtttgcatgcagatactacctattgaaacatgaaacatgattcttgaaaaatgatgacatctaatcatgtccgctaatttcaattattaccttccattttcatggttactttccattttctatatacatatataaccggcgacggtattccatattttgatttttcttggctacgctggtaggctcacggtcgaagagctatccaccaaacaccactgagctacctcgctgacgacatttgctcgcaagctctgtgatcttcatcgccacgctgtgaagagggcggacggccc

SEQ ID NO: 75786 - DNA, 915 bp, Oryza sativa
tttaaatagatggggtccctagagtggtgaagatggaccctagagtttttgaaatcaacccgcgcaagtgtggatttcagtttttttaagagtctcaaatttcaaggtatttgctgatagatccaggtcccagaacacatttacagtttgaaccttgcatgtttgaaacttttgctgagtgaaatccctgggtgctaatcatgagggtgaggtagaggctgggaacatagcattgccccgatgagtttctcgctggtgccgtcagggaaccatggctcagttgggagcgaccaaaagagaatttgtagaagggcctgcgacgaagctattattggttggcgcgatggctagggtggtcggaatgggtggtggcggcggtgcgagtggtgaagatcctcggggtggtgatgcatgtgaggctagagactgatttagcttaagagggtgcatgcatgtgggttcttgggtcctttgaaggctcaccgagcagttggggagaggtggcgaagcttggtcatcgatgtcggcttgcggaacatctcggtggcagcgcttcacttcgagatgttgggtcccaaaattaaagatttggtcttaactgatgcgtctaaactgtatcaagccctggattggtagattgatacaggttcaataatctggatcatcattgcatacatttgaacaaggctccaaaggagattttattacagaatataagggtatttacaaaactgtggctaattcctttgctagataacttaatcggctaggtctatacccactcgagaattgccgtcgtactcattcgttcttcacatgtacttggcaaaccctatgtcaatccaaaaagtactagcaacccggaaatctttctagcgtattgttccaatctaagttcattatattttatacaaa

SEQ ID NO: 75787 - DNA, 6762 bp, Oryza sativa
aatttaacttcaagcttttcatctggtagcaacacatgagtatattttcacaattacatcgcatagagtacaagataatacaattctgtgtcatgattcggatgtgttgtctgctcaattccactttttttaggtttatctactttaagaaaataaaaatttttccgttcatcacacaaatttcgatccgtcgtctcctgctcaaaagcaatcacgttgttcgctcatttgttcctcccatattctaaaactatcaggcctcgtgtcacaagcatcgtccacatcccgcaaaatataaggcagattaattgtccaagaacaaaaatgactttttggtcattatacacattgctgatgcctatgattatgcttgggtgtttcgataaataattgagatcaacttcagccacccatcattacccggtgcatcgcacaggcattttgctagtaaggaaaatactaaaatatactgtttatgggcccacatgttagttttctttttctctttcttctctcgtctttttcctctcaccttagtccatctcttccttctgccgagcaacataggggaggtatagaggagggcacctgtgctccggtggccggggattggtgacgtcggtggcggatgatgttcccgagcgacacgcatctagggagggtggtggctggtagagagagatggttggaaaggcgaggacaaagcttggtctggctaggagagaaacctccggtagggcttgatacgggatgaaagtgttgatgtgaaaacacgaggcctgggagatctgcttaactccagtgcaggtccaaaactcgcattcgggtatgttagcgtgccagttgatttgatcctgcaatcaacaagaaacaaagacaaagaaaccgcggttaaatccataaacgatagccgatcggctaggtgccgatgacatatcatttatctttgagccgatgtcatatatgcatcgatcagcaggcattaataaacaagacagaactaaatctactcgatcggctgtagatattaacgatatataatccttatatcgatatatacttaaatcaagtgattgggatatatcggtcgccatgccgagacaatataaatcacttagatcaaaatatatattaataatgagattatatatatttatagcgtagccgatcagatagatctagcatgtatcggctaatactccgataccactctatactaagatatcaaagcaagtaaaatatatcaaacaaaagcctaatatacttatatgcaacaagatcttaacataaagggcagatttaacatatcaacgaagcatataaggtaaatatagttaaatcaggtaagatcggctgaaaccctgatactaccctaatcggcaaccaagaagcaggctagagattgagattctaatcacgactcataagatcaaactcaactgatgcatcattaagtatgacaagaaggacaatatctagacaatcaagccgctgggagtttcatagagtggtagatatcttatataatctaaatcaacgtcaaaatctaacctaatcggctgccctctactaatagatgttagccgattgtaggttagatagcgatattgccagagattatgtaagatatatgataactcgacgaattacataaacaagattagagtatcataaagatggaagcactaatcccgagaacgcaagccgccataacaagttttacctcttgttgaagatcgaaaccgatgcagctcaacccgaaagcaagaactcgttgaaacaaaacaaaagcaaaaagggtggcgatgcgccgagattgtattgaacgtgtgttagtttgattacatggggctcggggtctatttatacccgagattacaaaacatgtccatatcggacacgactcctatctctaacaaactctaagataccataagtctttgcggcagacttttgcccaagcatatctctaaggaaattacataaaacatcctaattaatagatacaattgccttctcaggactctatccatacgtggcaatcctcatgaagcacatcaacccaacccaacaacatatgccgtgtcatattgtcagattcggctcaatcggctaaccttgtccaactcggactctgccgatcttggcaacagccgattcggacattaaccgatcctctctctgtttccggagcaatctctatctcgaactccgcttcaattccatcttcttctccgatacttggattaccaaatttggttgttaacagaaagagaagggtaaaagtagaaaaatgggttcgtcggagtagagatatgctaatggtgcgaggctttggtgtgaggggagccggtggaggagattggcatggccggcatgggaaagagaagaaagctcaaagagctcagttgtggataaaatatggggagctcgtgtcttatataggcggcggctaatggcggtttggaggagaagggcgacgaggacatgatagcgattggcgccgactcttgtccgtgattggctggcctgcccggccatggcggtttggcctggtggcaggcgtcggtgggagcagaacagcgggtggccggcagcacgcccatggcgcacggtggcggcacccactgggatgacgagcgtctgcctctactcggctaggctggctagctaggtcgacttgggccgaagggagacagggtggccggttagggttaggaaatgaagatgggccgagagaagagggaaaaggatttcggcccaaaggaattgttcgtgaatttgaataattttgatttgcataggatttgtatttgaagtgaatttgaataggagattttttaagggaatttatatttgggataattttcagaatgggtatttttcaactttatttgagtgcaacattttagaggtggaatttgagggaatttatttggaagcactcaaataagaaataggaatattttgcactatgagtagtagagctcctaatttggatatatttttgggaatgtggtagaaaatatatgaatgcagataaataggatttttcccccaaaaaataggtggcatggatttagagaaatattttgtggctaatatggatttagaaaaatttggagtttttggaagggatggattgaaagttattttcttaggacaagagctgaagagcaattattctaatatttataatattgctattcttgtgctggggagacttagtttctggaaattagaattggaggctagatcaaaataggagcttcacgaaagaatatatgatagaatattttagatggagaagaactaaggagtttcagcgatgggtctagatggagagtttgatcgaggattaattccagaaataattggcactgtgtcggtctagtttgaaaggtaatattagatgatttcttggaccataatcaataaagtaaaagaagttttcaaataaattgaataaagaaattttagtcgaaataaggtttaaaattcaaaaataaaatccaatctggaaatacctcaatttactaagatatatttttaaatgaaaaccacaaaaaaaattaaataccaaaaattttttgtgtaagttagttttaggaggttacctataattatattttcctaggtttaggaagttattaaaaaataagaatcaacatgatgcaggattagaaaatagttaattttcacgatgttacatgcgaacagcacgaacgggtcgacgatctgccaaagcgaggcatgtatgagggtggtgaggtcatagagacatcaaatgtacagggaatcaaacaatggctcaacggcatagacggaatcgatgatggaggtggcagccggtgacgaggaagacggtggctgatcaacgcatttacttgatctttggccgtggtccttggccaggacaatggatcaccggcatagactatcacgcccagaaattcacgaaccagaatttctgagctgaatgtgcattaaacccctgtccaggaccagcaagtgtacacaaacgataattgttgacatacagatccacgtcttacaagaatataaaagattacaaatgcagcggaaaaagtaaaagcgagctaagcctgaagacttgactcctgcagcgggcgactccattccacaggcaatccttgacagcagcaacaaaaccaacctcaacgagacagctccaactaggaagatcttcagctctggtgagggggaaaagagagcaagactgagtactacccactatactcagcaagtcataccggaagaggaggtatgatgcaggatatatccaagggaggctaaaggttcttttgcataaagctagcatttaaaagcagtagttgaaagcagtaaaacagttgtagtaattaatcaatattaaccaatcactgtccaacgctaccccacattgcaacaggcccaaccaatcacctgaactacaccagttcaattagctaactaggggtgagactaatcacggtgaatctggtcgaccgcccataaccgcgggcacggctattcgaatagttttactctgattagaggtgtacaactgtacccacaagacatgttcccgtgcgccgacatgccaccacgacataccggaaagaggccgtgacaggacccttcgcataaccccctctaaccgatcgcaccacaccacaaggttcgcccccgtcctcagcaggcaacgggcagcccccctctcgtgccacggtgaatccggaagccgatcaaccaaacaccccggccgacccaactccatcacgcccaccctaacctgggtacgtcggctagaggaaagctacacaacaagcccagccattgcccacgctggcttgtggtaagtacaataagttcttccagggcatcccgcgaaccggtccttaatcgccatgggcacgactagcaaaaccatgcacccacagcccaccatgtagtgtattttaattaactaacaccattgcggtggcactaatccaaagctatgccaataatcaaactctatgcattaatgtgttttcctcttttgtgtactagttgaactaagcatggctaagcatttcctaaaccaacatctaatcattttaatacccaagttatcaatggcatgaggtgaacaatatatggctgggtagtaggacccatcgcacatgatattgtaaaacaatgcaacatttaatagaaatgcgggacatttgtaaattgggaacaatatgatcaactgtaatgcatgacttgccttgttctcgcactgacgagatcacaacaacgtcttcgagggatcgcggatcgacaaaacggctgaaatctatgcgacaaacaaagcacacaagcaaaacaggctataagactactaaaaaaagaaaacaaaaccatttttaatggatttattctactttcacccctgctatcctagagaagtattcctgtcaaactcttcttgaccatggagcaacctctttttgagttgtctgctcctcggggcgaactctatgagccacctccttcatcggagtcaatttatacaactggctatgaaatttgtcctgaactaattagtatggttaggaaaaatcctttttctgtctttgatctagaaaatccctaccatcatctgtgagactttgaacaagtctgctcatgccttaagattcgtggcatgagacaagaaactatgtggtggaaattgttcccgttctctcttcaagagagagcaaagcaatggtacacctctaccgttggatgtgtaaacggtagctgggaaaagctgcgagaccaaccctgtccttacccgagtatgtgcttctccaacatttccatacgggtttggataaggagtctgcattccatctggacataaccgccggaggatcgttcatgcacaaaacaccttcagaaggaagaacaattttggatcgtattctagaaaatacttccttcatgacgcagtccaatgaaccccagcaggaggcatccgtgtccaagatagaggaacctctaatgatcgagccacccgctgaaccatccacttctgctagcttggttgatgagaaggttcctgagcagccgtccgtcgagaatgaagaaattcagactctagattgtgccgcaattatgtttagggacggttttgacgaagactacggcaataccctgaactattttagcaagaggaaaccacccgttcctttgtcacccccccgatcctatggaactcgggttactttgagaaactgttcgggagttgacatctgtaatgagcgatgaatggctaaggaaggcagagctttcatccgaagtaattcggataaataccgctccccgaatcattccttgccttccggaagggaacgacgtcggtattctctacagtccaactgtcggggccaacctcgtttctgagtcttttgcattcgcttatttaagcgataaggcagtgaccccgacaaacaaattcttcaacaaatggaaatatcatcgaaggatttgggattgtacaaaatgtacctgtctgctttaaagatagggaggtgatcttggatttccacgtctttgaaatccaagactttgacatcctaatcgggttgcccattgagcaacttcttatcaacacgcctcgattaggtagcctcaaaataacactaggagagaatgaattctcaattccattcttacgggcaaggatcacctttaccgaccctctcccagagattgagttagcggaagaggttaccgcagttcctc

SEQ ID NO: 75788 - DNA, 5337 bp, Oryza sativa
  unsure (1)..(5337): unsure at all n locations
taattataagtagctgataattccacattcaaggtctctcaggttgttatgatgctcaaatgtactctctctggtttttaatgtttgacgctattgacttttaaacacatgtttgatattttttcttgttcaaaagaaatatagaattatcatttattttgttgttatttgttacctcataactatggcttttttgtatatatgtatagtttttaaaataagacaagtggtaaaggtatgtttaaatgccaacaatgtcagccattaaaaactgaagggagaaacgtcctggggttttccggctagcttcacaaggtggtgggttagacgacctgngttcgaagcctcacccctcctaattatttgatattaggtccttccctaatacttgtgtttttcattaaaaaactgaatgagtaacanttttcagcttgggtggagacagaggattagcacaccacatcatgtcaactatcaagaagtcctatttatcatgtaccatactattggttcctgaaaacagttggcccatcttcacttttcagtcatggctggcacaatcactccatttctgcaataaaatgcagcttggagatcacttctaactaacttgctcttgatcgttgcagcgcaacatcagctctgtcacacgttgtgctggggcaattcaagaccatagtcataatgctctcaggttacctgatcttcagctcggatcctggaatcaccagcatctgcggagccatcgtcgctctcggtggcatgtccgtctacacctatctgggtctgaaagagtcgacgacaaccgggaagaaaccgcctttagcacagaagcccaaagctgctggggatggtgagaagcctggtttggagcatgaggattctgtatgagctgacgaggattattcatcctggttggtcgattgtactataagcatacttaggtgattctccaagagttgtacgccattgctgagtccattgtacatagaaacacttcatgattttacccttttacagttcttaaaaagttcaaaaacattgcctcacaattctcttcgtttcttttttcttgctgataagttccacagttgatgtcacgtaagatgaagaacatgtcagcatgtcacataggataggaaccacgtaggaggaaaccacgctctaaaccattcgggaaggtaaattggtccggttttaataattgacggagcatctatacccggttttgtagttcatgaacatgaattggactcggcctgcagattgagggagaatatatgaaccttttgccatattgtttttctaagttgaaacgggggacgcgtgcgaaactggcccattatttctttggatcaatatactcaagttttgggccggcctggcccatctagcaagcgaggtagttatagctctctcgccgagggcccgaggcccagcattaaaacgagcggctctttcccctctccgccctctctctctctctctctctctctctcccatggcgaagaagggcgcgccgcgcaggcagccgccgccgccgccgcctcggcaactggccgcggggaagaaggggaaggcctccccgaaggcggcgaagagggcggcgcccaagaagcagaggctgctcgagtcgtcctccgacgactccgagctggagcagcagcaggggcagcttcaggaggtggagtccgggtcagacctcgacgtcccctctgattccggcgccgaggagctctccgactcggacgacgcctcctttgagggaggagacagcggcgacgaggaggaggaggaagacgatgaggatggcgacgacgaccccctcgctgacgacttcctcgccggcagtgacgacgaaagtggtaatgcacggattactattgaatcgaattagctttaacaacgtgcttttcagccttttccccatcaagtcattcgattgtagcattcacgcgagctagtattgtaataatcgataatgggaatgcaatgctgtattgtacatctaggggaatatctattgatgattgtattgtgttttgtagacggaggagacgactctggtgtggactcagatgagtctgatgacttagaggcgaagtcgcgagcgattgatgaagagaaagagaaggcagaagaagaggctgaggaggagctcaagctcaatattagatcagaatctgatgagttccgattgcccacaaaggaggttgatttttccaccttcttttatgtcttcagttttacgtgccgctgaaggtccgcaagtgatgtgcacatatatcatagtttgtatgctctgcaggagttggaggaagaggcacttcgaccaccaaacctgccgaatcttaaaaggaggatatcagaaagtgtgttcatatatatattttgcattaccaagtttatgaattttttagatgaatcagagaaaactcaattgagatttggcataatattagtgagctaacaagatgtagctgttctcttgtgtaaactccaaggcacttcgaccaccaaacctgccgaatcttaaaaggaggatatcagaaagtgtgttcatatatatattttgcattatcaagtttatgaattttttagatgaatcagagaaaactcaattgagatttggcataatattagtgagctaacaagatgtagctgttctcttgtgtaaactccaagggcaaatttaagctttataactatggtcattttgcattgtgatagaagcattgaatatttccctttctgacttttctttctgcccattggtcttcccctctagttgtccgggtactctcaaactttagtaagctgaggcaaaaagatgtgccgcgaaaggattatgtcaatcagctgaagacagatataatgtcatactatggatacaatgattttctcgttgaagcatttattgaggtgagcttggtgccgtttgtttctttccattgagctgtgcgtttccccaactgcatcaggttataattagaaattattgtctgacatgcttattaaaatatgatcatggtttacctgctatgagttaacagtatacatatttttactgcgcagatgttcccagctgtggagcttgttgaactactggaatcttttgagaaaagaccgcctgaatgcttacgaacaaatacattgaaggtaactatttcagatctcctgatatgtatgtatgtggtgccatggaatacatgattctttatatgtgcttcagtcttttctttgcgttcttcatcgtccttacctgctttgttcatgatgttggcagacccggagaagggatcttgctgctgctcttataccaagaggatttaatctggatccgatagggaagtggtcaaaggtatgctttgttcgatcttctcctttactcaagtaatatatccaacatcccaaagcaactctcctggtataaatggcaggtaggccttgttgtatacgactccaccatttcagctggtgccactgttgaatatatggctgggcattacatggtaccttcttctccgatatcattgtgtgtagattatttcatttgctctccttccactaatgttggtattaaaaaatgtgactacagaaacaaggtgcaagttctttcttacctgtgatggctcttgctcctcaggagaaagagcgaattgttgatatggcgtaagatgttttcctttgtctcatacacttttggcaattgttcactatcatgacttctaagttattatgtgatccttttttttcaatgaacatgtaattgtaatatgccatgtatgtaatctagtcatgctgtcttgatataccactttgcttctgaatttgatgatacattcaactgaattaattaccttgaattcatggaattcatgtcctcgtttctgatcaggaactcattcttttcttgtttccagggctgccccaggtggcaagactacatatattggagctcttatgaagaatactggtcagtatgctgcctgtttttaaatacattttgttcctccattggagtaattttgttttgtgtggtttcttgccaattgaaatgcaaatatactgttttattcatttgtcatgcacaggaataatttatgcaaatgagttcaatgagaaaaggctgcatggacttttgggcaacatacatcgcatgggtgttaccaataccatagtttgtaattatgatggtaaagaggtgagcaaacagtacaaatattgttaacgtgctatctgatagccgaaacacaatcaactaattttatgcattaagaaagaatcttgatttgtggtatttgtcaagtacttagtataatgtaactacagtatattgttttgtacaaaacgataacagaatgaaaacacattataagtattgttacataatctctgaccaataatttttggtccattttaatcatggagaagataaatgtcaagtcctaataatttttggttgcttgaattgggtgcagcattttctcattgaaaacctattttgtgataacattctgtttatttcagctacctaaagttcttgggatgaattcggttgacagagttcttttggatgcaccctgcacaggcacaggggtaagcatcatatagttcgtataagctcctactcctgtcatattttctcatttatttaaacagatgcttactttttctgcagaccatttggaaggatccacaaattaaaacgtcgaagggcattgaggacatcagagactgtgcttttgtacaaaaggtgcatttcttgtatttctaggtcttgtttaaattgaacctacttaccatttggcatattcccacctaacaattctaaatgcaattcttcttatgttatcgaggaaaagaactgcattccactcacattattccaattttgattcttaaccaagtcacttgcttaaaacattattggttcgtcctcgtgttgagtttgttttttgggggtcatttctaagcaatttatattgtgcagttgtgctgattcttacatggaaataacatataaccccagaattgctatgttctgtttgctcatttttatggattatgtttacttaatctgtatttgctaagctatgtgattgtgttcaatcataatttggtcttttaagctacacaatttttgtttggtcagttttttctaaatcgagctgttattctatactggttgagtacctcaatcaccttgaaattggtatgtataccactatttactgtctaactgatgagttgttttacagcaattgctattagctgctattgatttggttgatgccaactccaaaactggaggttacattgttgggctgcaggaat

SEQ ID NO: 75789 - DNA, 5713 bp, Oryza sativa
gccgtgcacgtcgtcgtcgcagccaccccacgcggtcgtcgccgccgctgccccgcgcggtagccgccaccgctgcccccgcgggcctcccccctccctcctccggccagatctgggagggagggggaaggggagccgccgccgccgcctcgcgccgtactcgtcgccgctgtccacgccggcctccccctccctcctccggccagatctcgaagggaggggggaggggagccgccgccgccgccgccggccttccccctccctcctccggccagatcagggaggggagggagggaagggagccacgccgccccgccaccttccacgccgccccgtgccgtagccgccgtgggagaggccggccttggagaggtgaggtgaggagagggccggccgtgggtgagggaaggggtgaggttttgagacttagaaaaaatctagggctcctatccaagtctatttatattcaagtctattttcacaggcggaccactgaagtggcgcctgtgaaaatcacaggcgccgcttaggaggtccgcctgtgaaaatagatttttggactggcacattcaccccgatttatatttttgtaggcggtcatttggctctaaggtatgtccgcctgtgaaaataagacccccacgtcgagaaaaatgctttttctagtagtgcatcgcccttattcatatagatgctaataaatctagacacatattagcatctatatgaatgtgggcaatgctagaaagtcttacattataaaacggatggagtattaaatcagctatagatgatttggagccaatatttggctatactgttaaacttgctcttattattagagagatttttttttgtttggggggtatataaaattatactccacttgtgtatcgtgtattcattcattcatgtagttgttttaatttacacatttatatatatgtgcttcccagcaacaaaagaggacactattaaatatgctaattcattgcttgacctggccggcggatgacatggaggtagttgacaacataatggcatatagtaaaagatttcaataaagaaattaataaaccatgcatggcatgcaatagtttgcatgatatataattctaatatatatataaactgtatagaatagtatgttggggaactctacttggcaagaatttagaaactaattttgtgacaaactgcatatagcataatataatttgctctaaaaagagcagcacttactttaatatgtttatagtagaaccatgacaatagtagtagtagcttttatccgtcacacattgaggtcttaaactagtagtagtagcttttatttatttggcacttgtcttaatttgatctgtttccatctgaaacttctcctgctcccagctgaaccagaattatataggacgactagcatatactctttgccggcccgttccggaacttggagagaaaaatgttttggaaacaaaatgagatcatgatgaataatctccggcagcaggcatcaacggcaccaaccgaggttgctgtagcacttccaaacaacatctccctcgattgcatcctgcccttccttttctgcccccttttgggggccaagtgaaaaaaaaggtcgcatcatggtgtggcatagaataatacttccttcgtcctaaaatgaagccatttttgatgttagcatgggtattaagaaagtaggtgagaatgattggagaaagtgtgtgattggttgaaaagagaaagtaggtgaagaagaatggttgtgattgattgagaggaggaggtaggtgaagaaatagcttcattttaggacaagacactgtgctaaaaatagctatattttaggacggagagagtagataagctagtcccgacccccctcctctcctctcttgccccgcctatataatccccaaacatcgctttctcttggagtaggagaagggtagtagtttaagctatagctctaaagacatcaccatgcaacattacttgcgttattactatacctatccaccacctacacattttgtcatctccctctctctttctctctgatctgtctcagatgtttatgcacatatacaagttaatagttctgtggatctagcaatcccggcttgtttgtttttgctgctttggtttgatgatagctagatatatcgagagggagatgaccagtaagcttggaagaggaagaaagagagctgctaggcttgttgcggtctttttgcttgggtaaaaagaggtattggcgtgcctcaatccgaaggcatggctgattacaggcacctcgaccgatctagcgcatgcagccatgtttcttggattgagccgcgtcaatatctctccttgcttccttacttcatgtactgtgtcatgctcaagcatatgtcccctctccgatcttcctacctcgtcgagttcgtcggatcagttcccaaattaaaggtgttatatatatatatatatatatatatatatatatagtaaatttgtttggtgctccatggtgcccgggcaccattgttgaaattgagtatatacccaattcaaatgagtatgaaactttttcaattacctaggtattaacattaactactttactaactagtttaaagcaagtttgaactgaatttgaacttgtttttgttagattttgattctaggtatatagcatccatacatataattagttaggtatgtaatcatgtattgtgaaataaagttaaatttgagttgttttgttgataagtataggtatgaatcaaattattataactaggtatatactcacaatttgaaaattttaaaaaatttgagtgattttgtgcattagataccatggtgcccgggcaccatggtgccccatatgagtgtcctatatatatatatatatatatatatatatatatatatatatatatatatatgcttcatcttttctggggttcacgagtcacacagactagctgctttagaagtagtactatgtattgtgcatgatgttcacagttaaatctgcaattttttccatgctggagtgtttttataggtttgcggaaggaattaagttgaatatatatagctatataattatatatatatttatcttgcgatcctgagtcttctgacattttccatccaagttgtaggtctgatgcatggcttatttcaagatgtagtttctggtttgcttactaataacatctcttcaggtattcattaattaggaactactatactttacctactggaaggaggatgttgtttaaatctataaatttgtgctggttgcatcctcaacaataagttacactgtatctctctgaaccaagtacttcctctagcagataatatatgaagttagattttttttttcaaggtccaatgcatggcttaaatcataattttatattagataaatattataagatctaataagtttatgagattacaacagtacttattggtgacggtcaaaatttgaaaaaaatcttattacaaatgttaaattaatatttgtgaccggtgggagcatgtatctatcttaattattgttttgggatgcttttattatatttttctgcataataaaatattttttgagctcttttcattctaatccccccctccccccccccaacctgtgtgtgctcctaaaaagattgttccctcttatgataagtaatactccattatttcaaaattaaactaacgtatgccatgtaaaggaaaatagagggattatatatacggttatgcttctaacttcacacaagtttataactatactagttaggcacttcgtagtagctcacacataattagacgggaagatcttggatgaattgtattgttatggctgtagatttgcatttaacatcgttctgcatattaaaaacccaactgttctgaatgttgggtaatttagagctcatctattataagctatgggcttaattatgacaagttggcatatattaactatgaactattaaaacataaaaaaaaatctgtaactgatagtctatactgaagtagaacaaaataattacaattttcaattttataaaattattaaaacaagaaaaatgatgtaattgggaccccaaaaccgcgtacaactacgtattattaacaatttttttattaaataatgccaactctataattgagtctccaaacacgaaacaattcaatttttattaatttcaaattttagactcctcgaagcccttgtagagcaaaagagctgcacgttaactcctcacactacttaaaaaaccatttttccaaacggtcggttcctatttttgcgtgtggttgagccgctcatctgccctaaaatgtctgcaaaaatcgctattttttcatgcaggtggcgcaaccgcatgcggtaatttgattttcgcgtgtgggtgcttatgtcgtcctcacgcaaaaacaaaaaaccaaaaaaaaacaaaaatctcaaaaatcaaaacatcttgccgtcgacgctcgttgtcgtcggtgctgccgcccgccgtcactgtcgccgagtatgtgtggggttaggctcctctcgtcgtcactgccagatccgtgcggagccaggtgagggacagcccccgccgagcccgtcgcctgctgtcgagccgatcgtcgtccactgccgcaagctatcgccatcaccgagttcgcgtggggccccgctccttccaccgccgctggatccgtgcgaggctaggtgggggacagccaccgtcgccaaatccgagtgggcgatgacaccaccgagcccgggcgtcgcccgctaccgagccaccagccgctacccactaccgagtcgtcgccgccgctttggaatgagagaggggaggaatgagaaatgagagagagagagagaggaggtgtgaatgagggagaggaggttggagaggaggggagataataagggacttggaaaaaattgtagtgttgagagggaaaagaaggcaagttagaattctagcggatccccttaagaggcctgcccaccaaaatatattttctcatgcggtcctttaaaagatccacatgtgaaaatatgctcatttttttatgtgagtaagttaagaggtccgcttgcgaaaattgatttttgcatacatgcattttaaggagccgtacatgacacggttaattatggtccacttgcaatttaaaggggtctcattcacaaaaatcatttgtatagtagtgtcactagctgtcgtcgttgataattcatgttttatttgtggtttctctcttttctatatatttaatatgctctatggagaactctttaattatgggaaaataagatcgatacttgaataaagatatatatagatagagagagtgagttttccattcttttaggttgacggaaggattgctatggtttttctagaactagcagaaagaccaaaatcgaaacgaatggacattagtatatacaatttggcttggtagtggtacgagttatctcttggtgtagcaagaaggaatttttttttatatttatatttatttttaaaaatatttaaaaaataaattaccattttaaagtttggcaaaaatatactcctcccgcccaccctaatagagggagagaagggcctaaatgtaaaattttctacaacacataagacgtagttttgtactaattgtaaaattctcatatgatgtcggatga

SEQ ID NO: 75790 - DNA, 3070 bp, Oryza sativa
gcaccccggcgctgccacccttggtgttgcagccacctcctgttccccaggctccccttcgtcgagcccaaaacaagctagaaaaccgttctcgccagtgaccagtggtgatgccatcgccttcctcctccggcaacctttcccgactcaccgaagcattgtcccgctgcatcgtcgtcgccgtcaattacgcctcgtcgatctcttccttgagcatgcctccatatcaagttattgtgtgtattcaattcctatgagcaattcagattacctttttttttatcttgttcttacttgtttatttgatttgcttgcagtcataaggttgatttgcaccagcaagatcaacaacccacggagtggtgtatcgatcgctaaggcacaacacaatagcgtctcgtacggttgtagtaagttctcccaaattagagttatcatcaactccccgaaagatcaggccaatcatagccgtgagtgtattgagtgcagctcagggtttatcaagacctcaggaacaccatcccctcctttgagcacgtcgttcgatgaagttgcgtcgccctcaccgactcgaagaatgttcttatctctgcttttaccatggaccatctcggggaacccagtccttggtgaactacctgttttacccatgggtctcgacaatcagttgctcggtcctttctctcctcgagcgctgatgtattacacataatttaatagtacaataatgattaaataatttggaagtctccatttaaattatagctaaattttggatggtcgtatcttggccatacgaggtccaaattgacccgtttaaattgcttaattttttataacttaaagggcccaaaaatgttatttttatgtaatgtgatcatttctttcttagagttttagtcttgttttgttattggtgtagttgctatcattttagaggttcccatctcgcaatttaggtccatcgtttgtggcagcagaaaactgttcgttgactaaggtcagtcacgctctccttgagcatattgaaacataatttgcgaaatgtattttgacttaaattattacattcgctttattaaatttgttgtgttataactattttgttgtcgagagatcgtagccgatgccccaacttgaaataagaactcgtcgaaaagtaaaagaaaagggtggcgatacgctgaaagttgtattgattggattgtctcccctattacaatggtctggggtttatatttttaccccgagtacaaaacttgtccattatggacacgactcaagctttcctaaagataaaatacaaacaagtccataccatggactcttaccatatctctaactcaaaccgatataaatatcctaattaatagatacaattgccttaaatgagctctatctctaaacgacaatgacggtcatctcaatcgaggcccaaaccgagcccaagtcaggctagtcggctacttgtcaaatcggctaaatcagactccaactctatttccaaccgatgcaatgcccaaccgatgcgtaatccatatttggaaagatccaatcttctttgattccccttcaattccaactcgaaatccgagtctatcttgccaaatttcgctgttaacacctgttggtatttcttaacaatattactagaaatatgaatgtctagcaatgacgctagaaatggtcctggtatatatatggtttacagaaaggatccacaagcgcacggatataccattgtagcatttcgcccgaaagtattataaaggtatcgtatttatttaatcccaaaggaagagtgtaagatagaactattctaataatatatatatatatatatatatatatatatatatatatatatatatatatatatatatatatatatatatatatatatatatatacatgccacttacataatcaaagtctaagtaggggttaagatatttatttgggtagagtgacacgaagcaaagcactcatatatctcatttaatcatttctaaactaagcataagaagaaatagaaaaacaatcatttcctataattctaatatacactcaattttagtctacatctgttagtatacaaccatatagccaatacccctaatagtgcactcctggtgcttcgagagaccaccccggattgccgagtttcttacgacaacctgtcatggccgtccatccgggggctaaatacggaggaataccctccccaggaaagttttttaggatcgtactgagctgtcaccatcagcggcccacctcgactgactcgtagcatataaacacagataatgatacctaataatctagacaccatgtgtacattataaatactacactatatccctcaagatgacatagagcaactgaataatcagacattaaacccacacaactgcacctctctggtaggctaactatacgactgtaccgatacagacataaagtaaagacaatacttagataaactaaagtatcgagagcatatgaagaagaatatttcattaattccaaaagtcttacaaaagaaaggaagaatgctattacaaccttaccgaaattcctccgaagactccgagaactccgagatgctattctattctactccacttagcactagaatactaaactaaagtgtagaagagatatttgagcttgcttgagtgtgttgagagagtgaatgagctcctccttttatagggttgttatgacggttgtagcctatgcgaaatgaccaatatgcctgcaaccatcattggggagcgatcaagagcgtccaggtgtaaggccagccagagccagcgtcaccagggttcgcagcaggcctccaaacttccctatgtggttgacaggtgggtccctatggcggttgtgacagttatgacggtttccgggacggttacacacgacaaagtgggcccatcttatccataggcttgcttaggagtgaggttttctcattttctctttattttatttgctcaattcctacactcaaataaagtccaagtacaagtggaaatagattattctaaaacaaaatatgcattgcaag

SEQ ID NO: 75791 - DNA, 621 bp, Oryza sativa
gcccaagcccgccgccgccactcccgagggcggagacgggtagatctgctgccgccgagccgccgccgcctcccctcccgctggatctggcggaggggagggcgccaccgttgccaccgtcgggccgccaccgcctcctctccctcagtcgggcctccagatctggtggacggaaggcgctcccaccatccgccgcttcctcctaccctcccgccatctacagccgttgcacctccacgccgtccgccgccaccatgcctcccttcccgcgcctcccctctcgcccttgccggatctggcgggatggcgccgccgcccctgccaggccggcgctggcgccgccgctacacgcagagatatggagaaagggagagagaagtcaagagaaatggagaaagagaaagaagacagccttatctcttccgagtgtgggccccgccgggagaagaaatatctcctccggctcggcttgggaaggtaggtgacggcttcgagtatatatagtggggacaactaacctcaaacggtttagggtttgaacccgtttgaggttagtaaacctcacctctgacgggccatccgattgcaactcgtcacaggtaactagtcacctgtgacgcg

SEQ ID NO: 75792 - DNA, 9152 bp, Oryza sativa
atttgacaatgtggtgctatagtaaacatttgctaataacggattaattaggttcaatagactcgtctcgcattttacaggcggaatctataatttattttgttattagtctacgtttaatacttcaaatgtatgtccgtacacgtcaaaattttttttgacaagtaactaaacatggcccttgtagaggccgtgtttagttgcaaaatttttcttcgaacttctaacttttccattacatcaaaacttttctatacacacaaacttctaacttttccatcacatcgttccaatttcaaccaaacttccaattttgtgtgaactaaacacacccagaggttcttctgcatgcgtatatactagactgacatgcgttgctatagcttcttctgcgtatatatatagcctttctttgatatatatgcctctttgtgtatagatcatatttttcaactaattagtcatcaatagtcgaccatatggtgagttttctgccaccaactcaatacggcgagaatgaattgtttctggtatatatggcgtctggtggtgtagagtcataggagcttttttttttaactagaatgagttcgcgcgctatgctgcgcggtattgtagcatgtaaggctataactcacagaaaaatgtttgtccaagaagattacataacaacaatactcaattcctcatgtacctacagcgtgataagaacaatatttaacctaaatagttctttttataaccaaagtccccagaagcagttccggatagatgataatttatacaacaatttcacgacgcatagtagggatggcaagcatagtatgattcatccaacatctatgggcacaagatgcagtttgttatgtaaaactaactgaaaatagtacatggttaagtttctcataatcttgtttgcgaggactgcagtattaaaatagtatctgtaaactctagcattggccaaaaactcagtcagatgaggcaatagtattgcattgatcaactatggtacgaaaaaccaactacatttcagattcattagttttaagtagggacttgactcttcactatgagaactttctactcaagaaacatatcccccttggcaattcagatcaccaaatgcaatacccagcatctgctaaaatcattcttaaagttaagagtttggagaattaactcagtatattagagatgttactaagtagaactcaaaagtttggagacttaagtcagcacatagagagatgttacaaaatcagtagaaggaactcaaattaatgaacagatcctcacttcagtctatgttatcctactaatcaaatcagcggactcttaaaatagccatgtaaaggaacttaaatataaaggttcctgaaaagagacatctaaatgcaataactgagtatccactgtgaatcaatggactgatataaatgctagaaacaaatatacatcacctatgtgattaattagctaccaaactaccatgagagccttcaatatttgtatttttctcttagatgcccctcgtattctagtatagctaaggcgttgacaaatatcgatctacctaccgtacagtatttaaaaaaaaatgatcatcatggttaatgcatgtttagggatatttccacaggtatttcaaatggttttcctgctgagcaggctacagagaccatattgtttaatttgcacattgcagcactcaactggcttggtgttggtaagtttatttggtaggcaaaagaattggaccggggtgctccagcctaacacagtgcagcctagagatattaagaccagctcatagaaaagcattaaccgttgatgtgcatggagtatttttcctgtatggtttagaaaatgatcagatggagtgctcgtttttttggtcaaaatggtaattacatataattaatgaataaaaagaaataataggaaggattaaccttttttttttctctttctctctaaggagaacatcagagagcaaatcacagaaaggatctccaatgcatatttaccttgtatttgtttgtcaataagatgctggcagctccattcctgaagatccatgagctgagcatagtgggttgcctctcccaatattaacatgagacatgaattatcatgaagtaaacctattccttgaagattgagcggggatcttgggcctatcaagattgactaaggcgacatcaagcacacatcataagcatctcagttgaaagaacttttttttggtaaacttctcttaaggtaaaactaaatatttaccatttaaacttaaaaagctacttgcacagaggctgtaaaactacaattctcttttattgtaccatatatgttattcatgtgtatgaagagaacacggggagactatagtagcagttcgtaatggtgtcgcatatataaactcatgtataatcagataaatttaatatatatcaaattatagataatatcacagaatatacacatctagaaatcctcatgattttgtattgacaaaaccgaaccaaactaacatgttgtacccatccaagaatacctcttgtaggtaaattgggagtgctaggattaattttgtagatcgactatccaacaaaccataggacaatacatcaataaagattaaagcatctcctggttccccaaagaaacttcaatgcaagcatatgtagttcctgtacaaaacttgccatgttaattctgcaaagcaataatagtgagaaagccaaattttataggggactttttcacatgataagataaaaacaaggaaatactactattatgcaattactggactgagtgattgatgtctacgcctgtcatttacaaagaatggcaatatatgggcatatggcgatctgtttgcaaagttacacaaaaatataattgaatttcagaaccatctgtggccatcagacatgcaaatggcatatcataaaaaggtacaaacaatgaaaggcaaatgtttaatggtgaggtaaaaagagaaattcctgcagcttacctttttccgttgcctttgcctggctgtcatggctatcgtgttctgaatggctacataagaacatgaatcagaggttggcaaggaagtagcacaagaagctcatgcgatggataaaagtatgaaatgattgctcttaatttgggtatataataatttcattaataagcaacactaatattttacaaagctagtaaatgttgaactctaaaaatggggcaagtctagccgtctgttcacccatatgctgaaaacccacaaataatttgtgtaaaaggattctttgtagtgcatcattgtagagctacttggcctagtgatcatgagaaccatcataaattacatggtaggatgatttgcaaaacaacatagagttcaatttaatagtacttgcttacaatttttttttaaaaaaatatttcattatagcacgtggttggccagtgagctatgcaattacaactttaaaattattagcagtcaacatcttaaactacaatcttataccaaataatttgaactcagatattgtaattttaaattcatacccaccatagtattagcctcgccttgagttgtactaagcaagccccttttaacacatccttatctaccaatgataagtttctgcaatgtaaatgaaagttaagcctgcaacaagtaaatcttttgatcccaaaagatcttatagtaactattcaaattgttgtcccatttacattgaagagcttagttttttactgaaactgaaaacaggtaacaatggaaaacttcagaagaattcattgccctctgaagcactgttaaaaagataggaaaaatttgtattaaatacagtagaatcagcaatcagcaattcacatcaccctggcttagttatccaacaatcaaagaaatgaatagtctttacctaaaagccagatataatgggaggagccatgtaagcgacgcaaaaggtccagcaagcaaactgcttcatgaccatgtaaatggaaccagtgggaacaaaaacagaaggaactctttagagatgattcaacataatatagttatcatttagaacattattcttttatttagaggtaacaacaaaaattctattgaaatatatttttgaattctgtcacacatcttagcaaactcctcgggccatattaaacatctaggacactcatctagccaatacaacaagatagtacaatttgccaaaagctatttcactaagggaacaaaagctatcactgctacaacaagatagctgtttcactaagggaacaaatgctatcactgctgttgaacaaccaagaagatgcaatgtaaaaaggaaatataacctccagctgttgaatatcaactaattaggctcaattcataggacaacaacccaaaaggtaataaatgcaaccagagcagtgacgggtctggggaagaaccaccaccacctcatcctgccagtctatcttctgcatgtgctagctgcatgacagcatacataaatcatttcattaggcaccatgtttgctctgagatagaacaaattttcagtgcaaagcgatcctgtttggcacacacctatttgcaaaaaaatcaatcaaagagaactcattatttgctccaaaaactcacctacagacaatatgatagtagtatgttgggctgtacaggagaggcaacagagaggacagcttcttctcgtcctaatcctcctctatgccattggcctacccagtagacagtagaaactcgaaatccacatttaaatcaatgtaatcgcttgaatcacaagcccattgatgaaaggggaaaacacagggagctgctaatcacgcacctaaccgccagcggcgacagtgacccgtcgaactcgatgcgtcgtcaccacgtcgaagacctccaaaaaactgttgggagagccgcagcgaccttaaatcgctgggacctccagcagcagccgccgctgccaaacccctgtgctagaggctccgacgccgccgccaggtccccgacctcaaggctatgttgaaaccgccgttgagcccctccatcgagcgcagccaccaccgtacactttagggaagcactgttggaggacgggtaaaacgatggcgctggaaaggccatggaagaggaggaggaggcggcgccgcggcggaggagcatcggcgccgccggtcaaagaagcgagaagcgagatggggattgggatgcgacgtggagagacgagagatcgtggattccacgtctgggtaaggacggaaccatctagataggagacgaacgatcagattatgtccacgggtgagatcgaacggctctgattcgatggactcaatcgtaaataccaaaattataagggcttttctgcaaaaattaatggcgtggatcaactaggtttgcagatacgtgtcacgatacgattagttgacggagtccaaatcgccctggttgcggcaaagctaggagctttaagatatctagtatttgagaggagagtcataggagctttctggtcgcagcccacaggggagacgcaagcgagcgcgactgcaggaaggcaagggcggccagtgatggcatgggacacggtgatttctgtgtctcacgctttgctcgatgaagaggacggcggcggcgggagcgatctatggcctccacatcacgacggcgtctcgacggaagcctagcatccgcccctgaaccaactgggccaagtgccaggcttgctcccgtgattaaattacggattacaccctctattaactgcaaagttaaacagtcccacgaattccttttccacatttacccttttactacacctactacacttgctaccatctgtagtacaaattgatctcctccgtacgatctcatctcatagacagccaacatccacccaaaggtactcttaaaaaatccctaattttctatatgtaatgtaagataagaggtgatataaacgatacaccacatctacactatctctagtatactaatccaaatgattttattttatttgtttctccaatcccctttttctttcatcttctttcatcttctttctcaatattatcgctttggactagttaaatttactctctctttttttttcactttggaccacctcgattctcttttctagccatatccaactacgcctccgacaaagatattttatagtacttaccgtaagccaactagtataaacttatgtggaagggaaagataaagaaaagtgaatagtgttggctctcaaagcgagtacaatagcaagctacaagtcggctgtaagcacatatagaggagagaagagaagagaaggaaggaaagcgggcaacagatttatagccaactgtaacagggattctaaacgttgtgtgtgtatgagacaggactatatattattggtgtagtatatatttgtaggaaactattgtattaatgggctattaaattggctatagatgatttggagctagtagttggctatactattaaacttgaaatctcatgcagaaattagctatgcacttactccaagaaatttatattaaattcatagtgaaaaaaagagagaggagagggaaaaaatagagtgaaccttatagttaacccattatatatgttagctttagttagctatactattaaacttgctttaaggcttaagggtctctaccctaggactgggttgtagtaacataaggccatccccaaccctcgatgtcatatagtgcccatagtattaaatacattgtcacataagcaaaaatctaatatagcaaaagagttaatgagaagagagataaaaagatgaagaaaccatctctacacaagaaccaagaatgaaaacaaggggatagatggataaaaggagagaaaagagagatgattggatgataatttaattttgagacaccatccattagatacatagtttttatgtagtgtctatataacatggtaagtatgaaaactacttgatagtttctggattggggatgggctaagcatgtgctactatacatataactaaaaaagtgttattgtagtttatgctactatatatataactaaagaggtgttattgtagtttccagtaacacaaccaataagtattcttataggtcatgttactgcaagagtatctagtagtacgtaaccagtgtttagcatgccaaaaagtgttacaacatttttagtaacacaaacaagatgttacaatccacacccttcctttttctttcttttcttgtcgaggtcaccttccacaccctctctctcctttctagatgagatcgtcgtcctctccttagccctaggcggtgagcccttgtcaagagcgatgacccgagatcgtcgtgggcaagctcaacatccaaatctggtgggggcaaagccaacaacctcgaagacctctcactttctcctccttgtcgatgacagcggcgagggccatggctacaccagcaatcatggatagcgagctcctctcctgacggtagcaccagtcactgagcccctctttggagtggcagccccagttcatcatgggcgtgcaggagatgaggttgttatctagatctgacgggggaaaagcaggcaacctcaacacactcccaattcctccttctcggtggcaatggtgacgacaagggtcaaggctgtgctggtggccatgatgtacgatgatgatgacatctggaagtggcggtggcaagggccaagaggttgcgctggtggccatcactacaacaaaaaaccttatataaagacacttttgtagaggtgttttgcatattgcctctaagatcaggagttttatagtgtagagacactttaaaaattgtctagaaaacttttactctagagacactttagaaatatttttagcacattttattagattttatcttgtagacgcattctttcggcactttaaaatgtgcttaacatgtaaagacatttgcttgagacactttaaactatgtagagatacttcttagaataaaaatatatactaaatgactaaatatataagtaagttaaggcacaaacatacaatgaatgacatggggttgagttggttaatgccttgaagataagaatgatttgtttaacaggtcatgagttcaaggattggcaaaaacaagggaaactattttattctcatttttacattggtttcatatggttgtgatacaatttaatgtctctagaaaatgcctctaccatgttatagacattttataaaatgcatcttcgtttgtagagacaattcaccataaggcacttattgggcacttttaaaatgcctccacagtattgtaaaggaatttgaaaagtgtgtctatagtactcgaaaaatgtttctacaaagcatttttcttgtggtgcatggtgttcaacacacatgacatctttggtgcggtcccccagttgaggccaagatccaatttgggaaatggattaaatttatctgatgttacgtgtatatgcaatcaatgcaacatcgagttagcaatgcaaggaacaataatactataatcaataaatgacccatcgtaataattatatgattaagtgctaaacaacatacatgatgtccataatataaaatatactccctccgggctgataatacttgtagttttagataagggtgaggtcaaactttataatctttgattatgaatcattttcaaaatatttgtctttcaaatatggtgactacttgtatagattagtcttaaaaagtactttaataaaatcatatatttgttaacactttcatacatattataatggaaaataattgtcaaagttgctttttggagaccgtgtccttgtccaaaacgacaagtattatcaacctggagggagtagctacgcgagtgtgatatgagacgataaaagccttagactaaaaaaactatgttaattgatgaattagcccattggatgtaccaacttatgttatatacaatagatagagtggttgcatatgttgataatttcggattatttggcaaacgacctatcggataatccgaccaaaatgtcggataatccacatctgccggattttagagataccatatccgcatccgcatcatactatccgcatccacat

SEQ ID NO: 75793 - DNA, 952 bp, Oryza sativa
attcctgcagccccatagctccaatatgatggcaatgctatggatttaaactaatagttttatgataacttcaatataaatagtagtttcgtgatattcggttttgtgataattttaacgttaaatatgtagttttatgacacataaattaaataagtatttttatgatagtttgatcaaaatattaatagttttgtgaaatttactcttaacaatattatatatgctattcaatagcaattgctgaccatacaaaaacataacacttaatttgcagtaaagaaattctctgattaattatacacagctgctaaattctctcctcacttcaatccaccgtgcaatacagctgtttttcaattcgcaacgacccccatcgctgaagatgaaagacaggtacgcatgtactattcttctactacaaatggagcttattgcagctttgtgggacagccaaacggtcagccccggcccggtggttgatctgaagatccattgcatttgcacctgacgcgctcacaacaatttgacaatttgaacctgatagtgcatgtctcaccaaactatatagtactatcaattttacatgcatgttcatcactgaattggagaaacatgcaatgaagagagatcgacatgacatatactagtacatactattccatatgcaactctagatctgaactcaacttgtgaaattgtggcctaaatagtctgtacttcagcagcacacaacactgttgaaactctctgagcttcgatctaggacaggcaaaattaattgaattagcagactggacacaccaatcaatcatcctatccaagtacatgcatcgtcgtcgtcgtcgtcgtcatcgtcatcaaccattgcagttgcagctagagagctgaatatatacacaagttgcagctctttccatgctctatcattctcaagttgggtttaactttt

SEQ ID NO: 75794 - DNA, 2299 bp, Oryza sativa
agctataagggcaagtttgataggaaaataccagcgatcaggcgcccgatcagcgccaaaaaaatcgggcgcccgccgcttcccacgctgtccccaccacacgccccaccatatgcaccgttgcaacaaattatccacatattatggaaatgatctattaagggaattcgtttctatttttgttccagcaacaatgtcagcaagtgtactcatgacgtttcactaagtatatatcaaatgttgcagtgaaattgaaacatcatttcgctatttgctgaaacattgtttttatatatggtgaaacaacacccgtttttttggaaaccgtttgttttatacgttgtagcaaaatattccatgaggtgatttggttgtgtttcaacttttcaaacgattgaaacattttcgatctacttagtgaaacaattctgatctacttgctgtaacagcgctcatttttttcaaacaaaaatcggacgcctgatttgtaggcacctcaagttttatagtaggggtagttaccacatctaattttgggccatttaccatacccccactgggtttggtagtagtgtataggggtgaaaacgatcggaaacggtcggaatcggtagcatctcttcggaagcgatgctcgatcggccggtgattgaccatatttattatttaaacaactcaatatcgacattaatatgatgtataaagaaattagaaaaagcaaaaatttaaaaatagccaaaaacgttacggtcggaaatggtaccccttaaacagaaatggcgcccagtcgatcggaaatttccgtaaccgttttacccctagtagtgtagtactaggaatcaactctaaccacccattgctatgggtattttagacttttaattgattgacgtggaggggcagtttagtctattccgatgatcccgagaggcaagacagccttgcatgttgactcgttcgattggcccaagcgtcctctgaaaaaacaagggatgcaagactgccgccgccgggccgcgctttctgccgtcgtcccctcgctctaatcggcgattccacatgcagcggcgaatcgacgtcctgtgcagcggcgcctcagtctggcgaccccgctgcgctcccaccggccactggccgtcttacacgaacccttgtgtgtgaagtcgccgcccctcttgcttttgattcagaaacgcggccgcctctgcatttgatccggaggaacgccccgtcgtcgtcgccgctgctaccttccagcacgagcacccgttaggatcttctagagctagattttctatttctcttctcgtttagttacttaactagtttaaggatttcctaattgctattaattagagaaagacaggatatttcgtggaggggatgcctgcaggtgatctgactcctatgtggttgtatttagcagcgttagtttaggctctagttttgagtttttggtttcacttgtatgtgcaatatgatgctgagaatcatatatattcttgaatgtattctaaagaaatgattttgtttaccttgttctttcaagtattcgagctaggagtgcttcctgatgtatttcatatataatcaggaattgtgcagaattgtgctgttgtgcgtgcatcgttgttgctaccgatggcgtggcagttgccgctgcataatttgcatgcaacttataatcagacttagttttactgcatatacatttgtatatgaaatcagtttctcttgctccatatacattaacaacactggatggcatacatacatacatacatacatggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatacttacaatttgaaaattttgaaaaatttgagtgatttgtgcattagataccatggtgccccatatatatatatatatatatatatatatatggattgtgctttcccacatgctcttattggttaagttgtacttgaggctatctactagacaggcctgcatttgtccaactttttcgtcacatcaaatgtttgaaatatgcatagagcattgggctgcag

SEQ ID NO: 75795 - DNA, 7013 bp, Oryza sativa
tgggctctcgtgccccacaagcacacctcctcgctctctctctctatttctatctctctctatctctttctctctctctctccaccatgaccacgagctccggcaacccctccccttcgaccggaggaaacgcagcaccccggcgctgccacccttggtgttgcagccacctcctgttccccaggctccccttcgtcgagcccaaaacaagctagaaaaccgttctcgccagtgaccagtggtgatgccatcgccttcctcctccggcaacctttcccgactcaccgaagcattgtcccgctgcatcgtcgtcgccgtcaattacgcctcgtcgatctcttccttgagcatgcctccatatcaagttattgtgtgtattcaattcctatgagcaattcagattacctttttttttatcttgttcttacttgtttatttgatttgcttgcagtcataaggttgatttgcaccagcaagatcaacaacccacggagtggtgtatcgatcgctaaggcacaacacaatagcgtctcgtacggttgtagtaagttctcccaaattagagttatcatcaactccccgaaagatcaggccaatcatagccgtgagtgtattgagtgcagctcagggtttatcaagacctcaggaacaccatcccctcctttgagcacgtcgttcgatgaagttgcgtcgccctcaccgactcgaagaatgttcttatctctgcttttaccatggaccatctcggggaacccagtccttggtgaactacctgttttacccatgggtctcgacaatcagttgctcggtcctttctctcctcgagcgctgatgtattacacataatttaatagtacaataatgattaaataatttggaagtctccatttaaattatagctaaattttggatggtcgtatcttggccatacgaggtccaaattgacccgtttaaattgcttaattttttataacttaaagggcccaaaaatgttatttttatgtaatgtgatcatttctttcttagagttttagtcttgttttgttattggtgtagttgctatcattttagaggttcccatctcgcaatttaggtccatcgtttgtggcagcagaaaactgttcgttgactaaggtcagtcacgctctccttgagcatattgaaacataatttgcgaaatgtattttgacttaaattattacattcgctttattaaatttgttgtgttataactattttgttgtcgagagatcgtagccgatgccccaacttgaaataagaactcgtcgaaaagtaaaagaaaagggtggcgatacgctgaaagttgtattgattggattgtctcccctattacaatggtctggggtttatatttttaccccgagtacaaaacttgtccattatggacacgactcaagctttcctaaagataaaatacaaacaagtccataccatggactcttaccatatctctaactcaaaccgatataaatatcctaattaatagatacaattgccttaaatgagctctatctctaaacgacaatgacggtcatctcaatcgaggcccaaaccgagcccaagtcaggctagtcggctacttgtcaaatcggtaaatcagactccaactctatttccaaccgatgcaatgcccaaccgatgcgtaatccatatttggaaagatccaatcttctttgattccccttcaattccaactcgaaatccgagtctatcttgccaaatttcgctgttaacacctgttggtatttcttaacaatattcctagaaatatgaatgtgtagcaatgacgttagaaatggtcttggtatatatatggtttacagaaaggatccacaagcgcacggatataccattgtagcatttcgcccgaaagtattatataggtatcgtatttatttaatcccaaaggaagagtgtagtatatatatatatatatatatatatatatatatatatatatatatatacatgccacttacataatcaaagtctaagtaggggttaagatatttatttgggtagagtgacacgaagcaaagcactcatatatctcatttaatcatttctaaactaagcataagaagaaatagaaaaacaatcatttcctataattctaatatacactcaattttagtctacatctgttagtatacaaccatatagccaatacccctaatagtgcactcctggtgcttcgagagaccaccccggattgccgagtttcttacgacaacctgtcatggccgtccatccgggggctaaatacggaggaataccctccccaggaaagttttttaggatcgtactgagctgtcaccatcagcggcccacctcgactgactcgtagcatataaacacagataatgatacctaataatctagacaccatgtgtacattataaatactacactatatccctcaagatgacatagagcaactgaataatcagacattaaacccacacaactgcacctctctggtaggctaactatacgactgtaccgatacagacataaagtaaagacaatacttagataaactaaagtatcgagagcatatgaagaagaatatttcattaattccaaaagtcttacaaaagaaaggaagaatgctattacaaccttaccgaaattcctccgaagactccgagaactccgagatgctattctattctactccacttagcactagaatactaaactaaagtgtagaagagatatttgagcttgcttgagtgtgttgagagagtgaatgagctcctccttttatagggttgttatgacggttgtagcctatgcgaaatgaccaatatgcctgcaaccatcattggggagcgatcaagagcgtccaggtgtaaggccagccagagccagcgtcaccagggttcgcagcaggcctccaaacttccctatgtggttgacaggtgggtccctatggcggttgtgacagttatgacggtttccgggacggttacacacgacaaagtgggcccatcttatccataggcttgcttaggagtgaggttttctcattttctctttattttatttgctcaattcctacactcaaataaagtccaagtacaagtggaaatagattattctaaaacaaaatatgcattgcaagcatagctagttctcctttattttagaaaattgatggtcaaaattggtttataatgaccgtcaacaacaccgaccttcaagcctctgctgcaaagcgcattccgtacaaccacctatctaatgggtaaggcttaatgcatcgattagtataataataaacaaaaaagatacgtatagaggcggatgaggtcctagtatgggaagaagatttacatacttccaagagttccctaggggatgtgatccaaattacattggtctaaaacaaaagaaagaaacgacaagacaacaatcttcctctttggtctccagctccgacacctactcccccgctcgaaggaggcaactttaacggttgcctccacaacagctacgcgcacaatggcttcactcggggacctcatcctgcacaacttccaagaaaaaggttcatgtcgcgggcgtgctacgatgccaggatatactcgaccaccttgaggacgccacctcatgtacatgagcaggcagcccgacaagccgttcttatggcggtcagctccatgatgcggtggctgattgagccaatgtccatggtagaacaacgcatgtgccctaggtaggcttagtgaagtgccaaagcatgacgcgtcgttttgcatcaagtactgaatcgacatgtttttcacaaaccacccaataatcaaagaccacgtctaatcatggcaaaccttctggaagccataagcggtttgaaggagggagaaattaaagcagagccctgtcacgtcacctgggggccgcaggtggcccacaccatgctgtgttcccttgcttccgaaggaagccccatggcagacctcggctcggtgacgaggccagggggctactgtcgaagaatactcggggcacattaggacccatcatggctactatgtgccctccatggagtgccacatgactaccccgaactccaaaggtatgacgcccgtgtgtgttagcctggaggtagccctgaggtaggaaggatgccctaaagatagtgtcagctccgacgttctttgaccggtagttaatgggctaggaccccgaggtcatcctcggggctagaggcctatatcagctacgccacaacaattaaggaggtatgacctgaccatacacgctcccttactgtgtcattctgcattaatgacaaatggtgtggctgctgtggagaattgtgggccgtcgtggacgatagggcgtacctccctccacttgccaatgccacccctggataagtggtgacagtgtggcttcgtactatgctacatgtctcgcccgccggttaatgaccccctagccagcctcaaaggctaacaaatgggcccaacgatgtccaggacacctaccttgatcatcctacaccatgcgtcagaaggaggagaaggtgttcgcatcaacggggcccctcaagatgggccaatgcaagatcaagattaccagttgctgatgtagaatcacgccgcaaaccttgagcacgttatatgcagcccacggtggcactcagagacacgccactgtagggagtgatagatgccactgaacgaacaactgggagggaccccgttagggtgaacatacatcggtttgtcctaggcttggcaggccagctaggacgtcctctaacaccatagatacgagagatgacgagcaattggggacttgaggagaatagacttgggataggtagcaaggagggagatgtagaatatagagggtttggatactaaattgaatttgacgatgattggttgtttcttcagtcgatcttagcccccttatatttataggaggggtggactcttcttaaggtctttcacatgtctaattaggcttaaaaatcaactaggtctcgataaatcctagtctaaaaaaggaaacacgagaaatatctaaattagactcgaaccttgtgctgaagatctgaccgctcagacatacggtctgaccgaccacattaagcggtcagacaaaccttcaccggaaagctccgatatttttcaaatttggttatcaacgtcaactcctatacattgggtcgtgcttgtttgtccaggcattggggtatccccttactattataaaataaggactaatgccaccaaaaagatgggttcgggacctaggacaagaggagaccacctctgttagccactgggaaaaagaccttgaagaacacccttaaaccaagtgatctaagcaagaacacaagagtagagtattacactcccaagtagcttaaacctatctaaaatgctattccactacacctgagctcaacacctgcaccattgctgaatctcaaagggagcgtatcgtgccttcccgctagaagggctcatgctccgacaccgaccatctattggggaaaaaaattggtgtagcatggatgcaaagcattacctttgcaaccctaccacagatggttgacacatggacattataacgatccaacgactttatctgctcggtaccaagcggtgggacgaggatgcgcggttccttggctcggctcccaggcccatcgactctctccacaatccccttcctcacgtgttctcctatgccttcctcatcttccattggacctactgcagcggcatggcctccccttgtggtgtcaactcgaacaagaatcccacccgcaagaaggaagcctaggccatgttcatgtacaccaccggagcctacaacgttctccaatttcttgtcacggtttattttgatcatatcatgcgatgggaatgatcttgatccatggatcatcagtacttagtgacattgagaacatgatggtgtataactagtacaagcaggaaagaagggctcaaaggggacgcactgctagtggtggcaatcacaatacgggtgccgacaccacagcgcgcaccaagaagtacgccgtttgggacatgggcagtggccacttcagcatgttctcccatgaccaaggtggtcgcactcctacgatggtggtgccactggcgtcgcagatggatctttgtttttttctaccacagatcctcgttttctgctatgtccatcttccttgtgacgccgggtgcttcttctgctgcgttgtccacaaaggtttctcttttcatggtggttgtagtcaccagcgatgtagtcgctagcgatttggtcatgcctgaaggcgagtcgtcccgttccacatctgcacaatccccttttgggagccgggccaaggcatgccatgtgcagccttgttggatagtgccaaacaaggcaagctgttggattggtatattatccacgcgtcggacatccgaagtggggctgcaggcaatgtggtttgcacccggactgcaccaattttttttccgatccattgcactctctttgtctctatagactcctcccctttctcgctgccaccacacttcctctccgtgcttactggtgtgacacttccatgcactcttctcgtatctcctaatcattctcctaggctctccatccccacaccacacaccacagcattttgtccatatttcagcccctcttttctcggtctactctaccatatatatctcccagtagtcccccacatacaccagatgcaagcatagcaccaaaagtacaagaactcctagcatcagatgcctccagtccatatatagccctttggagagcaaaaagggagaacaacccagacaaaagagacagccatgtactgcccttggccttaacccccaccaccacagcccctcactgcctttcacctgcaaaaaccacttgcaaccctcacaaaaccaaaaaacgccagcagccagcttccctcccccctccaattttagcaacttctcccttaaaatctcccc

SEQ ID NO: 75796 - DNA, 673 bp, Oryza sativa
tatggcaatcaacatcaagatgatgctctgcaattgaaataaattgttggtccattgggagatgacaacacgcatgatggaggcgcccattggtaaatagcatggaaaataacttttcagggggtaagttttcttgcttccatataattatcataagcttgcacagatcaaattgaagctcaaagcagccctgatatgtcacagtaaaagaacataactatgttgctaaaaggatagcaattgcatctcatccaaactaggtcgaaaaatctataatgaccttgcttaccttcattgccaacaaatcaaccaaagaacaaagaagtggtacaagattttctgatggctgctgagatatcataccaggagaatagtaaccaaaagttttgatctttgaccacaggccaaatacattctgagcgctatcaaagattacctattcagatgacaacgatgtaacaagcatgatcagaaaaagcaaaaggcagaagtatttattttgtttatatacttgctaaaacatctaggatctgttgtaattacctccgcaccaagattggcttcctgcgcacaatgtgcatgcaggcagtatgcaatagctaattgatggattgcaggtgcattgccttgagatgaatccagtgggatgtctcgctggtttgagaaagaaaaa

SEQ ID NO: 75797 - DNA, 568 bp, Oryza sativa
aaaggtgattcacaaagaggaaaaaacacaaggtcaaaggtagtttctccaaacagggcttaaagtagcttcctcatatagttcaattttaagaaacaaagcaaaaagtataagtaggggccacacataccttcaccttttctctcttaattatcctctcgcacaagagtcgcaatttttccaactcaacctgcaaaattgtaatgtaaatatttcatcagggattgagggatcatttaatcaatgttcaatgagaatggacatccttcagacatttcctcaaggattgtttgaagtacaaaaaagaaatacaaaaacaaatattacttatagaaatacaaaaaaaaattaacagggcctctagaagaaagaggaagtgagggaacacaggatttgatgcactggaagttagaaaccttagatagtaactgaacaaaaatattgtatcacagatcaaaataggaaaagtgaaatgcatcatatatacgaaccctcattcttttcatgttgttgaactcctcaagtccatactgttgcatatcagcctgcatcaatttcgaataacaaa

SEQ ID NO: 75798 - DNA, 3949 bp, Oryza sativa
  unsure (1)..(3949): unsure at all n locations
acgatatgctttcctacataatgacagagaggcccgtatcataatcagtgacaagctctctgaagacgagactcaacgtcttctcaccgtgttggagaagcatcgttctattcttggctgctcgcttcaatatcttagggggattaatctcgcgctttgcacccatcgtattcctattgaccccgagagtactccctccagggaacctcaacgacggctcaataatgcaatgcgagaggttgtaaagaaagaggtcttgaaactcctgcgtgccgggattatttatcccgtaccatacagtgagtgggttagcccagtccaggttctgccgaagaagggaggaatgacggtcgttgcaaaaaacaatggaggacggaggatgtgcatcgattacaggaaacttaacaaggctacaaaaaaggatcatttcccgctacccttcattgatgaaatgttggaacggctggcaaaccattccattttatgtttccttgatgggtattctaggtatcatcaaattcctatccatccggaggaccaaagtaagactacgttcacatgtccgtatggtacctatgcataccgtaggatgtccttcggactgtgtaacgctcctgcatctttccaaagatgtatgatgtctattttctcggacatgatcgaagacatcatggaagtcttcatggatgacttctcggtctatggaaagactttcggtcattgtctgcggaatttagacaaagtcttacaatgatgccaagaaaatgacctggtgcttaattgggaaaaatgccatttcatggtccgtgaagggatagttcttgggcatcgagtgtctgaacgaggaatcgaggttgatcgtgctaaaatcgatgttatagatcagcttcctcctcctatgaacatcaaaggaatccacagcttcatgggtcatgctggctttcatcaaggacttctctacaattgccagacctctgaccaatttgctagccaaggacgcgccctttgagttcgatgacgcgttcctaaaatcttttgaaattctcaaaaaggcactcatctccgctccaatcatttaacctcctgattgggctctgcgcttcaagatcatgtgtgatgcaagtgactttgctgttggtgcagtcttgggccaaaccaaagataaaaagcatcatgcaatctgttacgctagcaaaactctaaccggagctcagctgaattatgcaactactgaaaaagagcttctcgcggttgtttttgctatcgataagtttagatcttacttagtgggagccaaggtgataatttatactgatcatgctgctttgaaatacctgctcactaagagagatgctaaacctctcctcttaagatggattttgcaacttcaagaatttgacttagaaattaaaggtaaaaagggagtagaaaattccgtagcagatcatttgttcaggctacagctcactaacatgcaggaacaaccgataaatgatttcttaagagatgacatgctgacgacggttcgcgactccaacccgtggtttgccaacatagtaaactacatggtatccaagtacataccactaggggaaaatcaacaaaaactgaagtatgaaagtcgccgtcatatatgggatgagccatacctatatcgggtttgctccgatggcttactacgaagatgtgcgccaactgaagaaggacttaagatcatagaacaatgtcatgcctcaccctatggtggccattacggtgcattccgcacccaggccaaaatctggcaaagtggtttcttctagccgacaatgtacgaagtctcaaaagaattcgtcagaagatgcacaagctgccagaggcaaggaggaatcactgctcgcgatgcaatgccccttacgtacaatttgcaagttgagatattcgatgtttgggatatagactttatgggaccttttcctaagtctcgcaactgcaagtacattctggtggcagtcgactatgtctcgaagtgggttgaggctatgccgtgcagcgccgcggatgtgagacatgccaagaatatgttcacagaaaccatcttcccaagatttggtactcccaggatggtcataagtgacggaggttctcatttcattgacaaaaccttccaagacctcctacgagagatgggagccaaacacattgtggccactccttaccatccacagaccagtggtcaagcagaaacatcgaacaaacaaatcaagaatattctgcaaaagacggtcgacaaaatgggaacatgatggaaggaaagattgccagacgcactgtgggcataccagacagcgtacaagacacccgttggaatgtccccatatcagatagtatacgggaaatcatgtcgattacccgtagaacttgagcacaacgcatactgngccatcaggaattggaacatggattttgagggagcagganaatggagaaaaatacagattgctgaatttgatgaatggagggagaaggcttaccacaacgcgaagatatacagagaatggacgaagcgctggcatgacaaaataatcaaaatcaagaaattcaagccaggagacaaagtactgatgttcaactccagggttaagcttttcggccacggaaaactgcgcagcaaatgggaaggaccgttcgacgtcatcgatacctcttcacacggggcaatcacactccgcgacgactcaggtaacatatttaaggtaaacgatcaacgcttaaaaattttccttgagccaaatgaaactgttgacgaagaagtggatgttattgaattaatcgattatgaaccatgatgatctcatctaatgcatgcttaaaaccctgcatagttgtcagttttgtgcttagaataggtttttgcgggcctagaaaaaattcggtggccagccggacctccctgatcgccgttgatcctggggtttggcgtggacgctccagacgttctcccaatgacggttgcggggcagttcggacatttccccttctcacaaccgtcataactgtcctataaaaggacctcacttcattcactctcacacacactttcaagcttgagttgaattataagaggctctattgtactatatttaatactagaataggaagagagtagagtagaagaagtcggaaggattccggagttgtcggtaatcttctcctatttcttttattctgtttattactatgaattcaatataatattcttcttgagtaatctagatttatcttgtgagaattatctgatgacgctctctctcctggcccgatcttctgatgaggggataactcttgctttgatcgagtgcgacgtttgcgacgtggctaccaaccagaacaagtccaggacgccatgcaatcgctacaccacaaacgatgtcgtaccaaccgtgacacgcggttgatgatccctgcaatgcaaacgagagaacactgcaagaacaagataagatgcaatctaaatattgcgaataggtgattaagcacaaagtaatagttgcgattgaagtggtagatccaatcgacccggcaaatcaacacaccaactatttggggctctgaatcaatagtccccgactaatcgagcgaggactagagacaaggtgaatggcacttggcaaaattcaactaagtaaaacccaaatggttttaggatgtacaaagctatttataaagaaaaataaagctagggttaattgctaattcgtggaggtggagggagacacttccgagatgggcctagtctattacaaggcccaaggcccaagttcggttttagcaacagcactgtcttattttggcgattcccgttgactcgagatgaatttggacatgagactggatgtgtttgaaaggtagcgagataagctttcaacgaagtccaagatcacccaaatcggattggcatgaaggcgct

SEQ ID NO: 75799 - DNA, 12499 bp, Oryza sativa
ccgtttatcctacagattcatccggttccgagagcatcgattccatacttctttagataaaacaaggagattttatccccatgtaaacaacatggatggtttttttgttgcgaaggtaacaccaatgctaaacttcatggtgaaatatctaatctattaaataggttgtttgatcaggtgcttatttcattattaggatgtgctgaatgtattgaactctattatgaaaagtttaattttctttgcttagtttggacataccatctgattagggtacttcctttgacgcagcttaaaaaattgagcaatacgatcccagtggcatctgagtcatctaatgtgcctgaagaagcaattgagaaggctgatcctagcagtgacgatcctcaaaaacagcccattcagtcaaaaaaacataaagatgtgaagacgacgaatgaagagacaagcatccttgatggggtgactaaggacaaaaggcagacacatgagacactcaagaaccacaagaagggtaagaaacgcaatggccctgagagtactaaaataaagggagaccagaaagaaacacacaacgaagaagagcctacaagtgaaaaaaagcagcctgtgtctgttaaaataaaaaaatctgttcccaagagaatatcaggtaacaaaggaaagaagctggatacgggcaaaggagagaagaggaaaagaaactggatggtgaggcgagactggtgagatagtacaatgatgttgtgccttttcatgccttggaattgttgttttcgttgctttattctgatttggtgtaatgatcttctaacagggaagcttataagaagtcgaggagtaaacaagtatgaaaggcacggatgaaggagctctagccgtagacaaattgcagttaaatttgaaaacccacatacggggaagatgttagaaggagcgagaatacacaattttggcgttggttcaagttcgaggcgaaggaaaatttttgttgtacttaagtctagtgaagtgatcgtctgtagttttaccctttcttttccgtcttggtttaatgtaccaatactaaggcacttctcggacatgagttatgggagtatgtgattgacttcgtcatgttgcctggtaagtactatgctggccgatggaacagtatgatgttctgcttgctaagggcgacgtgtggttgtgctcagggttaggggcggaaatcgtgctggctccgctttttattgagctttctttgaaattaatttaccttcatatttaaatataagctattcctctgaaaaatatataatcctgtggtctttgtgtgtaactctgatattgtttttctattaaaatacaacgataatatctaacataattatactaatcgtatgaaaagtatttagaaagaaaaatctacccaaatcgttcaaaatcgaataatttttatcttataagaaaccaagccagttaaacgactaattaaacgagtgggtttatcgctgcttcatatagttatattccttatgtggtggatgcaaccatggctgaagcagcagctttaagagatggattattattggcacaacaaatcggtcgtagtcgtgtggaattccaatcggattgcatggaagtcgtcacaacaatgcaagagggaggtttttctgccacggcagcagttgcgatttatgatgaatgctcccagtattggaaagattttctttctatctccattagtcattgtattagagatagtaatgtcgtggctcatgagctagctaggcaagctttgataggcaaaaattcttttgtttggatagatgatccccctgatttcattcggcaacttcttcttaacgatgtaactattttctcgaatgtaaagctagctgtgagaatttaaaaaaaaaacgagtccaagcagattagcgttcgaatactcgaattgataggttcatgacgttgcgggggttcaggaaaatgaactccgaccagggatggatccagaaaaggctcagggcctggttagatcccactctaaaattttttactctgtcacattgaacgtttgaacatatgtataaagtattaaatataggctaaaaaataactaattgcatagattgcgactaatttacaagacgaatcttttaagcctaattgcttcatgattttacaatgtggtgctacagtaaacatttgctaatgacgaattaattaggtttaataaatatgtaattagttttttttattagtgtcgaacaccccatgcgacaccctatataatactccctctctacttttgataatcatatttctaaatctaaaaaaaatatttttataggtatatttcaatccaacaatctatcctcttgaaagattgactacatggacatcgagaaatgtaaatattaatgaatcgcttatttatgaggaatgattagtaacatgtttaaatggatgataagtagaattactaatccttggtctgtgtggcaatatgaaatatgactatcaaaagtagatggagggagtacccgatatgacacgctaaaactttacacccctcatctaaacacctcctctgttcgatgcccagctatagcccaattatttatttatttatttattgcggagagaaatattcaattttgatggatcattgcagtaatagccatgaaaccaagcattaaacatgggatctttagcggaagataacattaacacgaaaataccaaagaacaacctcacacaaaaccactatttattattccatttacgagaacttacatgactgtaactcagtaacactttgataactaatcacatccttaacctgctacttagggcaatatattcatcctaataaagtaactcctgatactaactaagacgaccgtggctgtggtgaagcatcagatataccaaggcgacacacctgccaaaacacaaaaataaaaaaaggtgttagatccggatcactttttttttaaaaaaaaacagattgttcaaaattcagagaattccaaacatgaatttacctgaagatctatggcgacacggaggggctagcaggcgctggagcggcaggagacctcggaggcaccaatggcggcaccgatggagctgtcaaacacaacaacaacagattagattaatcccttcatcaaacagacaatgcgcattaaaaataaataaacatgatttgtgctagggtttaatgaggtgtaattaatcgaattttaacttacaggagcacatgaacagcgtctgcagtggtggcatggcgccgcaggtgatcgggaggagcatcatcttcatcgggtcgacgggcgtggggaggaagctgttgagatcgccgttcatgccgtggcagaggcagatgggcgcggtgctcacgagcgacctgaagccgtcgcagcaggtggccggcggcgtcggcacggcggtgttcgtcaggtagtccgcgcacggcatcacggacatcagcggcgtcatgcactcctttggctgcggctgcgccggcgagctaggttgcgggagcgggaacggcagagggaacgggagacccgacccggacgacggaggagcgccagcggccggcgagccatgcgccgggagcgggagcggggacggcattgggaacgggaaacccgacgacccagacgacggcggagcgccagcggccggcgagccaggcgcagggagcgggagcgggaacggcaacgggaacgggaagccgccggacccagccgacggcggagcgccgccggcgccggccggcgagccagggatcgggaacatcaggaacgggaacagcgggaacggcaagccgggtagtaatcccggcaatgtcgtcggcggtcgctgcgctcctccgctcaccgacgttttctccacggcaatggccggctcgaacccttggaccctcgcttccgcggccggcgccagcgtcgccgccacgacggcgaaggcgaagaagagggcggcggcgagcttggacgacggcgccatctctctcgtcgggatcggtggctttgggtggaggtggagaggtggctgatttgctgtgaagagctacgtgggatcgctcgcaatatatagtgcattttcagttagagatttggggtttgaaactttgaatattcatgtaatgacattggactctggattaattttcgtacgtaattaagcaggtaaacatatatccagcgaactcacgagttcaaaatatgtttgatgcttttgtaaaaaaaataaaatctctgctctcgtttgcctgtagggctgtaagagatgatacagcgtacttgcacttgcaaattgcaatgcggatataatgtcaggtacgtgaaattcttcacatttttcagataaaagtagccagattttaaatgtttcccgttgtttttcatccctaagaggagaagactaccattgttaccttacatgcatggtgaagttggagctaatacttctgtttgtaataatgagaattcaggactttacactgaagaattaactagtccaactagtatgaggttctggctctggttttgctcttcctcgaagagataatacagcccctaaaaagttctgaattttctgacgatattgagagcatagaactcttcagttttcagataaatcgcagagtctagttagtggagtatgacgttttgtctctgatttcgcttgcgtcaaagagataacataactcgtaatagaaattatgaatctctgatgatattgagaacatataactcttcattttcagataaagtagagagtattatcaatttcttaattccataaggtagaagtacgccattgttgcgacacatacatgatagtcgagagttatgtaggagtactaatcagagctatgctgaagacatgacactctgcagtcctgaataaattcaaattgcgtcttgtcataatatccagtttcttactccctccgtcccaaagtaagcgcagccgtgggaatccgtgttcaacgtttaaccgtccgtcttatttgaaaattttatgagaaaattaaagtaagttagtcacacgtaaagtactatttatgttttatcatctaataacaataaaaatattaatcgtagaaaaatttcaaataaaacgaatggtcaaacgtgagacatgaacagtgcaaaactgcacttatttagggacgaaggtagtagatggggtctttgattcttactagtaatttctattttctggatcacaaattcaaaacgactagatacgggccattattgggccgtccctgcgtaacaggcctaagctgagcccaattccacggccttttcgggagtttcttgatagaacgggcaggaaggggcggagttttcttctccgaacccctccctctccacgcacacctcgccggagcagcacagccgccgcatccttgccattccctgcttcggtccaacaccatggcactcacgaacgacagagaaaagctatgtagagcgtcaacttggcaaagttctagggcgaagtagaaaaatgcctctgatcttgttagggaagatattttgttcttttcgaaaagagggtgctgccgtagaatttcatggtcccattgttttatgcagctagcacagagttatggtttcgagaattgcactcaataattcagatgtggctaatgttagttatttcagcactgtcttggttacattgacaatgtgatctgactgactacatgtttttagcggatacacagttaaaaacgttagctttggaaggccatcagagaccccaggagggtcggaattcggatctccgacccgtattttccttctccgctgccatggcagtccttgcttgctctccctttacagctttctttcctcatagtggactccggactccatgccaccgccatcgctgccgcctgccgcacgcaccaatatgcatgtgtgctgatgtgtgcaaggagaccgtgataattgtcggctcatctgatccgtatactccgaatcgaacggccaacggggtttggagttttaatcctcgaaccccctcgggcttagcacgactggagaaagtgtgtgattggttaaaaagagaaagtaggtgaaaaataagggttgtgattggttgagagtaggaggtagagaaatagcttcattttaggacaaggtgctgtactagaaatacctacattttataatggaggaagtagtagacagaccaggccacatcctcctcttctttcggtctttcatacctgcgtcagaaaactgaacagttggccctgaaagttcagttaggcccaggaggtaatccgcgaattctcttcagatttcagcgccggcgcccggcgggcgtggcgtgcacgacgaggagcggccgcgtccatgtctcagcctcgtcgacaccgcatgggtcggcggctcggcgccgccgcgcgagcgccacggcacggcacggcacgagtccgtaacacgacgcgatccgcgcgcggccgtccgctgccgtccgcattttgcagatggagagggacgtgtacgtccgatccacgcgcgcgcgctagcttaatttcaacaggtcggcgcgcgccgcgcaacggatcgacgccgcgtccccgtccgtctctcccttcccatctcctgctgcagcacgcctgcaccgcccgcacgccatcgtcgtctccgcgaaggcgattatcgttggaaaccgggaacagcgcaatggtgtgtttgtttttgttgtctatcgtctctcgtggagtcgtggtcgtgctatgcagaaggagcatctttctcccacgcatatgaccactagtggagaaaccctttgtagtcccggttcgtaacccccctttagttccggtttccaaaccgggagtaccaatctgggactaaagatcgctatctttagtcccgggtgaaataaccgggagtaaagatcgatctttagtcccggttggtaacaccaaccggttgagccatctttagtccgggttggtgttaccaaccgggactaaagatagagctgacctttttttttttgcatgcccctgttgctgcatggtttatatatatatatatatatatatatatatatatatatatatatatatatatatatatataaaccatgcatatatatgtttcaatacatatatatgcatacatatatatatgtatttatacatatatatgttatgcaaatgcatatgtatatagatatatatatatgaacaaaatatatttacattatagaaaatgtgtacacatgcatatagaaacatatgtagtcatgtattaattacaatccattatatatcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctttaccgagttcgtacatgtatttcacttccgccttttcgattggtgcgactcctagcaattgatccgtagttagaccggtgtcagtaataattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcaaacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttatgtgggcaagcggtggagctggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggttctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcaactcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcaatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattaggataaatgcaaagtaacatatatatatatatatatatatatatatatatatatacatatatatatatatatatacatgtatatatatatacatgtatatatatatacatgtatatatatatacatgtatatatatatacatgtatatatatatacatgtatatatatacatgtatatatatatatatgtatatatatatatatatatattgcatttcacgttaacgttcgtcctcgttcgttcgctcgttcacgttccctagctcgttcacgttcgttcgatcgttctcgttctcgttcacgttgtcgcggcaacgtacgttgacgtgttcgttctcgctctcgttcgttcgatcgttctcgttctcgttcgttaatggcggtgtggcggcatcggggaggcggttggcgcggcggcgtggcgacggcggcggcgaaggcggcggcggcgtggcgttggcatgcggcggcggcgttgcgcggcgtcgaaggcggcggcgtcgaaggcgacggagagagatcaagatcggagagatcgagatgcatgaagggagatgcggcggctctcaccccagagatgcggcggcagcagaggaggcggaggcggcggcgaggacgacgagctcgagacgacggcgagatacggcggcgtcggcgcggggatttgccctaggcagtggcggcgaaggagagaggccgagagagatcgatcggcc

SEQ ID NO: 75800 - DNA, 5394 bp, Oryza sativa
ggaaagggcatggaagggatccaaactaaaattgaggggtatgtaagagattgagcaaatttcaggggtatagaagggattatgtgaacttcaatgggtaattaattttatctactaattaggatgttttatgtaatttccttagagatatgtttgggcaaaagtctgccgcaaagacttatggtatcttaaagtttgttagagacaagagtcgtgtccgacaaggacatatattgtatctcgggtataaatatgacccaaactcatgtaatcaaacaacacacgttcaatacaatctcggcgcatcgccacccttttactttcgttttgtttcgacgagttcttgttttcgggttgagctgcatcggtttcgatcttcgactagagctaaaacttgttatggcggcttgcgttctcgggattagtgcttccatctttatgatactctaatcttgtttatgtaattcatcgagttatcatatatcttacataatctttggtaatattgttacttaacctccaatcggccaacatctatcattggaaggcagccgatcaggttaaatactaatgttgactcagattatgtaggatatcttccaccctatgaaacatccaacggcttgattgtccagatgttgttgttcttttcatacttatagctacatcagttgagtttgaccttataagtcgtgattagaatcttaatctctagcctatctttggttgccgattagggtagtatcggggttttagctgattttacctgatttagccttatatcttatatgctcagttgacatactagtgttgacgaaaaaatcgaacacaccggcctgggagatatgcttagctccagtgcaggtccaaatatgatgagatgcaggcgtgccaatcagtttgatcctgcaactgacaagatatgcaaatagtagatcaaaacagtcaatcggctgacaagccgatggagtagttctagccgatagccgataatagccgatgccaataccagccgatagcggtagggtttaagcaatcggctatatgtccaatgtaaataatgatatgaaggcaatcggctgatgatgatgtaataaaataacaatataatccagtagaaaccaatcggctagaaacaaaatataataagcactgattcgaaggttaaagcatacatcagctggaggtccgatgtcatgaaatccacaagattagattaaacagtgaaacctttgtcgtcatttcctaaatccaacttatatgtatatgcaatccttatgagccgatgcaacgtccagataactcaccggctgaaaccccgatgaaacccttattggcagtcaaaaagcaggctagagattatggttctaagcacgacttagtagatcaaacttaactgatgcagcactaagtataaaaagaaacataatatctagacaatcaagtcgttgactgagttttcagggtggtagatgtctaagctaatctaatctaacaacgcgatttagccgataccggcagaaaccctaaaacgagaagcagccgatagagctaaattgatatgctaagactagattaacatagacatatgataaataggtagggaaatatatcatccaaaccagagcaatccaagaggtcgaatgtactgatgcagccttgaacgacgccgatgtagatgagacaattgcctgggccgacggaacattggacttaccccttcgctggagatcaaacaccgatgcagccccgcgtcaggtgccaactcccgctggacgataaaataaagtagaaaaggtaaaaggtggcgatgcgccgaattgtattgatcgtagcgatagattacatagaccccgggtgtacatatttatacccatgggttgatacaagtccttgtcggacaagaaagaaactaacctaaagataaaaggaaaatataaagtccttatcggacactacacacactttcctaaagataaaaggaaactaacaaactattcctaattaatagataaactgccatgccgcatcgtctttaaactcggtcacttagggataagcttcctttagtagattgatttccttaactgaatatagtaggaatctgactattggcgacttgataactcccatcggctgattccgagatgctgcagctgataatgattctaagccgatgacgtctttgccgattaccaaatttcactgttaacacatctttgccgattaccaaatttcactgttaacaactagatctgccctttatattaagatcttgttgcatctaggtatattaagcttcctgtttgatatattttgcctgctttaatatcttaatatagagtagtatcggagtactagccaatatatgctagatctatctgattggctatgttatgaatgcttatggtccttttgttaatatatatttcgatctaactggtttatactgtctcggcatgacgaccgatctatgccaatcacttgatttaagtatatatcgatgaagggattatataccgttaatacctacagccgatcgaatagattaagttcttttcttgcttgttcatgattgccgatcgactcaaatatgacatcggctcaaagataaatgatatgtcatcggcgattgcccgatcgactatcatttatgggatttaaccacgaattctttgtctttgtttcttgttgattgcaggatcaaatcaactggcacgctcacaaacctaaagtcaagatttttggacttgcactgaagttaagcagatcttccaggcctcgtgtttttcgcatcaacatcgtgctagggtttaccaaaagtcgtatcctgattattttgacaatatcccatatcctcgtggttatggagttcccgaatttaccaagtttagtggtgaggatagtatgaccatatggcagcatgtaggtcaatttgtagctcaatgtggtgaggctagtagttcagatacatataaattgcgcttgttttctttatatttgtccggtactgcttttacatggtttacttatttaccagcaaattctattcagatacatataagtatagttttgacgtggccaagtgtgataaaatttttgattatcttttgcaagaaaagcaaattagattacctaaaggccatatcataccatctcaagaagaattaaaacgtcgagcttattgtaaatggcatgattctcattctcatagtactaatgattgcaatgtgtttcgacgacatgttcaatcggcgatagatgaaggacgattgaaatttaccgatggttccaagatgaatcttgatcgtgatcctttcccggtgaatgcaattgatttcaatgaaaataaggtgttgatttggtcggagcaagccgaatctactaaagggaaggaagtggtcattggagaacctaggcctaaaaatgatggtgccaaaaaatccggaggttggtgtttggaaggagaataggagtgaagcttcaagttccaaagccccaaagaagactaaggtgacttttaatatgcttttgtacaagtatgagaagcaaggtggtgagaaaaatcacaataagggcaaaagactaagatcacctcctagggagtgatttggtcattcaccaagacgagtggagtcacctttccctcatcatcctcaagccatgccttgtccaatgccgccgtcaggttatccttttctttacttcatgccatggggggcaccgccaccaatgtttaatcatatgcctccaatgcaattccatcaaggttggggaggaccgaggaggtcagcacatgagcgtttgtcttcaccaaacaatggcctgttttatgctaaaaatcaggtcaatgaagaaaagagggaaggaaagcgcgtcaaggtggaaacgagaacttcggaggtgattactatcaaggtggggtctcatgatgtgccaataccttctggagatgaagccggggagtcccaaggtaacaaatccgaagccgggatcaattcttcgtagactgccagtctgaccagcccctctggccggtctgactgcggccctacggccggtctgaccgatggcatcatgccggtcagaccggaccatcaggccggcctaaccgctggccacacgccggtctgaccaggccctctggccggtctgacaggtgctcttcattcggtctgataggacattcgcaaagggtagctcgggggcttcatcgtcttcgagtaaaatcaacaggggtcattatatacctcctggaacagagccaaaatcaaggcggatgcctaaagatttaacggctacccaacatggacatcaacatggtgtgtatgttgcctatggagttttgtgctatggatgaagccgaagttgctcaacattcactaggtcctaaagacgcagtttttgagaagcctaatgagtcaaaccgtcatatgaagcctctttatattaagggttatattgatgggaagccggtctctaggatgttggtagatggaggtgtcgccgtgaatttgatgccatactcgttgttcaagaagttggggcgtggagatgatgagttgaagaagaccaacatgattctcaatggcttcaatgatgaaccaacgaaggcgaatggtgtcttttcggtggagcataccgtggggaacaagacgttaccaactactttcctcatcatcgatgcgcaaggtaattatcatgttattttgggtcgttcttggatccataccaattgttgtgtgccttcaaccttgcaaagaccgatgcttcacttgagtggcgacattggaatattcaatgcttatcggggttagacctttctagctatgatatcatttgtgtttccaatggtgattttgtacctatttctataaagccggctagcatagcacggctagaccatattactttgtataatgagtaaagaagctaatttagagtggttgcaaaagagggtgcaagaatatcggtctacaaagaacgatattggagaaactattgaagactttgatggagtagaaaagcttggtcaagggtttacataggccgatcgtttggaggaagtagacataggtgatggaactaagccaaggctgacttttgtaaacaaaaatagaaagccgattgtaaggttaaaataatcgagttgcttaaagagtatgttgatagctacgcatgggagtaccatgagatgccgttcttagccgtgatcttgttgagcatcggcttccaattaaaccgggttttaggccttataaacaaccacctcgtcgttttaatcctttgctacacgatcgggtcaaagaggagatagaccagttattagaagcggggtttattaggccatgtcattatgcggagtgggtatctagcatagtctcggtggaaaag

SEQ ID NO: 75801 - DNA, 5420 bp, Oryza sativa
gtgttcccttgcgagtctacatgaatgagttcaagaactgatcccgtgcctgctgcatcatcgcgtcgaaatctttcttttgatcaggtgtgaatttttctggatcgatgggcacgacgtttccttcaatgacgtcggtcaatcctaacttctagatcttttccttaacagtgcctggactagctgaggatggcgacagcggtggtttctcggccatgaggaagaattgcttgctgacttcttatcggtcccactgggcgtgccaaaagcgtgttgacgtaaaacacgaggcctgggagatctgcttaactccagtgcaggtccaaagctcgccttcaggtgtgttagcgtgccagttgatttgatcctgcaatcaacaagaaatagaaacaaagaaaccgcggtttaacttataaatgatagccgatcggctaagtgccgatgacatatcatttatctttgagccgatgtcatatgtaaatcgatcggcggttataaatagataataaagaactaaacctactcgatcggctgtagatatcgacaatatatagttttatatcgatatatacttaaatcaagtgattgggatagatcagtcgccatgccgagacaatataaatcacttcgattgaaatatatactgataacagaactatatatgtttatagcatagccgatcagatagatctagcatgtatcggctagtactccgatacaactctatgttaagatattaaaacaagcagaatataccaaacagaagcttaatatacttaaatgcaataatatcctaacgtaaagggcagatttaacatgtcaatgaagcatgtaaagcaaatatagttaaatcagataagatcggctgaaactccgatactaccctaatcggcaactagaagggaggctagagattgatattctaagcacgacttaatagatcaaacttaactgatgcagcattaagtatgaaaagaagaataatatctagacaatcaagccgctgaaagtttcatagagtggtggatatcttatataatctaaatcaatgtcaaaacctaacctaatcggatgccctctattaatagatgttagccgattgtaagttagatagtgatatcgccaaagattatgtaagatatatcataagtcgacgaattacataaataagattagagtatcatgaagatggaagcactaatcccgagaacgcaagccgtcataacaagttttacctcttgttgaagatcgaaacagatgcagctcaacccgaaagcaagaactcgtcgaaataaaaactaaaggaaaagggtggcgatgcgccgaaattgtattgaacgtgtgtgttaaaaattacatagggctcggggtctatttatacttgagaattgccagatatgtccatatcggacatgactattatttgtaacaaactctaagataccataagtctttgcggcagacttttgcccatatttatctctaaggaatttacataaaatagcctaattaatagatacaattgccttcctaggactttatccatgtatggcaatcatcttgaagtgcgtcaactcaaacccgatatcggatacaagtcgtattatgagaatcagttgtatcacttaacccagtctgactcggacttagccgatcctattcatagccgacccgaacctcggccaattcttactctgtctccgcgataatcctcatcttcgattccgcttcaatccaaccttctttccgatgcagatattaccaaatttggtcgttaacacatgcccccaagtccggaatatttggtaatgtttcggatttgcttaacattgactccgagcaagtttcgcactttaccgttttctgaccattattcaagcgcttcaaatactaaccgttgcccccgagaaatctcacactgttactcccgttttcaccgcttaagcgaaactctaccttctctctctccggcgattcctccgacgcaaaaagcgatgtcgtcctccgccagcccgtctgctgcgccatcagctgagtatgcctaggtaagtccccatcagcaagatcccctttctcaatagcagatcgattttcctcgtctcatattgctctcttcttctcggttgctttggatttgcagcacctttccaaccaagttgcgattcctagcctatcgcatgaaaaccactattttctgggtctaataggcaatcttgaccccactgattatcattgttgaaaccaacaggatcccctttaggctagccaaccctaacctgagccactagaaaaatactttcaagtcttggccatctcttgagagaaccacccctgagaaaagttggatcacatggtaccaacgcgtatcagctagtaagaaagctcactgggatgagattggaatcggccaagcacttgacctaaccatagccaactcagctaatgacgagcccttaatggcagccgcctcttatttttggtccaacatcattaacaccttcttgttcaaccaagggccgatgactccaactttgatcgacattaccatgatcaccggtttagatgtaacctcatcggctaatcccatgagcatgaacaccaaaaatcagtttgatttcagaaccaaaagcataggtggctggtctggctatgtggcggcatatatgggtcaaggatctgttactcctcgagagcatgtagccttcttgctaatgtggctcgaaaaattcctcttttgtggatccagttgtggtcctacaaccaactggcaatttgtagccgaagccttagaatcaaagaaagaatttcccttaggcaagatcctcctcggctacttataccaaacattgaacaacgcatcggccaagatagccgttggctcagtagttgatgcaggtggaccatggtggctgctgcaaacctggttacacctgatggttaggaaagttgtcaatcggtcgtctgtgacagaagctgagttcccattgccagagccgattgtaggagacgatggagaagaacgcactcatcgcagatgcacatcatacggagaatatgcatccacaccaactgatgctggagcgaagctatcggctgagctgctcaaggactggttctgcagcttctatgaaggttttaagaaagatgcacaggtttggtttccttatgaagactcagcatatcttgaacttccatcagactttagatttgaagacattaatcatgaaaaattccaaaatccagagaagttctcacagctgcaatcagcccatgcatccttcctgtcggcattcaccaagggagaaacatccaagtctcttatgagtttatcacccaatgagctcggctggacaacttggattaggccaactcccaatcggcttattctttgccgacaagattcaatgctgaggagaaatcacatccactctaatgatggatcggctacttaacctaccaggaccccctctgggcagcattgataatattgagtttgcaggatttagaagcaaaaacttcgacagatggtggggtgaatggaagctgcacttgtttcatcaatcggcttcgatgtatatgacagatctattccctgatgtcatacctcaggtaaacctcaccattgttaacttgaataattgttagccgattcattacttgactaatttcttgttcttgttctgcagacaatcgactcttcccctccacaccaaagtaacagtggcaggcacattgaatatgccccaggtctaattccgaatggaggtggactatctctcccgttatcggctaccatgccactaagacttcaactctcctttacgacttaatcagggaactagccgatgcaggcaagaaaaggaaaaccagatcatcagccgtgagtactttggcctcatctcaaagaaaaaggccaaatccaagaaaactaagccgactgataagccaaccgatgatctgcctgctttggatccatccattaaacaagctctggatgaagaggagattggcgaagatgttgaccaggctgcagccgaagtgagtgacacagaaagaacaccattggcttcacccaagcaaacacctccaactccctctgcccccgttcatttcacaagagtaaatatctctcttcggcttcttttgtaattacctccctcttcagctaattactcatagattttgtggttgcagaagaagaaaactgctgtgaagaagaaaccagcagcgacagttatcaagtcggctccaccagtaagatatctttaattcttttacttaatcaatctcaaccgactctctataacacttgtctattctacagcctcctcctcctctttcccctcctgtacagcaatcgtcaagtaactagactccgtcggctgtggggagtcatcacatcgaggaggaagaacaaccagctgctcctactatcccagtaagtttccttttgattcaagaacttagatcggctatattgacttagctctcaaacttcttgaaactatacctgcaggttctagccgatctcttctcttttgacatcaaagattaccttgatgaggcagaagaagatacttcaagcaaagctctagctcctctatctgacgatgtgaaaagaacacttgaagatatctcacatcggctagaagcttcttctttagttgactgtggatcaattaggacacggctgcatgaagttcaagctctgattcctaaagaattggccgatgtcctaactctagccgcttatctcgagaaacatcagttcaagctagaaaaagccaagctaagactagccgaacgctgtgagcacaaggagattgaagccacaatctaggtcaatcgacagcttgtgcatgaagaaaaaatcaaactcgatcagctatctgagggtccgattaagtccaatattaatcagctcgaagctcgcaagattgatctcttggcacagcttgaagaatggaatgctcaactagatatggagcacaaaaagctagccgatctcccaaaatctgtcgaagaacagaaggcaaggctcaagtcggctatcaagaatgttgctgacctaaccaagtccctaaaggtcacttctggaactgatgctcaagatgcccaagccattgaagaagtcgaacaaattaggcaaagggctatttcggctatccagcagtacttatctcaataactcttgtgtaataggacttagataccttaataccccgctgttttaacaatcctttgtgccgattaatacaacttctaacttcgcccaaaattttattttttttgtacatatgtgcccccctaattttacaatcccaaaaacattgatgaaattataaaaaacaactaagggcgatataataatatcggccattgtatatcgacaattcacaaccgattacaaatagaagaaa

SEQ ID NO: 75802 - DNA, 1726 bp, Oryza sativa
ttcctgcagccccaatgttattatgatctatttatattcatgtttaaaaatgctttacaaattccttttgcaaatggttgtgaaataaaacttccctttatgctaaaaagaaaactacaaccagcctccctttgattataagattcgcatgtagtatgttaggattgttctcgcttgctagtacattaagttgtttagtgtactgacattgttctttaggttgagtgtgcgggatcattgcttcttcaagaaggattctactagaggcctacccctagtcgcttgtttgtaggttatgggtaaacaagcttccataaatctctaattatttggctagttggcctatgtataattaaagtagttgtaatctgaattttaatctttatttatgccttattccatagtctcccatagtctctactcgatgctttggatttttggattttatattgtgtttcctatttggcttgttaggacagcgatgaggttagattgttactttttttatatgggttctattgagaccccatccaactaaatattttttgttatcacgcgaagtagcttatacaatatatagcacggatgtctcacaacacactactacaaatgtgattgttctgtacgagaccccatcatttttgcaaacgaaccataactagtggcgcttgcaaaaatcaagcggcattttcgcagacggctccttaagacgtccgtatggattttcccatacgggcctcttaagaggtccgcgtgcaaaaatggcctcattttttcatgcggctcacttaagcgcccgatggaaaaatcaatttgaaaatagaatttgaaaaaaatttgaaaaattgaaaattttgaaaaatttgaaaaaataaaattttaaactagtgtatctcactcatatgaactccaaattggatgattatttttcctaaaagtttctaaaatcatgctctatcatgtcattgtgttcttactgctattattttggccacttttgaaagagcatctatgcccctagtgggttttggtttattgatgacaaacgattaagggactgatgcacttattgagtgtataagcaagtgattagtccgatgaagaagctaggaaatggacttatcgatggatgagaattaaagagaagatatttaagatgtgagtatgaagtgactacctatggcaagacggtgaagcgcaagcgacgctcagctgcaatggaccatgcggtggtgaagggccagcaagaggcttggtgacgatgaaccgaaaccggtggtgaagggcgagtgaagactttgtcgtgatggaccgtgcaatgccatttgaagccatggattatccttatcaatcatttgagaaatggaagatgaaatgtcaaagatcaacaagatgatattttcccgatgatcaaatgaccttgacgccggtaatcctccaagtgaagaaagaaattggtgtgaaggtattcctattggtataactttcctttttacatttgagtttaggatgccgtactattaagggggataccacatacatataattggttgaatactagtgctcaaaataattcatctttgtgttggttgaaaaacctaagccaaatttcaactccgagttgttttacatgtcacaacacttgtaccgggtttctttgcaagtttttcaacatctcttgaaggttttggctcatgttttatggtggatttgatagcctatgaaa

SEQ ID NO: 75803 - DNA, 4446 bp, Oryza sativa
gctgtaagacttgatctaaactgtagctcaaaccttgctttacaactttgccattggtcactagctctaactctgcctggaactaattttaatctgaacccaaagttggaattccacctctgttccagacttagccaaaacctagatctcctctccttctctctcactagtcgctgccatgtgggccagggctgcatggtgggaccacattgtcagactcatattgctctccacacgggccactgccagaacacgcgcgccacgcgcgggagcacgcgtcgagcgcgggagagggcgagctcctcctctccatttccgccggtgaccgtacttaagccgaccgtccgaccatctttctctccctcttgcccttgtctcgtttcgcggaagaactgaggtaccccgcctcggattcaccgggaacggaggcgtcatctccggcgccggcgagagaagtcctcgactccgtcgcaatccggtgagccccattttcgttcaatgcgcgttctgtaatcccctctcaatgccgtctctaataccgccaagaacacctcatttggtgcagccaatttccgggaacgcgaccgcgtcaactcggaacaccgacgcgctctggacgccgctgcttcgcctttgctcgtcgcccggcttccacagttcgtgacaagctgagcctcttcaccacgagcttcatcaacccctgtagatcaagaatcccgaaggagtcgacacgaggtggaccacggtgggagatcgttttcttcttccccaactccggccaccgacgccattcctttccttctccttctctggtgagcttcggcgcaatatttttcgcctagagctaccttgtgctgatctaaaccgaagcatgcatcctctctatgcagtagaagcctgggggtacaccgtcgacgatgaccgtagcagccgcgccgtcgctgaaccagtacaccgtcgccaagactttgccgagccgcgtccgctgcttggtgagcctcctagtagtccctagagtccttaccatacgcatgcacgattagatcgagactaaaaacccacatgcatgtgcaagccgagcttagccactgcttctaacaccctaacagccgctatagagcaccaaagcttgcaagaaagacaccaataggttcgcacagttgttctctataccttttgttttgggagcttgagctgaatcgccgccaatcgccgccggtgatgctgtgaagctctcggctgtgctgctgctctgctctatccagagcaagggcatggcttttgaaatttaaagactcccaggaatgtattagcaactcgagcagtcacttacatatggggtcgtgcactaatctgtaaataacataaaacacaagtcccattttgaataaaatcctggaacacgtgctaggggttgtgggatctattttctgaaaacccaggggcttttgcgaaaaacgttagtcactgactggtagacccgagagaggaaaatgatttaagaaaattggagaaaatgcaaaactaatttcctatcaactgaaaaatgacagaactttagaaatttgtagaaaattcatcctgactctaaaaattgcaaaataaattttgttggaatcatattttcatgctctgcatcataaaaatgtttaatttaacagaatcataaagattcatgtcttaataatctgaaatgcatttaggaccataattaacatgtaaacactttaaaaatctgtaactttgaatgtaaactgttagattgaagtttctttcactgaatatcaaattaacacagagcacaccaatttcataagaagcattcattttagagcatgttggatttttatgtatgttttaattttgatttttgcatatgtatgtttagacgattcgcagccgagtctcgaggagacctactttgtagctgagcaaggagtggaagagcacggcaagccacctccccttttttatctcattgaacctatgttttggaggtttttgaaaagtttgcaaaatatgcatgtctattgtacactaatccattaaaatcttgtaaaatttgatagaacaactcctcaacttgcattatcacctaaactccacaaaagaccttaaccatcattccaaaccttaggtacaattcattgtgtcacgttaagaatgatgtttgaagtcacaattctatagaagtgcttagccatgcttagtgatgagtttacttaccatttgggctcaattacatgtataaaatgatttattttgtgatctggattaaaatgataaaatgtgatatttgttagataaaatgttagaaaatgtggattttaggtttgggcctcatgtggtacacatgtggtgtttagttgtgtgccgatagggggagagtgtgcccaaaccgacctaaggacttcactcagcgtcagttcacttcgtatacagtacaaccacatgtgctagtatgggatagcccaagcttagtaaattatttatgatttagccttatattctggtaggctggtgtgtatgagttcggataactcagaggaacttcctatttacccccgacgtggtagtataggtgactaatctatccaatacaacggtattgtgccacgtgggtgggttcccgttgtgtccgccaccacggcgttaagtttaaggcgtgggcccgccacttaacggttctaggtcatatatcgtgtatggcttaggatggagtgtcacgtatcgtgctagtgtaaggctaaatcatgaatcttggaagggctttgttgtgagtaataaatcgggtacttatgtatcgcgtgccatgcttttgcatgattattatttcgcatcatgtgggtaaggtgtacgtactctgcagagttaaaactaatcgattagtcgtgctcacggtcaagagcggtgtgtgaatatgtcatgagtatagacctgtgttttattctcctaaagctgaatttgaaattcaaaatgtgatgtgatttgtggattatatccttactgccatggaaggcaataaggggctatgttatatgtgtttaacatctattttgatgcccatttgctaagtgtatacttgctgaaatttaattgaaaataaatctgaatttgaaatgatctttgcaaactaaaaatttgctttatgctaaaattatcccatgttagctttactttgaatatgccatgcatgtagtgtactaggcttgcttggtgcttgccagtacaatttatttgtactgactcttgctcgtattgttgttttgttgcatgtttagagttggttgcaggtgagatcactcctaaggaggaggatttcgttggggatgtttctttcttccaggatggttcttactagggtctaccctagtcagttgcatgaaagatcttttgggtagtaaatgcttccgtgaacctaactattcggtcaatcgaccatatttatctaagcttatgttgtatgaacctaacttagaacttagaacttagaactccctatgttgagatatcatgtgcttggatgaaagtgaggaagggctgctgtgctctcgcccgtttcctcctctcgccgcccttcctcctcgccggatacgagctcgcgacgtcgctctctctctccgccgtcgccaccgatctccagtccgccgccgtcgtcgccccgggccgccttccacctcggcgccgcctccgtcggcttcgtcgcatcctcgccgacctcgtccacctctccgtttcggtcgccgaccgccggagcgccgtcgaccccgtcgacccgagccgcgcctccgccttcctccgctctggctgcctttttcgtcgtcgccgtcgacctagggtgagccgtggaccgccgcctcttttcccccttcccttcccctctctcggctgccgctccgccatgcctatggccgccgccggcgaccatagggtagcgggcgccgcctcccgccagccgcgccgagtggccgccttcgggcgcgccgagtggccgccctcgggtgcggctgacacgtggagccaacggcgccggccggtgcgagcccgggtgcacccggtccaccgtggaccgtgaggctgccgcgtgggccccactcccgtggacccggtccgcgcgcccccttcccctcggctgacgcaataaaccctttttaaattaaaatttaaatgaagaaattcgcaaatattcatttaaagagcatataaactcaaatggccaaaacttggccatttgaactcggaattggaccgttcaagtctctaatttttccttaagaagtcaagaacccatttttgtgctttgttcctgcttgatatatggagtttattagagtaaaagcccttttattttccgttggtcgtgtagacgttgcagcttcggaagatccgctcttcgtggaggttgaagccgacgtttgggaaagtgagcaaggcaagtcacatcat

SEQ ID NO: 75804 - DNA, 664 bp, Oryza sativa
atagcaaataattagcataatacacatcataatttgtaaattatataggaaaaatcatattaacttcaaatcatatgagatcaatctttttggacttataagatcatcctcagtatcactggaaatctacgtggcacaatctgtacaccaaacacctttaaaattttgtatagtaaataattagcatagtatgcactataacttgtaaaatgaataagaaattcatcccagctctaaaaataatgaatccaattatgtcgaacatacagactacaagaatctatttaatctatgacgaaaaaaattcatcatggatcactgaaaattcgtcacaggaatttgtccgtgacgattatacttatcgtcatctattgagcgtcacggattaaatctgccaacgttttctccgatatcatcacggatcagcacaatctatgacttttttaaccatcataaaactcttatgggctcgtgtagtccagcccaggcccaacctttgtgatgaaattaaacgtcacagatggttaccacgtggcggccaacatagcaggtgacgtggtcgttttgacacgtgagtgatgacatgtcattgatgacgtggcagctgacgtcagcaatttttttatacagcccattatttttttgacggcccaatatcccatta

SEQ ID NO: 75805 - DNA, 706 bp, Oryza sativa
aaaatcgtggacaacaccactaatcgatcatgggaattaacaacaagtataataaataaaataatgtacttccacttagtaggtagctagagagcatgcgtagacccagaggttggtgcttaggatggtggcggccacctcggcgaccttcacctggttgccctcgaagaaggcagcgtaggggaggagatggtcatagcagaagctggagccgtcgcggtcggcctgcagggcggtgtcgcagcaggagcggacgaacgctgccgcgtccgcggagggcgcctcccctggcgccgccgcaggtggcagcaccaccactggcttctcctccttcgcagcggccgcacatggtggggataagccgccggcgctgacgaccatcaacaccacgaggacggtggccatgctcgagctcgacctgctcatttctgtatattatttatctctctccctctctctctctctctctctctctgcttgtttcgttactacaggatgaattacttcataacaacgaggtacaatttatactagtaggctcgattggtcgttaactaattaaccacaacctttctttctaatttattcaatggctgttctagcatcacggcatgtctttttggtgttgtgatgtagtgccatgcttgcaattataaactactatattaatgcaactaattgcccatatatagacagcctgctcgct

SEQ ID NO: 75806 - DNA, 10960 bp, Oryza sativa
cgatgatattagagtagtatttggtagtttacacgtgatgatgtgaccattaagtatatgcatacatccaagcgcgagaaatataaacatggccaaagaatacatcgagtgaacgcaggatctacaagatattaaagtccaatgagttttggaacccaattcggcctccggagacagtactgacttcaaacggacctagcgccttcatgccaactccgatttggatgatcttggattacatggaaagcttatctcgctagctttcaaacgcatccagtctcatgtccaaattcatctcgagtcaacgggaatcgccaaaacaagacagtactattgctgaaaccgaacttgggctttgggccttgtaataggctaggcctatctcggaagtgtctccctccacctcaacgaattagcacataaccctagctttatttttctcaataaatagctttgtacatcctcaaaaacaattgggttttgtttagttgaatttttccaagcgccattcaccttgtctctagtccttgctcgattagtcggcgactaatgatttagatccctcaatagttggtgtgttgatttgccgggtcgattagatctaccacttcaatcgcaactatttctttgtgcttaatcacctattcgcaatatttagattgcatcttatcttgttcttgcagtgttctctcgtttgcattgcagggatcatcaaccgcgcgtcccagttggtacgacatcatttgtggtgtagcgattgcacggcgtcctggacttgttctggttgatagccacatcgcagacgtcgcactctatcaaaacgagagttatccctctcaccagaaaatcgggccacgagagagcgtcatcagttggtatcagagcttgcctggtgaggatttcagttgtatatatttttcctacccatcatctataaattgccataccacttttcccttcaccgaacatgagttctgagccttgcaattttcattcaattttgctttattgagttttagtccgctgtcgtgtcggagtgctggttctagctatagagtagtcttggtctgaatttgcaagtgtgtgtgttgcacgttgatctaggccgtagttttattctgcttagaagtcacagtttggctgccgcgaatatcaagtcgcactgttgtttgagtagcagatcggattgagagaaaatatggtttgctgatcgggattttgccatgagatcctgttagtttgcatgtgtgtcagataattagataattaggaaagtctgtttgcatgtgtgtcagataattaggaaagtctgttatcccttccgtcgtctgcttgagtaacagagacaccgaaacaataacaaatttgattgggtgagctttcctagtttgttacgcatgcatgcatcatttccttgtgtgagataaattccttgatttgcggcggcagcttctatagcgagttccatcttttaattcatacgttcagcccttgagttgtaattttttttatccaactattcacgtttgatagctgtgatctgtgaaaaaaaaagagaaaagtaaaaaaaaaaggcagaaaggtggggaaaaaaaagagccgcaccaaaaaaaatcagaaaaataaagaaagacaaaaaaatcagaaaaaaaaagagaaaaaaatcagaaaaagaaagtgtggagatttgttttgttggaatcttggagagagttgcttgagtgttgatcatttgcttgtttgagctagtaatgagtctaggctaggccagcaattttgcctattactttggactattattcaatttcgcaaatttgtttgatttttgctattccttgtgatatagttaagcctaccaagatccacatactactaacctttactaacctttacaggtctggctttgcaatcgctccactcatcaagcgtgtcattgtgccatgaaccaatcacggtgattgatctgtttttgcattatttgagaacattataagaacttggtatatgctatagtgctgagcgacttgcaaccccataagcaaaagattgttgttaacaagaagttacatgcatatgtttgtttttcttgtttgctactgacaatgacaggagtgtacagagagaacgggattgaacaaatgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgctcaagataacaaaggatggcataataggttttcatttgcaaaagcagcatttagcaaacatttgagaatttaataaaaccgttgagtaataattaaacaatattaatccaacactatacaacgtaccctgttgtataggcccaaccattctgaacaaccaaacccagctgtacagatctatctccaaaccaggaatataccattccaaaccaggagctaatcaaattattaccagttatagcatcttctaatatgatgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaagagttgtgacattacccctcgtacaacacaatccactgcagtgcaccactcccggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggatttagttggcacattaattaattaactaatcacgattgaccatcgtgaactatcaataagccatcatgaaataatagtgagtcattagttatcccataaatgtactaatgtttctaagcagggctaagcaattatatctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccgaaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggtttattgcgtcagcgggctagggtttggtggaccggcgcatgggcggcggttcacacgaacggacggccgagattgatccgatccaaatcggacggccgagatcgatcgggtccacggcggctcacgggagaggatcccgatgacgtcagcggtgacgtcaccgacggcggcggcggctcggcgggcggggacggctcgggcggcgcatgctcgccggcgaacggcgacgcgaggacgcacacggagggcaccaacgggtagcggacggcacggcgaacacaccggcgaccaaaacgacggcggagaggcaacggacgacgacggcgacgaggaaggggcggcggctaccttcgggttgtcgacggcgacgatgctccggcggtctccgacggcagcgaaggggcggacgaggacggcggcgacttggcgatgacgacggcggccttcccgagtgacggcgacggctggaacgacggcggcgcacggctggagcggcggcggcgaaggcaaagctagggcacatggcgctagggctactccggcgacgagaggcgaaggcgagggtggcggcggaaagagaagagcacggggatccttttaaaggggctcggaggcgacggcggaggcccacggcgacggcaacggcgaaggaaactcgcggcttggaaagagggaacccgatccgaatcgaacttgattccaacgctttccaaagcgatttagccgatgattccaaaggagaaaaggtagaggagatcccggagattgtttcccctcaaccaattcggccggagaaggaaagaggcggccggatttggaagggaaacggcggcggcgcgaactagggtttcggcagcggcggcggctcggcgaagacgaacctgacaggtggaccccacctgtcagcggcagcgggcgcgcgcgcggcagtggactgggccggctgggccgaggagagagagaagagaggttttgggccgactttcggcccaaagccaaaagaagactttttaaaacttttttcaattaaaattatttcttaaatgcaattccatttattaaaaatacttccttagctcaaataaatcccagaaaaatctaggaattatagaattaagcaaagtatttaatgaaattttatctggcccaattttatattggaatttattaattaaacttagattttcttttcaagacttttaaaattatttctaaaaattccatttaaacaacaatttatattatttgaattttcagggtgtgacaacaaataaaacattggctttcacatcaagaagagatacatgatgaggcttgtgaaaataatatatcgttgcctttatttgttggtaagttcaatcctacagattatattgattgggagttagtagtggatgaataacttgaatattatgaatggtctgaggaacaaaagattaaggcagccacaagttcttttacttcttttgcacctctttgtggagtgatatttgttttgttggtaataaacctggttcttggaatgacttaaaaacaatgatgagagctagatttgtacccgattattatattcgttacttacaaaagaaaatgcaaaatttgaaacaacggaatagaaccgtgagagagtaccaccgggaatttaaaatgtgtatgttgtgcggtggtatagaggagtctagaggagatacaattaaaagatttttacatgggcttgatttcaaaattcagcataggcttgaaaataaaacacatagccatctttttcacttactttttcttgctcgcaatattgaaaatcagattgagaaagaaacaaaaatgcctatgatacatgagaatattcctgtgccttctattgcatctaacatcgtgcaggaaggtaaaaacaattttgaagaaaggaagaatgaagaacctaaattaggtgaagagagcgttttaggtaatttaattgatggtcaactggatcaaggtgagaaagattgtgatatgctacaattgtccactaattatgctatgttagagcaacctctagtggaacagatttctaatttgcctctatcacaagctaaaagttcagattgtgttgatatttgtcacaccctaaaaatcctaaatatataaattgttgtttaattggaattattagaatttattttaaaaagcctagaagagaagatctaattttaattaataaattccaatataaaatggggccagataaaatttcattaaataatttacttaactctataattcctagatttttctgggatttatttgagctaaggaagtatttttaataaatggaattgcatttaatgaataatttaaattgaaaaaggtttttaaagttctcttttggctttgggccgaaagtcggcccaaaaccttctctctctcctggcccagtccgcccgcagccgagccgccggctcgcgagcacgcgtccgcccgctgacaggccgtagtcttcctcgcgccgtcgcccggccgaaccctagcagagccgcgccgccgtctccttccaaatccggccgcccctttctgtttccgatgaaattagtagaggggaaatgatcttcgggatcttctctacctttttccttttggaatcgatcgccaattcggtttggaaatccgtggattcgagttcgattcggatcgatctctctcgtccgaaccatagatttttccttcgcgtcgccggtcgccgtgggccttcgccgccgcctccttgcccctttaaaaggaccctcaagcccgccgctacctgccgccaccctcgccttcgcctctcgtcgccggtagagccctagcgccgtgtagcctagcgccgccgtcgccgccgttcgtccagccgtgcgccgccgccgctccggccgtcgtcgtcgctcgggaaggccgccgtcgtgatcgccaagtcatcgccgacctcgtccgcccctccttcgtcgccgtaggcagccggaagccgcttcttcctcgacgccgtcgccgtccgttgatcttccgccgttgatttggtcaccggtgaattcgccgcgtcgccctctacgtgttggtgtcctccgttcgcgtcgacgccccgtcgttcgccggcgagcttgcgcgcccgagccgccgccggtggtgacgtcaccgctgacatcatcgtcgtcgtttcccgtggcccagtcgtggaccgatggatcttggctatccgttttggatgaatcgatctcggccgttcgtttccgtgagccgccgccgtgcacccggttcaccgtgaaccctagccgttgatgcaataattcccttttccttttcaaaaataattcattattgcgtcataattcaattaaaatctatataagtgttttaaaccgatttaatctttgaaaattcataactaattcatcttagctcggatttagttggttcaagtctctaaatttttctaaaattgagacctacatgttaaaaatatccacatgtactgttcatgcttgtttatgtgctgttttggtgttttgctcctttctgtttagattccgacgtttccggagagtccgttttcgcaggagaagaatttgaagagttccaaggccagcaaggcaagtcacatagatcctaaacaaccctttgagcatgttgatcccgtttaaagctattgtttctattcaactattgcatttattttcgaatgtcattgggtggaattaacctattgtttgttatagcccttttgttcttgattactttattccttgataccttgggttattataacttgatctagttgagctttatatattggttcagctagatattacatgtgattgcttagccatgcttagaaacattagcacactattgggataacttatgactcactattatttcatgatggcttactgatagctcacgatggtcaatcgtgattggttaattaattaatgtgccaactaaaacctgataatggtgggttgtgagcacatggttttgatggtcgtgctcatgacaattaaggaccggttcacgagtttcggttgtgaatcatttaccgtgccaaccacaagccagcgtgggcaacggctttaccttttgtatagcatggttcattgcggagcaccagactgagaagtggcggagataagcccacgggggttcgctggggagtccataccttgtttataagggggtgattatgatccgggagtggtgcactgtggtggattgtgttgtacgagaggtaatgtcacaactcttttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatattagaagatgctataactggtaataatttgattagctcctggtttggaatggtatattcctggtttggagatagatctgtccagccgggtatggttgttcaggatggttggcctgagcagcatgggtgtgctgtttagtgttgattacaattgatgattaattactctcctgttttataattctcaaatgtttgctaaatgctgcttttgcaaatgaacccctactatgccatcctttgttatcctgtgcacttgcatatttgctgcgtggcttgctgagtatgtcatatactcaccttgcaatcattcatcagaggaggagatctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcatgacaagttggtatcagagccaggttgaccctaggttatgccaaatggttacctacaggagccctctaaaaatattggaaaagtagaactgttctcctccctttctcttttaattaaaccaaactaatggcacatggacttcataatctcttttaatggttctcattcaaaaatttattccagtgttattagtactgtacatctattactgtactaatggctcattttatcagtaaatgttttacaatattgttttatttaatcttgctgcaataaaataaatttagcctgttgattttataactttcttttattttatttcttttgaaacctgttgttcaaaagtgcaaaatttgtgatcttgtttccaactgtttcaacttatcttgcaagcttggtttactttatttacttaccttttactttgattttctaactttattcaaattaatccaaaaacttgcgctattaattggataaatgtcttaactccctcctttcacttgtctttagatgccgcgcttcaagcctgagtacttgtttggtgttgagggatttgtccaggagttgcgtacgatgtcctttgtcataagatttgggactgcccctttgtatgcccagattcctcatgatcgtcacgaagagaagtgccgagtcaaagtcaccttgaacagtaatagtgaagatatcccatcagtgatgttcgaagatggaggaggaaactacatccatgcatgtcaggaggtggcaaggatcgccataggagagctccgcgatcgctacagtgatcagttggccgacactgagtatcgctaccatcctcgccaacctcagggaagtgaccgtggcagctaccttgagactgaggggattgagaatgatgctactacaaggcatttggttgagatgctgtgggctatggatgaaacccgcgcggagattgtgctagcagctcaagatcgtgaagaccggaatcgtggtaagatttgcaagctagaggacaaggtggatcgtttggagaaggaactagccgcgttgaagggagaagcaccaccgcagaaggccaggattcgtcttaccgcaaggaagagagctctatttgtccctcgctaccaattagcgccaaaggtccgtgtggtggagaaagaagttaccccagccctagcggatcctccggtcgtcaatgtaagtgatgatgaaggagaagaatcgaagcgcacccattcaaaggtcgagtggggagctactcaagatgatggagacgagccgaacgagccttcaattaactccaatgcccggaagacctagagtgccttgtcaagccgttgtcttagatcgttgtgttagtttgtttgtttaagtttggttgtgtgtgtctcgcatgtgatttacatcagtggtgggatgtaagtgcatgcgtttgtttgcttttgagtgttaggaagttggtgagtttagtggtgtgagagtcttcagttctgtaataatgaaactcagttaagatcaataaaagttaagttagtaaaagaattaattctctgccctaagtagttttccccggtttctcttcttgtgatcctgcccatgccagatggtactcactcgtagcaacgggaatggtcccaacatcaacaataacaacaccaatggagagaatcccacacttgcccaagtcctggctcaacaggcacagcttctgaacatgatgatgcagcaactccagaaccagcagaactagggaaataaccatgcacctccccagaacaagttagcagaatttcttcgtgtgaggccgcccactttctctagcaccactaatcctgttgaagctggtgattggctgcacaccatagagaagaagttggatttgcttcagtgcactgatcaggagaaggtctcatttgcatcacaccagctgcatgcccctgcctttgagtggtgggatctcttccgccttaacagaactactgctgaacctatcacttggcttgaattcaccgctgctttccggaagacgcatataccatcgggagtgatgtctctcaagaagaaggaattca

SEQ ID NO: 75807 - DNA, 39562 bp, Oryza sativa
ttccaccccctcctccgaacacagccttagatgagcacatgatagggtaattactaagaaggtaaaatggttatgaattaagactacgcaggtagttgggagactattgtaaaagactaatgacttttgttgccttctgatttttccttttcagaacagtttgcaaatggaagttagcattatagaacttggaagccatcttgattgtgtggacaaacataccaattccaaagccgtctttttaatctagtatatcatgatgccatggggttatttggcctagcttatttgcatatgtcagaaagaactagggaattgtgttggggggcacaaatagccattttattagttctcttcttttcattgtatagttggcctggcagattttagctgattggctgaaaatatgatcctattgcttcacgctcatgagaaataaagggaccaatttgttgatatgcactgcaaaagtcgatggtcgatgctattcctgacttggtgtagagaatcacggacctctatagtaaactaagtttttgttctaatcattgatcttagtgattctatacggtcaaataattcagtttatactaaccaagcctcattgaaatgcccaaagaattttgtcgccttcttactgacaactggaaggacttaattctgtcatcttgcggtaatattcaaattaaaatgatgaactaaacaaggaattataagaaatcatacatacatattaggagacagaaactttggcatgggaacactatgttcttaagaagtggtccagccttcagaagagctctgatatttcgagttttcaggtaatgcttctttcccactacacctgaacatcaacggtgtgttgtagctgcttcaatcttcagacttttgtatgaagtttcatggtaaacatgtatctagctttcgttccagctgtgcacctctaaagctgtactctgcaaaacatgcatctactcattatattactttgcattgattttcatcaagtgcatgtgctactttaaaatattttctgttaagtcaactgatacgtaaatatccgtgtgaaactataatactctagagtctagtgggaaatattttgtagttaatgtataggtatcagttccaaggggctattactaagttgtatgtattgtgatactctagtagcacctctaggtcctgggcccaactctctatagaagcgaatttcaggtctagttaaaaaaaatcacttgctagccctcgtaaaaaaatgtgttaagaatcgacctattaagggtgggccctcgtataggggacaagggctttaaagcaggattaaggaccgatccatacgacgtgagtccgcgtgttaggggccaggtttcgtggcttttcttagtcggtttggttgaggcttcttcttcttaatgtggggtggtcatgcctccactggtcgagtttttttaataccaagttatatatatgcttattagtaaccaaatctgtgggatgtttgactgtattacagtgaaatactggagaaatctgggagttagtattaatgaggacttgttgctgtggttttctgactatgagctaccacaagaaatgataaatagatatctattattgaatctggagatataatgtgatactaaagcataaatagtactgctgcactgcaccatgcaaggacaagtggtccagtataagaaaacaagattatggccaacagctgcatgaacctccatgtgcagcttcaaaataaccggctgcctttgaatattctactgcttcccctcaacagagtcaacattagccatattgttttggttgcaagttgcagcttgcaacactcatttctcctgagaaacccaaccttcttgcaggtagaggaacaaggagggagatggctggcctgatttcttcaggaatcatcaagtggacggcaagcaagctttcttcactggtttcggcatcacctggagcatcagcatccaatgagcagagttctgcactcagggatgtgaggacgctgcagaggacgatggcgaggatccagcgcacgcttgctaccaccgatgagcacagcatcagagatgcatctgagaggcttcacctgagggagcttcagcagtttgcctacgatgcccaagatgcaatcgatctgtacaagtttgagcttctgcggcgaaggatggatgatccaaacagtcatggagatggcggcagtagccgtaaacgcaagcacaagggggacaagaaggtaccaccagttcttcgatctcctgtgatttttcttttccttttccgtttgattcatcagaaaagttttgcagatttaccattttagtgaaatgcaagcatgtggatggttggtctaattactcatgttaccataggtagacaatattgattcttgaagtatattgacatattccattatctctaacataagaatcatcgataaaaccgttgctagtctgcagctgttgtcatgtcaactacagtgaaataaatgagctaggtaaaaacatgggattgaatgattgtaataatttaatgaagaaattatcaaataaaaaataaatttataaaaaatggttttataaatggttttataaataaaaggcactttctacaagcaacttactagaaaaatattattttctattttttttattcaagtattttatctccaggaacctgaaactgaaccggaggaagtttcaattcctgatgaattggctgttcgggtaagaaaaatcctagaaagatttaaggagatcacaaaggcatgggatgatctccgtctagatgatacagatacaacaatgcaagatgaggaacatagcatgctcccactgcctactaccccatatgttgacgagcccactatctttggtagagatgaagataaggaaaagataatcaaaatgctgctctctgtgggtggtgccaatgaaggagatgtgtcagttcttcccattattggaatgggtggagtaggaaagacagcacttgttcaactagtgtacaatgatcgaaggattctgaacagatttgacttgatgggctgggttcatgtctcagagaattttgatctcaaaagcataatgcgtaaaattatcatgtccttcacgaaaaaaccatgtcagatgacacaaatggatcagctccagtatatgctaatagaacaagttgttggcagaaagttcttgctggttcttgatgatgtgtggaatgagaggaaggatatttgggatgcattattatcagccatgtcacctgcacaatcaagcataatattggtaactacccgcaatacaagtgtgtcaacaatagtccagacaatgcacccctacaatgtgagttgcctaccttttgaggaatcctggcaactattcaagcagatggcctttttgcaccaagatgagagtatgaaaacagattttgaggttattggcagaaaaattgttcagaaatgtgctggcttgcctttagcagtgaaggcaattgccagtgcacttcgctttgaggaaaatgaggagaaatggaatgacatattggagagtgaacaatgggagttaccaacaacagaggatactgtgttaccggcgttaaaattaagctatgatcaaatgccaatccacttaaagcggtgctttgttttcttcgcattattccctaagaggcatgttttcttgaaggaaaatgtggtatatctgtggatatctttgggcttccttaaacggaccagccagacaaaccttgagactattgcaaggtgccttaatgacttgatgcagaggactatggttcagaaaatactatttgatggaggacatgattgcttcaccatgcatgaccttgtacatgatcttgccgcgtccatctcatatgaagatattttgagaatagacactcaacacatgaagtctatgaatgaagcatcaggaagccttaggtatttatctctggttgtgagttcttcagaccatgcgaatttggatttgcgtacattaccagtgtcaggaggtatcaggatatttcaagttgtaaattctatggatgacaatagaagatatttttcatccttcttcaaaaataacagaagatgcttctccaagttgttctcacatcacattaaccttacaattgataatgagctatggagcagttttcggcatttgagaactttagacttaagccgcagctcaatgacagcattgcctgattcaattagaggactgaagttgctcaggtatctaagtattttccaaacaagaatctccaagctcccagaatcaatttgtgacctccttaatttgaagatcttagatgcaagaacaaactttcttgaagagctaccacaaggcattcagaagctggtcaagctccagcatctcaatttagtcctttggtctcccctgtgcatgccaaaaggaattggaaatctgaccaaactacaaaccttgacaaggtatagtgttggaagtggcaattggcactgcaatattgctgaactacattacttagtgaatatccatggtgaattgaccattacaggattaggtagagtgaccaaagttgatgatgctcaaacagccaacctgattaataaagagcatgtgcaaactctaagattagattggtctgatggattctactctagtgaatgtgatcataattctagtcatatagatgtaaaagcaacaccagaattagcagaggaggtatttgagagcttaaagccaactagcaacttggaggagttagaggtagctgactattttgggtacaaatacccaagttggtttggaggttctgcctattcacaattggccaagataactttatggaagcaaggctgcaagttccttccaacacttggccagttacctcagttgcgtaaacttgtagttatacgcatggaggaagtagagagaatcgggcaggagtttcatggcgagaattccacaaatcgattcccagtattggaggaattggagtttgagaacatgccgaaatgggtggagtggactggagtttttgatggtgacttcccttcacttcgtgagctgaaaatcaaggacagcggtgaattgagaacccttccacatcaattatcatcctctttgaaaaaattggtcatcaagaaatgtgaaaagctgacaagactgccaactattcccaacctaacaatcttacttttgatgggcaatcttagcgaagaaatacacaatagtctggattttccaatgctccaaatattaaaagtgtgtttcacgcaaaaacttgtgtgccttgaacttgacaataagaacctaccaatcctggaggcactagctataagtggatgccgggggctattttctgtggtaggattgttcagccttgaatccctcaagcttctaaaaataaaagattgcccaaacctgcagtgccctttacaaccacttcaacagcagcttcagtaatgtattatcacgaactgtcctcaattacaggaatggattgagtggcaacagtctctaatagacaaggaagataaggtaagagctttttttttttatctgtgctttctttgtgccttttgttttttgttttcttcactgaaattgatgtattttatcctcagcagcaaccagaatttgataatgcaagttatgatcaagaggctcttggtgcactgagcgacaatagtgaggatgatgttgaagttttcaatgaagatgaagatgacgatttctatgatgaaatgctagaagttgggcagtcaagcgggacagcaattaatgacgatgatggaagtaacgatgctgtttgaagtatgagagcaatatttttgaacatcacgtgcaaatgattttgtttgcatgtcgttctccaacttcaacttgattaatccaatttgatgtgctacttcctattttttataaaaaaactacagtgcaaaatataccaatttcaggtcgaaaaaaatatgtgacatacattccattagctggatagctatggttttaatgtaggaaaaactgttatataagtgtcttacaaaatatttctgagctcccaatcttgataacaaatgaaaaaaaaactcatagaagtaggaaacatgaaccgtaagtagaagtatttaaaaaacatgtggtttgagctttctaattttatgacaaacttggctaccatcacggatttccagtgctgcctcaaatttccctttggttcagttgcatttctcggataaacaagttttcttgttagcgacaattgcatattttttattaataatttcatatttttgcaactaattgattgtcactatcactattcatgcatcatgtttatgcgtctgcaggactgcaattcgtccagttgtccatctatggtgacaaattgcaattgtctagagcaagacagggtagtaaaaaggtacagctatttcacgcgtaccccaagttgaatgtgtgtatgcaaccttggttgaatgatcgttagttatgaaccatacggcagctaagatccagatttagccgtttggttaaatatcgatccaattatatgcattgaggcagtaccagatacataaggcgttaatttctcaattatcaggaacgaagaaattggaggaaacaaattaaaggttaaagacatcaccatcaactttaacaaaaaaatcatctttgcataagcatctactacatccagcagcatgaacatatagtgtttaaggtatcggacatggaagatacttaaatactaagccaaacggttcatatttcaaaattcagctaacacctcaaacggtttcactaatcatgcagatcacacttcatgccagatgttcacttcttatacttctttggtgccctgcatcattacgaagttgcagacgataaaactttatgaaaacaagcatacatatttgcaaatggatggttcaatgctacttacgccgcagtttgagcaggcactgctggagcagctggctctcttgggccctgtttgtcatcataaaagtattaaaaacacatggccagcaaataatcaaatatgaacaagccaggcaaatatgctttaccatggaacatcttcaaaaaattaatcatgatttgacaagcttattgtaacatgaatgacgtcccagtgtcatttaacatgaatgagttgacagcattgctttactagcatttttttatttggtggaataagatatatttcaatattgaaatgcaaatgctaacacattagatattccaatgaaaaaaaaaaaactataaccatagaaatcgtctcacctgagccaacctctcgtcacgcctggcaatcttcctctcacgactggccttgctcttggcacgcttagcctcaaactggtcagagagtgtcttctctcttgccttctcagccttagacttgtggatactttccatgagaacacgcttgttcttgaacatgttacccttgaccttcatgtacatgtcatgatacatgtgcttgtcaatcttcttggcctcacgatacttgcgcagcaaacgcctgagcacacgcatcctcctcatccacaggatcttggtggggagcctagcctccctggtacccctacgcttacctgcaaaatggcagaataaggaatacgcagagacattttcacactaaaataacaatgaacttaattgtacacaacgcaccatagccagagtgacgtcccttctgcttggcctcatgggctctccgtgcacgggacctggagtgaatcttctggggcttcttgataatgaacccatccttgaccaacttacggatgttctgacctgcaagcacaaaggaaaaaaaatcagatagccttccaagaatttcaggcatgtgatatgagtcacagatatatacagggcaacaaacttcagtatctagaacagtaaataattaataggatattttattggttcttgcaggaaatgagttgtgacctattccaataggacattacacaaactcgcttgcagataagctacaccataattcatacgctcagacaggatcataccacagttgtacaaatggtgatgcagaatcaaaatgaaccaatgagctttagaagttggaattgcaattgcaaaactgacaaaaaactgatcctttaatggtaatcatcatttgggcatgaattgccagcatcctaactgatttaggtaacgaataactcaacgaagaagcacaaatgcacatgcatatctaaatgcgccaggcatccccttgtctctttgtatattaatcactatagaggacagttagtcacattcccagaacagcgccttggattagaacccctaacgacaaccttgatcaatcggtaacaacactgcatggtccaatctagatagcatacactccaaggtcaatatactggccatttctctaatgttctcttccaaacaaatacacccagcacaacaacctaacaactcctatagaactgggagcacgcgattcccacgaagcaataaaatattcctaccagaatcgccgggggcaaaaattttcgcgcggattagcagcatggcttcagatctaagcaaatcacgcatcaacaccacacaagtagcaggcacagaacatcatacggtagggcaaggggagggttatgggggggagggacgaggaggggagttctcacgggagttggccatggagatctcgttgacctcattggggtcgagccagaccttgcccttgccgcatttgagcacgctggaggcgagccgcttctgcagcttgagggaaaccatcgccgccgccgccgccggcttcttacctgtgtggagtgtgtggtgaggggggtgcaagggttggccgcgtgcggcgccgggggtttatatagtgagaggggctagggtttcagcccgagcggggagactcatgggccttgggcccatcagtgtgttggggtttgcagcgggaataagttcactttatgaccctcaaatgtccacgaccttaaattacaaaatcggatatctcgacccccaaactcctaaaaccggtgcatttgactccctggaccgttttgggaggcggttttgctgatgtggcgccgtgcggtgcctacgtggcaatattgaccgagttttcggtccacgtagcgttgacgtagcacctacgtggcggtagaattaaaaaatatgcatgggacccattagtcattcacacaaaaagaaacatgggcccactaacatatgggacctatatcctcaagaactcatgtcgacgatactgtggggacgagggctactagttcctaccgcacgatcggaactgtggcatgctaaataggcgcggctcttacccccagatgggccaagtttgacaagtactccctccttcaaaaaaaaaaaaagacaaaccctgggtttgcgtgtccaactttgactgtccgtcttatatgaaatttttttataattcgtatttttattgttgttagatgataaaacatgattaacactttgtgcgtgacttgtctttttaatttttttcataatttttttaaataagacggacgtcaaatattgggcacgaaaattagggtttgtctttttttgggacggatggagtagtactgctgactttgttagtttgtgctttaatattagcaaaaaagtgtggtctgtggtgtattgcatgggctgttcctaaacatgcatgcacctaattaatctaaatgtactgtgtgggtggatcatttatttgctggtctgatagtttgtttagttcaaaaatgtatctttttttcccttccgataacgtttcgatgcacctttttgattacgattgtcgacgggtgatacccgtagaccggatatagagggtattggggtacgctggtacaaggatctacgtagtacgacatcgagtaatcaaaagacaagaattatactggttcaggccccttgataggtaatagccctaatccagttgatatgggattatatggtggaaaacacaggttacaaaggaaagatggaacttgtcgaatccggcgagattgtagtcgagttgattcgactagctcttgacgacgtggcccctcgcaggctccggcttcgtaggctgtgtgggttgtgttggctctgagattcgatcctctatgccctccccaggggtcccttttatatcgcaggtctggtggtctccgagtaggactcgaacacaccagacccagacccagctcaatacgtaggtaacccagttcttatccgagaaggactcttcccgtctattgatttcgtgaaaggtttccttagatcataaaggaaatatccgcatacgcgtgggtatgccatgtcgatacgtaacgtatatcgaagggtagagggtatgcctgacccgtaaccctgacagtagctcccgacttctgctcaaaatgaactcgtgcgaccattcgcgacttcgggtgtcgagaacgttatcattccaggtacgagaaccacggagatgacgtgtagtcgaacatgccgtttgaagcccaacggtcacgagtgaattttgaacttaagtcaaaaactgccgcgcgtaatggacctagaaatttccggcggggatttctctcagttccttggaattcgcaccgtcgggggtgcgcctatttaaagggattttgggtgcgcattttgaagtccgcccactccatcaagcacacaccgcccgttagcgctcctcgccttctccactgccgtaaagaaccctagcttcgtcagctttaggtccatctctggcgatcttccagcagcgatggatctcggcaagtcggcttccaccagcgcgaccctgaagaagctccaggaggatggcgcccttcctggccgtgaaaacgcggagagggaagcaggaggtacaaatcctcagcccatcttaggtcgcatggttgtgatcgaagattatgttgtctgcgggtttctctcttcaccctccgaattccttctgctggttttgaatttctatgggctttctcttctgcacttgaaccccaattccattgctttccttagtgtctttgtgcatctttgcgaggcctacattggggtagagccctttcttgatctgttccgcttttattacgagttgcgctggatggaacccaatagggtgtctggttgcgtcgggttccgacttcgtgacgggatgaagtcgcgctatgtccccttccagtgtccctcttctcgtagtaaatggcggaacaggtggttttaccttgaaatcaaggattcaaatccgatcctcgttgttcccgaggaacaacaagattctggtctggaccgccaagccccccttgaccccctctctccaatcgtttatcgacatcatcgatgatctccgagaacggggcttatcgggatatgaagtcgttgcagacttcgtcgataggcgaatccagccgctccaggctcgggcccacccggcctataactattccgggccagatgacgcgacccgggtttctcctcggggtatctttctcgcattcattttgatatgcttgtactcgcgttccttttcgacttatcaaaaattgattccttcttgacaggtctgagcagcgaagccgtggagcggcgtgttggtcaggtgatgatcagcggcccgactacggcgagcgacatccccgcacccttttgtgaaaggggagtgacggagcacgacgaagcaatcaatgtgagttcattcgataagcgtccgccttctttgctcaaaatcagcttatgacatgatttagtgtaggcccttcctttgactgatgtcgtcggtccgctcgcggatcatcaggtggcggcatctctgaaagagaaggtcgtcaaggtggcgtctgacgctgccaccactagtggtggcaaagctccgactaaggcgaggaaattctcgtctgtgctcggacaccgccgcaaggcggcgactccctcagtaattttcaccttgtcgtcaggttatgtagcaaggaaggtttgttctcactctatgttggttgttttgtaggcttccgacgtgtctcctccgcctgcgcgacgtaagcgcattgtgacgatcggcgagaagtaagtaaagaaacttttagattctcgtgtcttctgtttgagtggaattttgattcatggcggtttatagggaggcgcgggcgaacgttgctcgggccaagtccgggggaacgtctagcgcgtcccctgtcacggcgtcaacagatgtcgtgcccgtggtcgggagtcgggaggcgacgccaagcggccccgtcagcgatcccgctgggggtcgtggtctgccagaggccgtcctcacctgggaggagctccaagtcgaaatggggcgccttctcgaagccggtgctcgcggcatcggccgcgagatctcagaggcgagggcggagacggcggcggccaacgcgcgtgccgagcgcttggtgcgggaactggctgaggcccgcgaggacctcacgaagatgagggagctggtggccggcaacgagcgccagcgcaaggggctcgaggaccgcatgtcggaactcggggataacctctccgagatccgtggttcgctgcgggtcacctacaccggtctccaccagcttgccgaggagtgcggcatcaagtccacgatcccggcgaaccccgacgagttctcgttgacctcttctcttgcggagctggcgacggcgatggggaaatcccctccaagcatacggccaggatcgcggaggagacgtccaacggcatctataccggggcgtgtcatgtcctcgcgtgtgtgaggttgtcgcgtcctgaactcgatatgcgcgagatcttggatcagggggcggcaagcgacacgcgtaagaaggtgatggaagaagtcgatgacctgggggagtctgtcctccccctttttgaagagtaggacttcttgtattttttgtgacttgtaaatcttgaactctggttgccttcgtgcgtgtgattatcatccttgttcaccgttgatctcggaagttttttcttgtcgactgtagagatgctgatgacgaggatgtccagcagcgcgggcagcccgagtcactggcgataattccggtattcgagtttgaaccacacgtcccacatgacgtcgaggaccaaactcttgatgcggaggtcgaagtgactacaactgcctcaagtgagtagccattctaccttcgagttctacctttgtgttgttttggggatttccagcttgtcttagtggtcgttatgtttagcagatctcaaggatgcccttgcgacccaagatcgtcgtatccaatactggaagacgaaatttgaagtggtggaactcgagagaatcatgctatccgtgaagaaagagcaagccgtggaaacgctccgaggccgcgaggtgtggtttgggtcatacttgaagaattgttgcacctcgatggctagggtatgcagggagcttcgagtagtccgcggcgatcctgaagaatcggcggccgggtacatctcgtggctcaacggggcctgtgcccaactcgatggcatcggcaagcgaatcgacgaagccttgaagcaagagtgtcatcttgcgagccgatatttcggaggacatgtgttagcttgcctgcgagatcaccgcccacgcctggatctcgaattcctccgtgaaggtttttcttgttctcggaggaatccggcggagatagaccaccttgcgaggtcgatgtcgccgttggccgagaagattttccagtcaatggactggcattggctttcttggtagtatttgtaccctgcgaccagatatcttaggggaagatgtaatgcagcgaaatatttatgtacaaactgtaagaaatattttgtgaataaagaaatctatctttaacaaatgtttcttactctggatgtcgtgtgtatgagtgtgttctcagttaatgactttagttagccgtttgagtcgtacactctccctagcccccagctttgtcgtcggaggaattttctcggaggacaaggctcttggacccttgacctgtcttggttgaataagctctgatcctagcacccagccgtgaagttggaaagctcggtttccgattacacgacttggttaatacgcacggcgagaactcttacacgaccagatcttacatggtctttcgtctctaaaggatctgacaaggccttatcggctctaggcgtccccagtcgaagatcccttaggttcctcggaggccttgtcaagacggcgtaaagggacataaggacaggtttcaacgctaggtgtcgtcagagtaagggatcattgggtgaaaacactttggtcgtgacatgtgacttagaaataggctttattgatactgtaagggtgcttacaggtacagtggtattgactcatacatagaatttacgtagttggtcaatgttccacgaatttgctagttcgcgatcgtcgccgtctgcgattttgaatgcgcctggccgcaagacttgtgtgatcgtgtagggtccttcccattttggtgagagtttgttttgccctgcttgggtttgaactcgtctgaggacatagtcgccgatcgaaagtatgcatgctcggatgcgcttctcgtgataacggcggagggcttgttgatagctagctgctcgaacggcaactcgctcacgatgctcctcgagaaggtttacatcgatgtctcgctgtttctcctggttctcgtcggaatgcttctgtactcgtgtactttgatgtcgtaactcgccggggaacatggcttcagagccgtacacgaggaagaagggtgtttccttattggatgttgtcagtgtggtgtgcatggcccatagtactgatgggagttcttcaacccattttttgtcgtgtgacatgagtctgtcgtagacgcgggtttttatcccttgtagtactatgccgtttgccctttcgacttgtccattgctttgagggtgagagaccgaggcgaaacatattttgactcccaagccgatgcagtaatcctggaaatcggcgctgatgaattgagggccgttgttagttatgatgcggtgcggtagtccgtatctgcataatatacctctgatgaacttgatggcgttatcggccttgatttccccagtgggtactgcttcgatccatttggtgaatttgtcgattgctacaaataggaatctgtagccgccctgtcctcgtgggaatggcccaagtatgtctagcccccagcacgagaacggccaagtcagagggattgtctggagtgcttgtgcaggtagctttgtgtgcttgctgtggaattgacaggcttcacatcgctggactatgtcgcatgcatctttaaggtcggttggccagaaaaacccttgtcgaaaggctttgccgaccaatgtccgaccggcggcgtgtgacccgcatatgccttcatgtatgtcgaggaggagttgtctgccgtcgtcggtggagacgcatttgagaagtatcccgtttggcgcttttttgtataaatcgttgccgaccatacagtagatctttgctttacgggttattttctcggcctctgtatcgtcctcgggcaactcctcgctgctgatgaatttgattaatgggatgcgccagtcatctgtggtttcaatgtcagcaacggcgcgttctgcctcggtgacctccaagctgatgtcgggggtactcgggccaacttcaccgctaacttcttttaccgatggctttgtcaggacgtcgagaaaggtgccgggttcgagcggttctcgtctggatgcacgtcgtgctaggtcgtctggctcgatgttgtccttgcgatagacgtgtcggacctcgatcccgtcgaacctcttctcgagcttcctgacttctgcgaggtacttggataactcggggttggtgcatttgtagtctttgtgcacctggtttgcgattagctcagagtcccctttgacgattagtcgcttggccccaagtgcggctgcagctcgtatcccggcaagtagtccttcgtattctgcagtgttattggttgccctgaagttaaggtggattgcgtgcttgaattgatctccggagagagatgtcaagataaatcctgcccttgctccttggctgttgagtgcgccatcgaacgccattgtccatgtctcattgtcaccttggttgtctgacttattatctggcatggtccaatcggccacgaagtcggcgagtatctgagatttgatggctgttcgcggcacaaagtggatatcaaattggcttagctcgactacccatttcgcgatgcggccgacaacgtctttgtttctcacaacttcgccaagggggaaggaggagacaactgtgactctgtgggcttgaaagtagtggcgtagcttccttgatgtcatgatgactgcgtagagcagtttttgaatatgtggatatcttgtctttgcgtcatggagagcttcgctgacgtaataaactggtcgctgtattttctctgtctcgacaacaatgacggtgctaacggaatatggcgtggcggtaatataaaggaataattcttcattaggttggggagcaacgagtacaggggggtttgataggtagcgcttgagtgcaataaatgcctcttcggcttcctgtgtccatacaaatttgtcttgtttcttcaataaggcgaagaaaggctgtcctcgttctcccatcctagcgacgaatctgcttaatgctgcgatgcatccggttagcttctgcacctccttgagtcatgtgggcggcttcatgttctcgattgctttgatcttctcgggattcgcctatattcctctgccagaaacaaggaatccgagtagcttgcccgacggtacttcgaacgtgcacttctctagattgagcatgaggcgatatcgtccgaggttgtcgaacgtttcccgcaggtcgtcaatcaatgagtcacttgtcttggttttgacaacgatgtcgtcgacgtaagcctcgacattgttgccaagctggttgctaagtgcgccctggaccgtacgctggaaagtattcccggtggttatcagtccgaaaggcatcttaacgtagcaaaataccccgaacggcgtgatgaacactgtcttctcttcgttctcttttgccatgctgatttggtggtagccagagtaagcgtcgaggaagcttagaagctcgcaaccggctgttgaatccaccaactgatctattcgagggagaggaaagtgatccttggggcatgccttgttgaggtctgtgaagtcgacacacattctccattttccgttggccttccgcaccataactgggttggctagccactctgggtgaagtacttctctaatgaagccagctttcaaaagtttgtcgagctcttcttgtatggcttgttttcggtctggtgcaaatctccgcagtctttgctttactagcttggcatcgggtcgcaccataagtttgtgctcaatcacctccctggggacccccggcatgtcgcacggctgccaagcgaacacgtcggcattatcgcggaggaatgtgatgaacgcgagttcctatttctcatctagtgtagtcccgattttgatagtcttgtcggggttagcactagagagcggaacgatcttgatggtgccgtctggctttggcgtcttatttggcttgctcactttcttaggtggctcagacgtggcgggtggggtgggcgtttgctcgaccatgtcgaggctccgcttgtcgcactgcaccgccagctttgcgttcccctaaatagtgattgttcccttcggtcccagcatcttgagcacttgatatgcgtagtgggatgtggccatgaacttcacaagtgcagttctcccgatgatggcgttataagctgtatcgaattcagcgacatcgaaggtgatcagggtgcagccccctgccacgtcgaacagacttcacgttccactttcttgtattctcgcttggaggagtacgttgtggaaccaccgaatatgtgtgagacgtggaggtcggagtctgggtacgcagaatccgattcgtgaggaggtgtctccttgttcttctcaacaacgcgtactcgcttgcctttttcaaacgccatgtgcttctcgagcgactttttgaaaacaaggcaatcctccagagaatgtctgtccgttttgtgtatggggcaccatgatttctttgtatcgctgccctgtcggtctgggcgcttgggagggttcgcgtattctgctgcgaggacttccgcttgagctttccttttcccgtttttgcgatttttcttcttgcttgactcagatgcgtctgcggatagtttcttctctcccccagtcttcggcttgtcgttcttgcgtcttagcgcgtcatccacatgggctcaccgctcaacgatctcgaataatcttcgagtagttgtgatgcgtcttgtcgccaactcctgggtagtgtagcgatctctgacaccagacttgaaggcgagaattacagaagcgtcggtaatctcgggaattgtgtttctgcactcgttgaagtgccgaacgtattccctcaatgattcccccgagttctgtgttaacgcatgtaagtcgtcttagatcgcgtggcgcttgtatgttccttggaaattggcgacgaactgttgccacaggtctgcccacgaggagattgagtagggaggaagatgcatcagccatgaacgcgcagaaccctttaacgcggatggtaaatagttcgccaacgcgttgtcatctgctccggcagcataaagcactgtcgagtagacttgaaggaattcttctgggtcggtgctcccatcataattttcaatggctctgggtcggaatctctcaggccatcggacatcacatagggaacgaccgaaagccctacacccagcactgggggcggtggtttgtcggcggtcgcgtgaccttcgtggatgtctgtccaacgatgaagaggacgcggatgatgacgatgacgatgggtcgcttggttctggcgtacgattacgaggatgacgacctggatcccgggcatcctgtcgttgtctctcgctgttgtctcggcgccgatcgccttcgtcgtcgtcgttgcggcgacggccatgaccagtattgtctggcccccgccgttcgcgatcgttgtagtctcggtcctcgtttgggcgatttcctcgatcatggcgtcgtgaagagacatgacgccgggagcgatttgcgtcgtcccatgtgcgtcgtgcttctcggcgatcattgatttgatctcgaagatctccaatgccacgaggtggaggggtagcctgtcgaggtaattccctccgctccggatctttaccattggtgtcgccgatcggtggctgatcttggtgtgctgcggtagcggcttcttcgaacgcattgctgaggttggtcaccgactcccgtaatcgttccgtccaacgctcgaggtcgtcgttcagaacgggatcgtaaggagtttccctctgtatggcttgaacaaccctgatgtgctgggctggagtagtcgattgatttgccgcctctgcattggcttgtgctgacgtgccaacgtcatcgatagccaatacctcccgcgacgcacttgttgtcgatgacccacagtcttcgaggagatgtaagaccgatggttcgtgggggtcgagatcgattaccccaacgaatcgatctgaggctggagtcgctccttgttccttgccgttatccctaacggggacgtatgacttaggagacggagttttcacggcgccgaggagaactttgcagctcgagaggtcgtgattctttgtcttgtggataggacaatagacatcccgagttagagaagtacgctgaattccgcgttctttgcaggcgcgaatttcagcacggacattgatgaatacctagcaatcttgaagggtatgtttcttggttttgtggataggacacaaagaccagataacttcggaagtcatctttgttggcccgtggtttatgtcggagggacaagacttggccgcatcagaatccttcacgagtttggatgtagtcgataatccgttctctgtttcaacgggtggatttttcgacatggagccgtcctggttcatagccactgcgttctcgtttccagtcattggaggaccggttgagatcggcatcgtggtgtaaaccgggaagacgatttcgccgacttgagtccataccagcattattgaagctgagagtgcttgactggagctggtgttgacgttgttgtcgacgaagcttgatggcatagtagtagaaccttgagtaccaagtgcccctacctggcgcgccactgtacgtagactggatatagagggtattggggtacgctggtacaaggatctacgtagtacgacatcaagtaatcaaaagacaagaattatactggttcaggccccttgacaggtaatagccctaatccatttgatatgggattatatggtggaaaacacaggttacaaaggaaagatggaacttgtcgaatccggcgagattaaagtcgagttgattcgactagctcttgacgacgtggcccctcgcaggctccggcttcgtaggctgtgtgggttgtgttggctctgagattcgatcctctatgccctccccggggggtcccttttatatcgcaggtctggtggtctccgagtaggactcgaacacaccagacccagctcaatacgtaggtaacccagttcttatccgagaaggactcttcccgtctattgatttcgtgaaaggtttccttagatcataaaggaaatatccgcgtacgcgtgggtatgccatgttgatacgtaacgtatatcgaagggtagagggtatgcctgacccgtaaccctgacaacgattgagatttagtcatcgacgagtgagagccgcattgtcacaccctgaagttctcctcccaaacctaaattgaatttataaatggtcccaagaaaatatcggtgtaaaagcaagagtaaaccctaataaaccaatgcaaataataatcggaattggcatgtggaatttttcttgagttctacatgtcgaaatttactaacaagatttttagtggaattttcagagccctagaaataattttaaccaattaaaattgagcacatgcaatttttaatcccaggaaaaaccctttcttccttttctttttcttttccctcctttttcctcttcttgggccgtcggcccagtccaccccaccgccgcgcgcgcccttttccttcttgggccggcccatgcgcccctccctcctctctctaggacgccgacaggtgggccccacctgtcggggtcatccccttcctccggccgcccgccccacgacggcaacagccgccgaaaccgccgcgcccaccccctccgctcctcccgcgccctctccgccccactccgcgcgctgcgcccatgtcaccgcctctccctgcgtctcccgccctcgcgcgccccaaaaatgggcgggattcgacttcgaatcccgccactctctctctctctccccacctccaacttcccccactaactcctgcgaaatcgagccactcccggctgttcccgacctctccgcccctatataattcgtccccgcgtcctcctccacattttccttttttccaccggcctctcccgtgctccccatcgctcccacaccgcgctcccacccgccgtcgcctttttcgttgctccggccgcctctagccgccgttagggtcgccaccgcaccgcgccgtcgccgccgtcgggttcgcgaggccgagctccacctcgtccacccctcctccgccgagttccgccatcggaggccgcttcggtcgtgcgccagtgagtctctccataaccgccgccatcggccacggtttccgctcgccgtggactccctctctccctctaatctctctatttccctctcttagggtgtctcggaggtcatcgccgttcaccgtcgttccccggtcgtcgccatcgccgttcgccgtcgtccttccccgcaccggccaactcacggtgaggcatccctcctcctcttttcccctccctctccctcctagccgagccgggtcgagccgccgcttcggccatgcgccgccgccttcgcgccgccgtcttccgccgccggttgccgtcgccagcgacgcgcgcgccgccgcccttgccatggcaggccggccggcttgatgccgggccaggccggcgtctcgcccccccttggagccgcgcccgtggggcctgcttgttagccgcaccccctcccgccttgtgtctctgccagtggggcccacgtgccggcgccccttcctctctctcccgagccgctgacccatggggcccgcatgtcggcgccgcccgcttcccgtgatgacgtcagccctgggatgctttattgcgcaataattcattaaggacttttcttttctagtaaaaacacagagaatcttcttaaaatcataactaattcatccgagctccgtttaagtccattcaagtctcagtaaatcaagaaaaatgtgtagaatccattaaaaatggttttgttctttgtttcagtagtcttatagcctgtttgtattgtttgccttgtatgtcgcttagattccggctctcctgacgctccggtgtactttgagatagtcgccgaggttcctccagcagcagagcaaggcaagtcatgcttgtcacttgaacatgttgatcctatattgcaaatgttctaatgttttccatcaaatactgcattgttttacagtaatactatgagatgtttacctactgttacagccatgctattttggtaccatgctcctttgttagcttgggatataacatgactagatattggactagggattgcttagccatgcttagttcaactagcacacaatggggaaaatcctattaatgtatagactgtaggttctaatggtaatgttggattaatgccaccgcttcggtgtgggtcaattaaaataaatcacatggtgggctgtgggtgcatggttttgttggttgtcacgccctaaaaatcaactaaattaaaaatacattgtttaaatcatttttagaaattattttaaaagcctacaagctaaaccctaattatctaggaaaattttcaacataaaattgagctagataaaattttattaaatactttgcttgttcctctattttctagaattttctgggaattgtttgagcaagggaagtatttttaataaatgaaacaacatttcacaaattatttttaagtaaaaagttccaaaactcctccctgaagccgttgggccattttggcccaacatccctcccacatcccgtggccgagccggcccatccggcccaacccgccaccaccgcccctccctcgcgtggaggccgacaggtggggcccacctgtcggtggtgtctcctacctccggccggctgcaagccgagcccgagccggccgagccgccgccttctgcctccgtttccgccccgatctctccacccctagtccggatttttgaggggtttttatccccacatcttcctctatctttcccctcaagaatcggagcaaatggttgagtatcttgcccgaatcgaactcgttttcgagtttatctccaaaaccgagtttttgattttcccgagtcgatttcttgcgggaggagtccgatctcttcaatccaaggctataaataggaccccctagtcctcctctttcgtttgccccaactcccgtcctttcccgtgctccgtagctccgtcgccactgccgcctagcaagccacccgccgccggccggactccggttgcgccgccgcgccgcctccgccgtcgccgtcgcttgccgtcgccgccgctggtttcgccaagaggtggggaagctcggccgcctcctccccttcgccgccggccgccgtagcctcgtcgccgccagtcaacccgagccgccgccgccgccttctcgacgccggctatcgtcggtggtcgttcggtgtgttggtaagtaccgtcgcgttcgtctcgtcgttctctacgtgtagatgccctccaaagttccggccgaccgccctagctccggcgaggtcgtcaattcgggccggccaccattgatgacgtcatcgtgacatcatcatcttttctttttcccgtttttctaatagattaaaacttcagaaaatcataactaaataaccgtagatccgtttcaggtagttcaagttgctaaatttttctaaaatcaagatctacatgttaaaaatatccacatgtactgtgtatgcttgtttttgtactgttttgttaatttttgtttaattgctttagtttccgacgttccggaggagagcgtttccgttgaggaaggttccgaagcgtttgcggaagcccaaggcaagtcacacagatcccaaacaaccctttgaacatgttgaacccatttaaagctattattttatttcagctatgcattgttttcgaatgtcatcgggtggtaaacctttcccaattaattaatggccgaagatgatcttattttcctataggttataatttgattagcatgaaccttatatgttggattggttcagctaaatgctatatgcaagtttgcttagccatgcttagaaacgttagctaactaaagggattaattataaactatgttacattattattttaattatggttacattaaatggtagctcacgatggttaatcgtgtgatgttaattaattgatgattaaaacctggttaaggtgggttgtgagcatatggttttgatggttgtgctcatgacaattaaggaccggttcgcgagctactgttgtaaaacttttaccgtgccaaccacaagccagcgtgggcaacggctttatcttttgtatagcatgattcattatagtgcgccagactgtgaagcggcgagaagtccgtgggggtcgctggggagtccattgcctctggttttgagggggagattatgatccaggaacggtgcactgtggtgagttgtgttgtgcaaggggtattgtcacagttcttttccgaggtatcgtggtggtactaaggcgcatggtaacatgttgtgggattgtgtcttgtgggtacagtggtacacctctgatcagagtttaatctattcgaatagccgtacccgcggttatgggtgagttgagcaatgtttttcgtgattagtcgcactactcattaatggtaataatgtggtaattaatttgactcctggtttggaatggataattcctggtttggaggtttaatttgttcaactggggttggttgttcaaatgtggttgggcctatgcaacatgggtgtgttgtatggtgtttatttaatattgattcattatacaactgttttactattctcttaaatatttgttaaatgctgttatgcaaatgagctatattatgccatcctttgttatcctatgcacttgcatatttgctgtgtggcttgttgagtatgtcatatgctcattcttgcaatattcaatcatcagaagaggagtatttcagcgaaggtgatgatctgaaggattgagcttgttctggttaagatgcctgtggagtggagtcgccatagctgttccgtagtttgttatagttttatttttccgctgcgtagaatgttattctttgagaggaactatctacctctgtaataatttattatttgcgaatattaaatagttatttatttgtactctattatcaatttgttattgtgtgcctcggttgattcctggacgagggtttaacacacatgtaagcgtttggaattttggatagaaattccgggcgtgacattggtcgcgcccatggcagttaaggaccggttcgcaggatgccctggaagaacttatcgtacttaccacaagccaacgtgggcaacggctgggcttatagtgtagctttcctctagttgacgcatccaggcaagggtgggcgtgatggagcggggcgggccctgcgacggcctctgtcgcttccggattcacctaggcacgagaggggactgcccgttgcccgctggggacgggggtgaaacttgaggtgtggtgtgcttagctagagggggttatgcgaagggtcctgtcacagtctctttctggtatgtcgtggtggcatgtcggcgcacagaaacgtgttgtggggctgtgtcttgtgggtacagttgtacacctctgatcagagtaaaactattcgaatagccgtgcccgcggttatgggcggtcaaccagattcaccgtgattagtctcaccctagtttagtctaatggaattagatagtataggtggatggttgggcctgtggcaacgtggtatagcgttggacagtggatgattaatattgattaattgttacaactgttttactgttctcaacttctgtttataaatgcccgttttacgcaaataaaccagtatagctatcccttgataattccctgcatcatacccctattccggtatgacttgctgagtacagtgggtagtactcagtcttgctctatttttccccaaaccctagagtatgagtatgcgtcagatggtggtttctccgaggagtaggcttcgtccgtgccgtcgaggatgcctgtggggtggtgttcccgctgcagatctagtcaaggcttagccccttttatcttttgtttttccgctgcatttatgtaagacttttataatgtttgtaagacgtggatctgtatgtcaactttgtcgcttgtgtaccccagccagtcctggacggggattttaatgcacattctgcttggaattctattcgggaatttctgggcgtgacacgcatgggagaggtgtgtgcaaagctagggccacctatcggcacggaaaagaagcgtcgtaggggcgtgggatcggatggtgactttgcctgtccaagtagacatttaccaccttttagttgtagtgaccttttagttgcagtgacagagattttgactgttgcgcctcgtgagccatgtgggccacacccatcacccacccgcacgcactcgatcgattaaccacccaaacaacgccaatgcaagcagctcgttcccaagttgccacaacacaccatgcatcttcgagttcgactcgcgggcgcacttgtggagattatgggtaccccatacccacacggcacggttatccgactagttataggggataacttatatatatgaaatatgtaacagatcatgacttgggtattacgtttccttgtatattacggaacggcctaaagtcctggtttgataagattgtaaagtagatttaggaaaccgataccgtattggataaggtttctatcttgtaatcatgtcccccatcctatataaggtgggcaggaggccctctagggggcatgagacaattagatcgtcagatctatactacactcggcggattcaaatccccaaacaggagtagggtattacctctcattgagagggcctgaacctgtctaaatccttgtctctgcatccatatacttttaggtttcgtgcgctaccccgttttattattgccgaattcatgttttgacagctggcgcgccaggcaggggatgcgtcgagtttcccgtcgacgagtgcgatggaatcaattcaagcattgagattaatctcaacgagttcgacgactccaaatgttaatcggtttgtcgtttcaatatattgttatcagattgatctataatcacaattgattttctgttgtttttcctctctggttacatgtgccgccgcgctgtgaattcttctgatcactgcgggttgaaaaaaacataagccatggggaaaacggccggagttacgcggggtcatcagatcggttctgtccatgcaagcacgggatcaatcaactgaattaatatgaatggcttttgcacctatctatgcaaatatgcatctacgttacatgcatatacagtataagaaacatatatttctgtgtactttgccattgctaatcagattgatttgtctggttgcatgtgttatcggagctgtcatcggattcttctgagttatggccacgcgtgaacgcggctatgccacctcgtcacccgagttcgtttcccatcatctgaaccctccggctagaatttaatccagactcgggtcaatgatttacacacgcatggcagcagcatggatcggtccaatgacatgcacgcatccgggaagaccaatcttggcgagttcaacgatttaatctcgacttcgccgggttttttcctttcaacttattgttgtttattagattgatctctaaatatcagattaatctcttggtattttctgatgtttacatgtaataccgcggcactactgttgccgactggtgccttcgtcctcatggctggcctgctatgccgctgctgacgggcgtattgatcttcaccgaccggtagcctccgtcgccgccgactggtgtcctcgcctatatggttggttggtcacaccaccgttcatgggcgtccacatcttcaccgaccggctggccttcgccgccgccgactggtgtttccgcctgcacggctggcctattatgccgccgttgttgggcgtctacgacttcaccgccggcctgcctccgtcgccgccgactggtgccctcgcctatacggttggttggtcataccaccgttcatgggcgtccacgtcttcaccggccggttggccttcgccgccgccgacaggtgtctccgcctacacggctggcctattatgccgccgttggtggacatcttcgctttcaccatcgaccgccttcgttgccgccgactggtgtcttcattgttattgatggacgacttttttcccacattggccacctctgccatcaccaaggggaatattacaaagctaagtcatcattgttttattccttatatgatattttccttttcctctgcctcactacttcaactggttcgctgttgactagtgagtcggaggctacagatgttatatcatatttttcaacatttttcataatatttatcctgattggttgcaaaatactccgagttcaaataaagtgcctatcgagttatggagttctatcttcctatgccttccatttggtttgtcgatggatagttgcctttgggccgattcctagcacccgggggctcgttggatggaccaagtaacgcaaggtgctaaatattattcggaataaatcaaaagcatagagataagataaatctattttctgctctctacaattgcaaaagtacccgagtagtaaattctgattcgtgaaactttgttccattaatgacgaactcatgtcactcatatgcatgtttgggaagtgcctaggccgactcccgatgctcgggggctatgactagtcggacagagtgtttaaacgtacggagtcatctgctcggggaaatcaaaattgagtagaggagaaatacatatttataaatattttaaaatacttgaatttttctcgagtattatatttatatcagatactactcatcctatatgtttgttttacaggatccagatccagatatgcataaaagggattcatggctttaagcttatctcttacgcttcaggaatgggatcagtcagaacatcaccaccggcttgctttcgccgccgccgactggtgtcaccgcctgcacggctggcctattatgccgctgttgttgggtgtctacgtcttcactgaccggcttgccctcgtccgccgccgactggtgtttccgcctgcacggctggcctattatgccgccgttgctgggcgtctacgtcttcaccgaccggccgcctcatccgccgccgactggtatctccgcctgcacggctggcctattatgccaccgttgttgggcgtctacgtcttcaccgaccggccgcttcgtctgcagccgactggagtttccgcttgcacggccggcctattatgccgctgttgttgggcatcatcgacttcaccgaccggccgcctcgtccatcgccgactggtgttttcgcctatacggttggttggtcacaccaccgttgttgggcatctacgtcttcatcgaccggccgcctcgtccgccgccgactgatgtttccgcctgcacggctgacttattatgccgccgttgttgggcgtctacgtcttcaccgacaggccgcctcgtccgccgccgactggtgtttccgcctgcactgttggcttattatgcctccgttgttgggcgtctacgtcttcaccgacaggccgcctcgtccgccgccgactggtgtttccgcctgcacggctggcctattatgccgtcgttgttgggcatctacgtcttcactgaccggtcgcttcatatgacgccaactgatgctatcttcttcacggctggctacgtcgtcgtcaccgctaataggcaccgtcatcttcaacgcaagctgtctacgcctgctgccaactggtttattcacttccatggctggatgattctgcccctggttattggccttatcgtcttcaccaccggtcgtctcgtctgctgttgactggtgtcctcgcctctacggctggtttatgccgctatcactactgatggacgtcattgtttttattgctggtcgccttgtctgccgccgactggtttgttcgcctccacggctacgcgtcttcgctaccggtttgcttctgttgccgccgactcgtgttcacttcatcacggctgtgcaactttgtcaccatggtggagctacttcatcttcattattttcggcaccggcaaactctatagcctctacttcgcatgatttgccacttcaccaaccacgacgtctacaatagcctcgacatctcggcatgtgtcacaaaatatgatgccgtgttattttactacaacaagtgatgttccaatcttcaatatttatcttcactcaagcaatgattacacgacgacaagaagctacagttctcgactctatgttcagttgtttcccaactaactaaagagtcgggggctacacaaatacaagactctcaaaattcgacaagctgaagcaatcaattaatcagccaactagtcaactccaggagtcattatcttcatctttgctttagagcagagttatcaaccaatcagctcagtttcgatgagatggacaacatcatctactttcctccaagtgaagcatctacaacagctataacaccaatttgatggattattgtcactgacttcatcaccagcacctctacttcattggccctgacatctctgccgttgctaatggatgactacgtcttcgccaccggttgcttccgtcattgccggcttgttatttcgccttcacggttgacctactatgcaaacgctgatgagcgtcttcatcattatcattggttgctacactgctattgactggatcaccgacatcgtcatcttcatcatgttggttgcgtttgtcgtcgccgactatttccttcatcttcatgattggtggatttcgtcattgcctttgatgcgtgtctacatcttcaccgttggcttgctttcgtaaccatcgattggtatcctcgccttcacgaatggcttattatgtcgccactaatgggcatcttcatcttcttcaccagctgcctcgtctgtcatcgactgattatttcgctgccatggctacacaactttatcgctgggcgccttcatattcattgctggctgacctgactgctaccgactggtttcttcgcctccacggctatgcaacttcatcacttttgattggtatcattatcttcactaccaccaatatttttgccacctctggtaggcaatattatctctatattggtcgtcttgtctctatgccaactgcgtcagctacgatcaatggacaactgtgattacgacagaaggacaagctatatgctcaggggcttagctcaaacacaagtatcataccttcaatttggacttgctctggatacatgcaacatgaattcataaacatgggtctattttctatgctcaaagactggactatttattattccctataagggttatcaaccgaatacttgtgtcagtcgggattcaattattatatctatttcggagtatcccataagggataatcactcagatcagaagctattcatatgagctatacttggtctatatcacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcatctttttgcttaggcaaaagtgcgcgtgattatgtgcccaataccttaaaatccttttatatcgcagttactcaactttttaggagttggtacattgcattttaaaaggtgccaaacagtaatgctttatatagctgcccgctgacttttttatataaatcaaggcgttgtttgggttcataaagcaattgattggatacaatatcattgctttttgccacgtaagtgtgcacttttattgaccaatattatggcttaggctgattatatattttggtcattttccaggcggttggtaaatcctttatgagtttatttactcgaattttacaccacatatgccgtatatttttgggtgtagtgaaaccatgtgtcttttagggacttaagcacatctgttaaagcagtgtgcgcatggcgtatgtccaatactttggaaatttctttactcacagcattcgagcttttttatagttgttttgctatgtgaattttcaatgatgtagtcagctttaggttgcatgcatcaatttttacaaagcagtcggtatatcacttggatcatgttgctatatattaatattaagtcacttggttgactacaattatcaaaaccacttggttggttggattatttattccttgactatatgcttggtttgttcaattaaccacatgatcgggggctaaaccaattaggtgcatctagtcgatgcacctgactttatttttcagccatccacagtcttctgatttagtaaaagtactcggaggtcatggcgaagatgattgaagcactcggctttggagtaatctagttcgagagaagattatcttttcgactgtgaaggtctcaggggctactgtggagattatgggtaccccatacccacacggcatggttatccaactagttataagggataacttatatatatgaaatctgtaacagatcatgacttgggtattacgttttcttgtatattacggaacggcctaaagtcctggtttgataagattgtaaagtagatttaggaaaccgataccgtattggataaggtttctatcttgtaatcctaccccccatcctatataaggtgggcaggaggccttctagggggtatgagacaattagatcgtcagatctatactacactcggcggattcaaatccacaaagaggagtagggtattacctctcattgagagggcctgaacctgtctaaatccttgtctccgcatccatccacttttaggtctcgtgcgctaccccgttttattattgccgaattcatgtttcgacagcactgctggttggctacttgcctacctggctcgctcgctctctgcaccttctatgaaaggaggcaagcaacacagtccggccgccctatcacttggccacaatgtagcacgcaagatcgtcgagaagctccgccgttagtagcattcaacgagatgatgcaccgcgttgcctctcttctttgagttgcaagccaagctccaggtctcaacatcttcgccgaagccaccgacgaagcactcagtcgcgacatgtgtcacatgatgacgaagcagagcaacctcgcgttttggcccgtgaaaaggcacgatggcaacgggaccctaccgctccctgtctccatcaattggcgcaacaagacctgcgaaggccagccgtgccttggtccagtcatgttcatgggggtgctacggctcttgctgggcgttcgccatgacgggcgcgctggagagccaccgcgtcatcgcatgcaggggcaaactacgacaacccggtgctcctgtcagagcaggagctcgtggattgccatccaaggagcaaaggctgcgcagggggcctcgccttgaacgctttccagtacgtcatgaaaaatggtctggcgttgtcaaccttctacccttacatgggagtggacgatggtacatgccacgccagcaccacaccccgcgtgaacatgatcatgcgaaggttccaggagctaccacgccacgacaatgctgagaccatcaacaatacgctattagcctatcggccaattggctatcagtcaattgattctgcttttattctttattgctgattgcaggatcaaatcagttggcacgcccttgagacacttgaggctagccttggacctacactagagttaagcagatctcccaggctgccgtattttcacatcaacagtgggtacaatgtttttcaccgaaacgaattagttcaaaaagcaccgtaacatgagacttggacatattggaatggattgagagcgtttgtttcaaaaaaaatctctcggtgactcgttgggtgagcttttttcatttagtgtcgatatcgggtcatgcgggtgtgatgtttttcaccgggacgaaatagttcaaaaaaagcactgacacctagacaaaacatgggtattttgatagttttattaaatgttgcatcatttgcacgcactcaatgtttgtgtacaaacttgtccatatgtggttgcaaattgctattgtctggagtaagatgctggggattagggtatgattaaaacaagaactactcgtgtaaccgcagttgaagttgggaggcaattcttagggatctgaattgatttttatatcctggttagcttgattgaaccaaatgctacttagaaaataaatagggaaaaattagaaccatgccattataattttgtaaaatttgatatgtttgttagctcaacgtcaaacatttttatagccttgcatatttattgccgctttctgatgttgtgatgtcaaagaagtttgtccttgtctatacataaatttgtttttgggataatgtgtggctgaagtggcggtctgccctatggaagatagtcctcctgatcagtgaaagaaaaaaaaatcataagagttaactaaagatacttattattactctattatttttttgcataagtatactttgatcctatctatgtccatgggcacgtggtccagtccgaccatgcgaacacactgtaacagtctcgtatccttgatagaaggaacaaaatctgaaactggttttgatgttttatgctcaccttgttagaggaatgctgtttccctaaattttgcctcttcggttactatcagttcattggtttttctcctgtgcaaaattgtacgagttggaagcaatgtttaacatgaaatgccacatatctaaattttatttttaaactagtaacagggaaggagaaaagtaggatagacctgccctcatatttagcaaaatgtgcagctgctagtgtacgtttgcaaaactgaacacttacagtgaaaatagttttggagtatataccaggtagatgaagggacaacaatttctctttataaaacaaactacaattggactagagatttttttttctggtttaactataagattccttgcgcggtgttctaattaagtgattctatagattgaactatgctgttctcaacagggcttggcaatataaagcaattcatggttctacagagcatatgaaccacagaaaatggttctatagtggccctttacagactagattagggacacagaaaatgcatgtcaccatacaagaatagttctgagcattacattgatattctgaaatgatgtgtccacgcagacaatgcatttccccgcaaaaaaaaaaagagcagataatgcatttcagctagtggtactgtgtgcgcagttatgcagttttgacactataataacaggaattggttgaaaaccaatatatgcctcttgttgtaaggaggttggaaacataataacaggaattggttgaaaaccaatatatgcctcttgttgtaaggaggttggaaaccacagcttgtgcattaaaaattgcattgcacttgtccacaaggtcaacaccctgaacttctatatgttcctcttgccttgttaatctgattcatctctcagcttggtctaactctgtctttggatcagaaagagcagttgagaagagatggctggactactagcatctggaatcataaagtggacaacaaacaagctttcttccttggtttctcctcaaatcgtttcatcatcatctgacgagcaaagtgcttcgttcagagatctaagagatctgcagaggacgatggcaaggattcagcggaccctcgatgcgatggatgaacacaatataagagatgaagccgagagacttcgcctgtgggagctgcagcagcttgcatatgatgcccaggatgctgtcgatgaatacaggtatgagttgcttcgacggaggatggaggaccaaagcaatcaaaggcagagcagcagaagtcgcaagcgcaagcgcaaaggtgacaagaaggtaatattatccccttatcctagctataaccaatgctacatttggtttatcagaaaaaatagtctgtgtttcttctttgatgaaataaagcttccaaattgcagaggcctcctctcaaagtttcttgtataaaaagataagctcccaagcaatttgtttctctcaataatacatgagcaatctgcatatcatgcataagcaaccattgacatagccatataaaagtattgggatagtagaggagcaaaaaggggtccataaaggagcatgtacatatgtgtgttttatttaactcttgttagtacacagtatactacatgcctttggattataataatattagtgcatgtacaggaacctgaaccatcccctatcaaagttcctgttccagatgatttggcagcaagggtgaggaaaattttagaaaaattcaatgagatcacaaaggcatgggatgatctccaactcaatgagagtgacgcaccaataagagaggaggcctatgacatcaagatatctacaaccccgcatgtaggtgattttgacatagttggtagagaagaagacaaggaaaacatcatcgaaatattaatttccgatgaagctgctcaagcaaatatgtctgttgtttctattgttggcatggggggtttgggtaagacaactcttgctcaaatggtgtacaatgatgaaagagtcagcaggtactttcaactaaagggctgggtggatgtttctgagggtcattttgatgttaaggcaattgcaagaaaaattatcatgtcgttcactaggaatccatgtgatatagaagatatgggtaatctccaaaatatgataacggcgcaagtacaagacatgaagttctttctagttcttgacaatgtgtggaatgtgcagaaggaaatctgggatgctttgctttccctgttggtgggtgctcagttgggaatgatcttattaacaacacgcgatgaaactatttcaaaaatgataggaacaatgccttcttatgatcttagcttcctaacttctgaagaatcatggcagttgttcaagcagatggcctttggatttatagatcaacatatggatcaacagttcgaaggatttggtaggaaaattgtgggaaaatgtggaggcctaccattggcaattaaggcaataggatcctctcttcgcggtgagacaaatgaagagacatggaaagatgtctcagagagtgatcaatggggcttacctgcggaagaggatcgagtgctgccagcactaaaactcagctatgatcgaatgccagtacaattgaagcgctgctttgttttcctttcactgctccctaaggggtactatttctggaaagaagacatgataaatctctggatgtgtttgggactcctcaagcaatattgtactgggcgccatgaaaacattggcaggatgtacttcgatgatttaattcagagggcaatgattcaacgagcagaatctgatgaaaaactggaatgctttgtcacacatgatcttatccatgatctggtacattttgtttctggaggagatttcttgagaataaatactcaatatttgcatgaaaccattggaaacttccgctacttgtcattggttgtcagttcttctgatcatacagatgtagcactaaattctgtgacgatacctggaggtataagaatccttaaggttgtcaatgcacaagataatcgaagatgttccagtaagttgttttctagtagcatcaatgttaaaattcctaccgaaacatggcaaaatcttaaacaacttcgtgcattggatttcagtcatactgcacttgcacaagtacctgattcaataggagaattgaaactactcagatatcttagctttttccaaacacgaattaccactatcccagaatcaattagtgacctctacaatctgagggtcttggatgcaagaacggacagccttagagagctcccacaaggcataaaaaaactggtcaacctccgccatctcaatttggatctttggtccccactttgcatgccatgtgggataggtgggctaaaaaggctacagacattgccaaggtttagcattggaagcggaggttggcattccaatgttgccgagctacaccatctggtgaacatacatggagagttatgtattacaggactacggagggttataaatgttgatgatgctcagacagctaatttagtcagtaagaaccaattgcaaatcctgagattagactggtctgatggtgtttgccccaacaactgcagtcatcctagcagccaaaatgatgtggctaccccagacccagagcatgaggaagagatctttgagagcctacggccgcacaagaacatcgaagaattggaggtagtcaattatagtggatacaaatatcctagctggtttggggcttctaccttcatgcacttggcaaagataatcctatgtcagcaaagctgcaagttccttcctccacttggggaattgccacgcctccgcatactctctatggagtgcatgacagatgtggagcatgtgcgacaggagttccgtggaaacatcaccacaaaggcattcccagctgttgaggagctggagtttcaagaaatgttgaaatgggttgagtggtctcaagttggtcaggatgactttccttcactccgcctgctaaaaatcaaggatagccacgagttgaggtacctcccacaggagctatcttcctccctcacaaagttagttatcaaggattgcagcaaacttgctagtctaccagctattccaaacctcactactttgg

SEQ ID NO: 75808 - DNA, 688 bp, Oryza sativa
tttgtcttgggaacaaacaggccgaatacgcctcgctgctacctctaacctcctacccccttcagttcctaatttgttgacgttttagacaggattacacataccaatgagtgattaattagtgttcctacttcctgttttacccctaacaaatacggtttcgaggtacaccaaaccacaacctgctcttggtttgagtggccatcgcatgcaaaactaaagctactagtcctaagttcgattcttggtgtccacttatttttgcactcatgcacaacgccggcagcgtcaaccacaacggcggcgccgtccacctgttgtgcgagcttcaccaccatggcgccagcgtcgacctactccacggcagcggtggcgtcctgcacgacctgctccatggcgaaaagtagtgcaaggaggcgaatagaaggcagcgccccgcgcagcatgcatgacgttggaaataatgggagtaatggccggctgcatgcatgcagggcaagcaggtccaagatgcaaaaaaaaaaaaaaaaagctaaaacgtcaagaaatatcacacaatacaatggttcaagagctaaaacgccaacaaatttcaaaccggagagagtagtccaaaagtacccaagtgacctatgggcccgcactatgtaacgccaaatcaaccaatttgaccgagcgcgtaccactt

SEQ ID NO: 75809 - DNA, 3480 bp, Oryza sativa
ggactatgcacatgattacaaaatgatccaattattcaatgaaatttacggctcgccgattcgttaaaaaaaattgatccaatgttttttgttttatatttctttatgggctagtccttatagaaaccccttggggatagcctcttgcaacgttagattgaagccagtaataacttcacttgactccacaaatcatgcaaatgtcactactatactatgacaccacaagctcctcaaatgcatgcatgcatgatgccacatacccccagttggcaccactacaataaatattgctatacatgctaacatctgtcactcatggatactaattaactccagcctaatttgagtatgccaaataaggaacagaactaatgctggagataacaaaaaacggaagcattgattcttgatgatatactcttgtagtcgtgtccctataaatcccatgaagaggatattgtcattgtggcagtgaccagcaacgattctcctctcatggcggctatcaagaacaacggtgccatggttctgtgttttgcaactctgtttgctatgtctgttgttttcatgtcttgcgatgcaacaggaaggcataatgctggtaagttccggcctatccagatccatttctactactgtagtacttgttctctctgttactgtctatgttgctgcaatgtttattcagatatgcagaaaagtgaagtgcatctgacttactgattgatactgtttggtggtcaccgtgcttcatgatgtgcaggtgttctggacgatgctggcgtgttgtgcttcacttggctgaactgcacgaatgcttcatgccaaaaagaatgtaaggctggcaaatgggatgctaagaaaagcagttgcggcgcaagcgacgtttgctgttgccgagctgcaaagttgttggtgttggatgagcaagctgttagatgaaattttgtgcccaaattcatcaaatcagcaagctgttagacttagatgcgacggggaataaatatatgtatgcaattatgacctgatttggtcagcatgtccaacaatgaagttgtttgatgaaattttgttcccaaattcatcaaacgaaataaaggaagaaattcaaatttaccaccttgagactcctgaggtacaaaattggatatatggtccctaaaaattgaagtgtgaccgaccataacttgctgaaaacaatcatttttcatctatatgcatcatttgtaggaggatgcaagctttcagcattttcttcaacattgacttcaacataggacagagcagtactgtaccttgaagtctctttccacacacccatctccatccttacatccacaacacgtcgccaatcctcattggcagcatacaagtttgacgctagcacataattccccccgtattcaggctccatttcgatcacatgatcgaccaccttcctcgcgagaatggcatttcctagatcccgacatgctccggtcaatacacgccatattacagggtcaggcctcactggcatagccaggacgaactcaaatgcctcttccagcataccagatttgcacagcaggtccaccatgctcccatagtgctccatccaaggtgtgatgtgatactcttcaaccatagacttgaacaattggcgcgcttcattgacgagccccgagtgactgcaggcattgatcacgctcaagaatacaagttcatcaggctggaaaccttgtctgagcatctgcgaaaactggacaagcgcagccaccccatgcccgtgcacggcgagggcctgaattatggctgtccatgagaccactgtccttacagtgatcgagtcaaatatctcacatgatctccttaccctccccatcttaccatgcatatgtatgagtgcgttggcgacacgggtattctccaagaacccattttcatgggcatactcctccacccactcccccagctctgacctgcagtccaacattgtgcacgctgagatgactgcaagaagggttacctcgtcaaccttgaccccagcaagcctcatttgctcgaacacttgcagtgcctctgctggctttccattctcgcagcaagcattgatcatgcaagtccaagaaaccacgctcttcatactccctatgctgtcgaacaccattctcgcattcaccagccggccgcatctcccgtacatgctgaccaaagcattcagcaagggcaaatcaagagcagcgagatttctcaccgcgtagccatggatctctctcccatgcaccaagctcctcagccgcgcgcacgctgacaagaggatcgtgacggagacgttgtcgggccgggaagaacccgcccgcgccatggtggacgccgtcaccaacgcgtgttgggggagcccagaacgcgcacaggcagacaacagggtgttccatagcgggacgtccgggcgggggatttcgtcgaacagcttgcgcgcggcggcgaggctgccggaggccgcgtaggacttgaccagagcggagcaaaggtggagagacgaggggagcacgccgagcttcagcgctcgcgcgtggatttggcaggcggacacgtcggagagcgcggcgaggatggccgcgccggtgcgcaaggctgcggcggcggtggcgctcatcggtcatggcggcggcggcggtggcatttgcaagaaaagcacaagcatgtttggaaaattgtatattttgcgggtctcatttgcaaagttacccatctaacgctccccgcctcaatcttgaccgctcaaaatggatcgaacggtgttccgggatcctagagtggaccagaatattgggccaaagatgcaggagattacatggcctaatggctaatgcctaatgggcttttgaactagagtcaagttaggactgcttaaactgttttactgtgtttgactgaagatcacatactgtacttatttgtgaggatgagacatacaaaatatccataaacaagaacataatactcctgtcataatatttgatgtttagtataaaatttagtcgaattttataactcgagcaatcaattttatatttaaataagcttatgaaatctaataagctcatgattttatgatagtaacttttcaaggcaaatatctcacaattcccctttgttttacaaaccaggcatttgagagttattgattgatagagctttaaaagtaggaccaaatcttgttctaaacgttaaatattcattatcgactatcgagtcgtgtgagtagcccatgcattcagatttggacacattaactccagatcatttcatagaggcttcaaagcccacatatattttacagccaggagcacaagtataacaacatggaaatacagcatcgtactgactattattttctttctactaagctacaaaaaattacagcattcctcagcttgaagctttcagaggcagacatagctctagctcacctggagccacgggggatccact

SEQ ID NO: 75810 - DNA, 1622 bp, Oryza sativa
cttcccctggaatatgcattgccacaagagaaatatattttaggtaagccacatgattgacaaacgtccatatgaattaccacatagaacaatcaaacatgcaaggaaaatttcaatgcaaccataacatgcttaaaaagctttgtatgcttcaagggatataaaagtacagcaaagcttaccagcataattggcttcatcagttccattaggcgcccatgctgcccatataagattgccaggagcgagtatatcaggctttagaacatcagcatcttgaaagctaaaatcttttacatccggtcctcgagaagagaacaaggcaacctggggggcagagttgtatagagttggtgccaaaccatctgcaatagctgctgttgcttggaaggtcgtggcccttcctgcccaatctcttattgtagaagagttgtagtagtctataagatcctacagaaccaaaactaatgtcacctgactatatcaaaaaaaaaacgtattatctaactaacatgcataggttttccctactattcaattatcatgtcatcctacaatagcaggcatatacaattcatgtcactgctcttgaagcatgtacattctaggggactgactttctgagagtagctcgactaaaaaagaagacaactatacgagaatagtttgtgggcactgaacagacaccaaaactagatggatggttacacaagagctatacaatccactacgctacataaatagttttttctagttcatgtttacataagacgtagccagataaaagaaaaacattccagataaaagaaaaaacattagaatctgcagcttttcaatactccactcatggtgttctgcctacagatggcatccatgatatctacacactgacacttttggggatgcaatacttcctccgtcccaaaatgtaagcattttttaggttggcacgggtattaagaaagtatgtgagaatgattgaagaaggtgtgtgattggttgaaaagagaaagtaggtgaaaaagaatggttgtgattggttgagaggagaaggtaggtagaaaaatagcttcattttgggacaaagtactgtgctagaaatagctacattttgggacggaggtagtacctttgttctgctgacatctgtgatgagaataccaggcatgctgacaggtacaggatcaaattttgttcctgggtaactattctccacagcaacaataaaaccagctgcaccaagactcctagcagtctctgacactttcttgatagaagctgtcccagaaatatagttgaaagaatatccacacaaaagaattttgccctgaattttcctcttattcaagagttctggcctttggcaatctaatgcactgtacttggtggcagatgaacccagcagagcatcagccgcagaaatcaggctgaatgatttattctcatgggttgcagctgtagccaaatgagaaaactgtaaattaaccacaagtagaaatttctatgtaactgtcagattgcctgcatttgttgacatgattgcaatctagtaacatatttgctatgggatgcagtaacatatgacagtggaattacaaaggaagaaaaacagaggattgtct

SEQ ID NO: 75811 - DNA, 3395 bp, Oryza sativa
ccctcttcccaacccatctccctcgttttccgcgtgcacgcttttcaaactgctaaacggtgcttttttgcaaaatgtttctatacgaaagttgcttaaaaaaaacaaattaatccatttttgaaaaaaaaaatagtaaatacttaattaatcacccgctaatcgctgctccgtttccgtgcgggcacttagtgttgggaaccaggggttccgaacacaccctaagcgcagacaacaacattgagtgatttttatttatttatttattttgggggggggcgaagttaaaaggtaggccacttagcttaggtcattttaattcattttgtacaatttttgttgcccatgaatgcatataccatacatgtagtaatagaaaaccaaaatttgagctaaaatacatgaataaacagaacttacgtgatacaccaagtccaggaagaagtttcccatttcctagcaccaaatgatttttgtatctgcggtcatcaactccagcagcaacagtggttatccatgggctgaatgataccagtgttttcggaaatggtcctccatttcctgctgcttgggcaacaaacaccccagctttcacagcggaaagaagtgcagcatcaaaaggattcaaaaatgtagtccgcgtagcagttggcgggctatttgggccaacagaaaggttgagaatgtcaacaccatcctgcacagcctgcaaaatgcagattgccatccatgcattagttcctacatattgaaggcttgtgatagtgacatgcattacataactggcagatgttgtttcactcatttctgcaatagtctatgaagaaaacaactactatggcagattccagaaataattgttttgagtcactattgtcaggtactaagtactaacatggcagcacctgcattacagtggaaagaaattcagataagtaactcatatgttatacctgatcaatggctgcaacaacatcagatacataaccaccaaaaagcctgtaaaggactttgtacacggctatcctgtcaatcacaaactcaggaaaatcacaatccggaaggagagcaaaagcaaaggggaataatagatattgattaacaataacggcaagatagaaggaagtgaatttcactagcacaaggctcacattcattgaggtgatttttgtgcattattcttagttgttcaatgagatcttgaaattagaaaatgctgaagaaatggaaacttacctagcacgtggagccataccacttgctttgccaaattcgtgaccatgcattcgtactggaatcccattatttccagcagcaattgctgctgtatgactgtttaagggaaagcatctttgtatcagataactagataagtcatgccattcttctcaagatgaaacacaaccagaatagctaattctttggacagaacaattttcatgtatggcatttttcttggtataagaaactagaacagaacatatattaattaggagcatgaccttccatggccatcgccatctaatggagatgcaaaatcgacatcaggattaaacgctccagcagcaattgcagcttttgcaaaatgctgggcaccaactatcttcccattacaaaagcttcttcttgttactggatccatctcacatttccccttgtaatgaggaacaggcccataaggatcagttttgtgggcagagaagcttggatgttgggggtaaattcctgaatccacaaagccaatcacaacatcttcaccagctctatcgaagccaccacccgttggccatacccctgttggcaatccaagaaattgtggagtgtgtgtcgtcaatttctgtatcttcatatctctctccacatgctttactcctggggctttccttaggaattcagcctaacacagtgaaagattgctgtgttcagccaagataataatcttaaaccaggaaagaagaaaagatataaaaatgctaaatacctgtaagggtgacatgtgtactgcaaaaccattaataagatgatggtagctataaagcttctcataagttccttctaccaaaagtgagtctagaagcttgtcatggtaccttcgtaggtggagtgagtatgaagtcacagcctcactgaaatcagtaaattgcacatatacagaattgtcatgtttccaccacaactccacaaatacaagcaagctgtgattaaaaacttaatggggggataatcaatttcaatatcagagagctgaaagacagtaacagtggtgaccttttttttttctaatgaaggctttcgagcagatattcttaacatgttggaagactcttaacagctcaaacctcacacactacatatatgatatatcataatgggaagaaaatggaatccatttcaagaaacatttaggaggtgcacttcctcagtagcaagctccaagtgcaacaagacatgtgaaatgcaattcaacaataagaactaacaagtccaatatgccatgcaacccaacatagactccacaaattcaccaagagtcagccaacacaaaataaatgttcgaaggcatggtgaaaaaacatcatcaatagtaaactacctggtaatttccatatcttcatccaaatctatggcggttgcagggaatccttcaactccacctctgtagctgacaacaggttcgccttccattgtaacaatgtacacatcatgtgttccaagaaccacttgtggtacaatgataagaagcaaacacgcgagctcaagcgccttcatcttcagcaatatccgaattgccacaccacagaatcttccaaagaatggaactgtcagggaagtgcacttacaagttacaagtatgcatgacactagacatcaatttgatggtttgggagagtcaagagtacaacaactacaggagtacaggactgcactactgactgagtaaaatcactcactaccctagtcatccactactggtcccggcagtgcccacaatttctttgtgatactggagttgcccacctcacaagcctctcatggagcacgcatttacggaaccttattaaattagggcggccgatgacattaaatggctcttcagaacgattatactctacagtctacactacaatatagcgtactgtaaacggctagtctgtgtgtactccgtatgcattttaatagctgcattttctttagaacagattgattttgaaatgaaactaaaaatttataccactttgctaaaggatcaagcatgagttaagatctactagaacaggctgaacaaatattatctcactgtaaccaatactgcaagctgctaaaaaagggtgaaacaacaaaatcaaagatcaatatgaataatatcatgatctggtaaaaaatacgggggatcc

SEQ ID NO: 75812 - DNA, 1626 bp, Oryza sativa
tattttctatgcactagaaaaaatacacgtacgttgcaacgggtgaagattattttaatcttgtaattgttatacggtttagctaatcttgtaattgttatacggtttagctagggtgaaattcaccatggaagttcgcttggatattttattttagaaaatcatgagatgtagttaggagtccgacttttatctcaagttagcatgcgagttttttttaagagattgcttatacaactcattttgtatttccaaaagcaaacgaacttaaaatttaactcaaatacggatttgtatttctataaacgaataaacttaaaaaccgactcaaacatggatgatataccaaaatactggtaaaaacatctttaatttttataatagtagacatatgcagattaacaacactgcaaagacacacgtgtgtgatgatagagttacgggtgcataatttcatccaccaatttcaatttatattattttcgggttacaagtattttttaagttggtacagagtctaagtaaagagtagaagttatatactatctttgtaaaagaacacatcgattgagaggggataagggaaataaggtgtaccatcactattccttgctggtggtgcatggcaagatatggaagtggcagacataagcacaagaactgccaagcacagaaccatcatgctattgttcttcatgagcgccatgactgcaatggtatatgtatgtatgtagtcactgtgattgtgaaatggtatttgttatatatagtgtgtgtatatatagagagaggtttggataggctagctagcacattaattaattcatatttttattattttattggtactaagtgataatgcatttaggcatggatatcaatgttctgttatagtggtgccatttatagtgtatcctccatatctgctaggaaataaaagaaaaatcctccagatatgctagaaaataaaagataaatccttcaggtcttctagaaagtaaaaaagataaatcctccagatctgctagaaaataaaagataaatccttcagatctgctagaaaataaaagaaaaatcatcaactatgggcctggttcttcccacgcatgggctatagatgggtccaaattagactagatctaaattcattaggcttatgtgtttctccaaggggagtacctatacatctttcgaaagatttttataatcgtatcacacagatttttaatctttagattaaaatccgatagatataataaaaagcaaaaagcaattaagaaacaccataatggacactaaattaccatatcctcaataaaaagaccaaatccaatacaaaatttaaaatttacatgcgaagattcaaaaattacagtgtaacttacaaaagttacagtgtaagtttcataaattacactgtaacttaccagaaaatgcactgtaaatttgagtaagaaaatcgagtgagagataagaaaaaatctttcgagtgagatatagcaaaatcgttctccaagtgcatctttctttttgtttggtgcttattgcttagtaaaattcataaagttttgctccaaaagaaaacggtaaaaattcatagagtattttgcactttacaccaggtaa

SEQ ID NO: 75813 - DNA, 1302 bp, Oryza sativa
gtatattatagaagttaagcaaagtgcgatggcatattagaacttgacaaacctagtgacatattgttgaataaggacaaaatcaataacacacgatggattctctatatattttatggttgtttagttcattacctatctactatcgtgcgacatttttataaaaatttaaatcttatactataagctcatatcttacacattaaattacatacacttataatataattttcaaattataaaatggccctcttcacattttataggagaaatatgaaaaatgatttattatctatttaattatgagaaaaaatattagtccaaattaacgtatatttagaaaaaataacatgtaagaattacggaaatacctacaatcgtatatcatgcagtgagagaaggagaccacaatcgaatgctttattgttgagcaaaattgatggcattaattttatctttttttagctgaatctatctaaccataattaatcagtccgtgttagtagaagtctgcatcttcatgcatcaacatatcatgagactattagtaaaagccaagtacactgaccccacaatacttaatatatcacaagactatcaggtaatggacaacttatctttaattatgctaaagacttagtatatcacaggagtatcgggtaataatagacaactcatctttaattgtgctaaagaaaaaaaagtaaattacagttcgtactatgtattcttaaaagttttcatattatgttatcctttaaccattcttttcatttatagaacaactaactttacatttcaatttagaccaccctatttcatccatctccaggtctagtgactcagcaaacacacactaactctctctctccatttttctttttccctccgtgtcgatgatatgggcccaagggcatttttgacatttcacgcgatttctctctcctccctaactggaaattattattttaatcggcgcggtgtccactggtaaattatcacgtttatggagtgttttccccaaaaagtgagtttgggcagtgtcctagggctaaaaccacacataagaagtgtcctgtagcaaaatttgccttatttctgttgggtgcttattgcttagtaaaattcataaagtttagctccaaaagaaaacagtaaaaattcactgtatattgcactttacaccgggtagtagtatgtttctttttctttcaccaaatttagcatatattttcactttacaccaagttatcttaaaataagttccagttaacatcagggtacatcaagaaccctataaaa

SEQ ID NO: 75814 - DNA, 3839 bp, Oryza sativa
caaaagtgtatatgtatctatgatgttggtatttatttgccatttatttgtaggtaaatatggtcaaatggacatcgactggcatatttaccttcgttccataataattttacttttaggattcaaatctatcttaaaataattgttaaataaaatattaattgtctcataattacttctcatttaaaattatttttattttattcttaactacccttccacttttacttatacgtcatttaatgaggggtattatagtttttatctcaaaccttaatatatgctaaataacatagacttgtaattattttacaacggaggtagctagtatccaaaactacagcggaaattatgtgccgtaagcacgtcagttatctgtggttcctgctgtaagtggcattgtactgtaggatagggtgtagtactcgtgagctttttgtcaatgtgtaggccgtttatccgagtattctctctgtcttaaaatataagggattttagatggatgtgatattttctaatcctatgaatttggatatactctatatccagattcattgtactaggaaatgtctcatccgtctaaaatcccttatattttaggatgaagggagtactatccggtgtatcaaccaagtgagaaaaagatatttttatgaaaatatgtatgtcaacaaagtgaagaaaatatatttaaaagtaaaatttgtttgttttccttagtaatcattgggcttaccatgggaaaagggtaatccctcaccaaagaccctggtgttacctaattatggactttacatatgttgtgacagttttcaaaatgtatatttagtcactaaattttattataagaaatttaaaaatctcatgaagttatgattctaatgccataagtttttcttacaatttaacttcaaacttgttcaagatgacatgttattttttatcattttctggaacaagattgtcgatgtccccaatgtagccggatccggtttgcaacagagagatactttgtttgtgccgatggaaattactccattggcttacttgacgtcttgacgtgttgaccaacgacatggccaagcttcggcttggactcttgttggttgaaacgctcaaatcaaatgtgactaactcaaattacacgcgtttctacacttcgctgatcacatattcatacaacaaagtggtaattaagtctaaaattagctgacaacttctctctgtttaaccagccagccactgcacactgatcagatcaagatatatacagcacaacattactgatattattatatacatacctgctgcattaatttttcttggaccaaaatgctccattaattttgacttagaaatacatgcgagctcatgagctcgtcagcttcacttcacagagacgaccatggcggcatggcactcacgttgtcggcacctgccgacctaattctcattcattcgttcagtttttttttccttctctgaccaaaaacaagaaattcagttttgagtgtagctcgacaaagatcgataattcagtcagagttttcacggacggtgtttgtctgaatctcttcacctcttcaccaaaacgacatgtttttgttatgggtgtgatgtgagtccttaacttctcatggagaaattgatatgattctttgtattcgcttaagacatcattggtcgatgatttcagagaacccggttaattgattcagacagaaatggtttctttgtatcctttaaaacatcatggtatgcatgtgtatactgttagtcagattaagcaatggcaactcagtctttgtttaatcatacatatgtactcctatttaccgctactgatttgattctcatctctgatgaaacaataatgaccttctatcaatggaaaccaccggcggcaaagcaaaacggcggccagtttcagagtttttctctgaaacatacggctgttttttttttcatatcgtacagtacatagtccttttgcagatcatatgtgcctttcaatctgtcattgcagttcgttccttcttgactatgtatgcatccatatgttcgtggtgacccactcgggctagctgaaagtctgaaataaagtaggagtagtagtattcattgactttaattttaatattcagagaaatataatacaacgatctctctgacttgcgacttgttgatatcagaaattagtatactactgttgcctgtccaagtattcaaggaaaagagtaaattgcgttcacgatatataaacttgtatggtgggtgcaaataggtacaataacttgtaaattgcttattccggtacaataacttggctagttcatgcaaagatgggccaaaccaatccacacaagtaaaattgatgtaatatgatacgtactagtgtgtaattattgttacacatcaaaattttttactgacacatattattagtcgcatgatactttcaagatttagaccaacgaaaaagcaaaataattaaaaatacctgattgttaaaatacactttcaatgaaagtgtcagaacatgaacatgaaaattaaaattttcttttagtagttaatagtacatataacaattgtcttggtcttgaacagacaaataaaaattagacgagttatatagatgatcaaatttttccaaaaaatgaaacaaatattgtaccctggacatgaaaaataaacttttgcacatttttatttggattcgaaataagatctccaaatcacagttatatgtatatgctgttatgtcattagtgtgcactaatttagagcaattttacttgtgtggatcattttggcccagttcgcaccaactagccaagttattatatcaaagtgagcaatttgtaagttgttgtatctatttgcacccaccacacaagttcatgtaccgtgagtgtaatttatgttagagtaaattacatgtcaaaataatccacacaagtaaaattgctctaaacagtattttagagcaattgggaaaattttaggcatctgatttcacaatgaatggacaagatcgttccagcacagcacctataaacagtattttactgtgattttcactgttactacggtgcctacgctgtaataacggtaaattctagcatgaatgcaagtataaaatggacgattataaaaacacatgaacgatcttttgattagatcgcatgaaaaatataggaatcggtgtcgctctttgtttcagcgataccgttcggtctcgctcgttctttccgcgagagcgcgcggtctcgcgcggcttgcgccgcgcgataccgccctcgacgtcacgtctacgctattttcgctcaatggttatgcgagatcgacatcctgaatattcctgaaataaaattgaatgtgcggtatattttcaaatttaattccctcggcaccacccctgccggcaagcatgactcagtgactcctcgtctctaatgtgtgggaggatggggggcaatgttggaagggagaaaaaaattaactggccttgtgtacctttccaaatcttccccatatagtagtccttcattttgtgggtggaaggtaagattcagcagcacacatcttgacacacacggacggcgcagatgaattcgggcttactatatataatatacacacatacatgtctttgtcctaggggtgtaattttgacaaacatgaggctttgtatcatatgtgtaattaatttgactctaagagaattcagttgcataagttgaactcttgtgtgaaaaggtgtaaagttgattttgttttctttctttacaatgggcttggatcaggttgggtttagtaggctagatatctctcct

SEQ ID NO: 75815 - DNA, 6481 bp, Oryza sativa
aaaaataaatccatccatgctttatatttaggaaattttatttcccacatttaacttcacttgttaattaatgtacatttaatataaattttaataataatttattaaataatttataaatcctaatacgaaaatcaggatgtgacaaagaccgctggaagaaatcacaagaagaaagatagggacttgactcctacaaatgaagggatccatcttacacgcagagtggagattatgggtagttgggtaccacatacccacatggcacgtatatccgactggttataggggataggttgtacagatagaatatagaatatgtttaggaaaggactcgggaattatgttaacttgtatgtcaaggaaatatccagtagtcctagttagttacagttgtaatacatattcgttagcctagtacgtaagccatatgggctgtacattgtaatcttggctcctccccctatataaggtcgggtccaagtgtacctaggggcataacttttctcccagatcatcagatcaataatacactcggtggaataattcccccgctgtataaacctttgcctcctacgtcctaacctatccacttttccagcttgattgctaccccttttagtattgccagaatcttgttttgacagttggcgcgtcaggtaggggttgcaccatgtttttcgccgactagtgcgatgggattcgttccgggcatcaccgacttcgctttccctcccgggcagacgtgctggttcggcggcccatggacctcatcagccacccgtacatgcatgcaaagaagacatcgtacgacagatcaatccatgattataaatcaagctaataatattatatagattgtgaaagaagttcttctgtatatgtgcagaatgaaggatcccttaaagcaaattgtttttgattggttgcaagctttatagttttatttagttccttcgactgtaactttgtaaatattttttgagttatataaaattacactgctcggcaaagccctggcagtatttcaggtcaaaaaagatttcatatagattgaaacgacaaaccaatcgacgtcagagattagaatcatcgatctcattgagattgccctcgagcaaaaacaatgcctttgattcctgaagttgtttccatcgcacttcttgatggataattcgacgcttcccctacctgtcgcgccaactgtttaaactggaattcggcaacatgaaaaagagtatcgcacgagacataaaagtggatggatgcgaagacaagaatttagacaggttcaggccctctcgatgagaggtaaaaccctacacctgtttggggatttgtatccgccaggtggatattgatctgatgatctgattgtggttatccgtgctgatgcccttgtaggggctcattgcccgccttatataggttggggggcagggttacaaagtagaaaacaagccagacagcccactctagtacataatagatggatccggcccactcctatctctagtcgaatatggaggccgtgtcggtacccggtacgcatactctccacaagtttctctacaggaacaaggacgatcaataactaactatctgttttctcttttctattttggttcacacagctacacattgacatttatttttagcattaaatgcctagctctagccttgatgtttacttacatttttctattgtaattttatgtttttgttttagcattggtgtgaatcaggatactcctaataatatatcaacatattttggttgtcatctttttgtgtagtttgttttgaccagaaaaaggttgcttaaaataaaaagaaagattcatgcaagctgaaataattcacacgatagataaatttatttccgaaatttgataacaatgttacaaatgtggcgtgcatgcgatcaatgtgtgggaagcaagtatcacaattaattaattgaaatacaaaagtatgcacgatataatcgacggtggtgtgtatccaaaagaaatttagcgtaaggcctatatataagaaagaactgaggaattgtatgtatgaagttgaatgaaaaaatgatatataatgtagaattgagagttgggaatatatgaaatagaaaattgagaaaaacaatgttaccaaaaatcgtggacaacaccactaatcgatcatgggaattaacaacaagtataataaataaaataatgtacttccacttagtaggtagctagagagcatgcatggaaggctatatatatagctagattattaaagctttatgtgattgatgagggagctagctgtgtcgaaagtatatccaagggttttctgggcggggagatcatcgctataagtgaacaggtaacctatctcgcaaccggatgctttcccgatcccaccgttgtagggtttctccacccctttgatccacttttgcgcattctccagatcctccttgctgcgcttgccatttccggcggcggcgaggcggccgaggctctgcagcgcctccctggtgatgttctcgccggcggctacgctgaagtcatcgacgcaggcgttcaggttcgggtcccccttgccggcccctccctggaccttgcgcaattggtcgacgtagacccagaggttggtgctcaggatggtggcggccacctcggcgaccttcacctggttgccctcgaagaaggcagcgtaggggaggagatggtagtagcagaagctggagccgtcgcggtcggcctgcagggcggtgtcgcagcaggagcggacgaacgctgccgcgtccgcggagggcgcctcccctggcgccgccgctggtggcagcaccaccactggcttctcctccttcgcagcggccgcacatggtggggataagccgccggcgctgacgaccatcaacaccacgaggacggtggccatgctcgagctcgacctgctcatttctgtatattatttatctctccgcctctctctctctctgcttgtttcgttactacaggatgaattacttcataacaacgaggtacaatttatactagtaggctcgattggtcgttaactaattaaccacaacctttctttctaatttattcaatggctgttctagcatcacggcatgtcttttaggtgttgtgatgtagtgccatgcttgcaattataaactactatattaatgcaactaattgtccatatatagacagcctgctcgctttttgtttcatatccattcacttaggcgcctagcattggcttctatatttttgtcaaatccttgcatttttccttggttaatcattaggtctagaaatataatgatatatagtttaaaatttatttaatataatatacgaatatctacaacaatctatttatcttaaccaatcacaactactactgctcgtttaattttctcacataactactcatctcattcaatactaactctttattcagatactcattgttaatatccagaaaaaaagctccaaatatattgttagacggagagaattattattttggaagcaactgcaccacaggccagaagcaaaattcagctatataactactctctccgtcccataatataaatgattttgccctttaaatctgtcccaaatgtaagatatatattttgtgatccgcgacgatattttatacccaacctatcaacttagtgctacttttttcccatctactaatttttaccaatttattttccatctatcaattttttttattccctccgttctatattgtaaaactttctggccctgccaatataatatcaacccaattgatgagagagaaaccacataaaacaatagttttgtgcttgtgtttctcccttcttccggtcttcttccgacgctcctctcagttctcacacgccccctgttgtgcgtaaggtcatagaccacgcacgtgtgccccgctgccccgtcctcactgctacaccgctccgccgcgagggctccacggccaaagctgcgcaatcatgctgctgctcctcatgtgtgtacccctgcgtgtgaggtaaaaggctgccactacgccacggagtcctcatcgtttccgtggggaccatgtcatcgacccttccatccatgatgccccgccagaaggcctccgcaactgccttcttgtcgctctggaggagtagctccctcctgttcatcgtgtcggtgaacttctgtaggattagcttggcgaagacgtcgatgatgttgaggccggtgtcaacctcgcttatgtacaagaacaagcggtcgttgtcgaccagtttcgaccgtcaatattatccaatatatgaagactacctatggttgcaatgcataattcccaaataaaataattacttccactatatgctatgctactaacatgtatgcaggagaagcactcataaatgaagagaaggatgtggaaatatatcaatcaatcagtcgaaagtctgctggtgatctgcaattgcatgagaaggcccaaaagtccaatttaacaatcacaaatgggcctagaatgtatgtcactgatttaggggcccacatggaagtctcctggaggaagctggggccagaagagcccatatagggtatatactgtttttagtaaactgttttttattattagtagtaggtaacagtttatactcttttttcgtgcagtatatttcctagctatgtatatgctgccatttctgcatgaaagtatatactgtttttgtttttagtaagcaacggtatatactgtttttttttatttgtagtaggcagcagtttataggcagctgccatatacttcattttgatgtagagaaatatatacagataaatatcccacatacgtgttttttatgacagtatatacttattttttttaatagtatatacttcttttttttacttagtactgtgcttcaccaaagtagtttaagtactgtgcttcagttaagactagtatatatactgtttcctaggtggtagcaatatacatatatacttctttttaaggtggtagtaacatatacctttttaaggtgcaggtttatacttttgttaagataattgcagtatataccatttttagcagtagcagtatatgctattttttaagatagtagcagtatatatgctatttttattacttgcttttaccctgtcgcagaactcagtgttcgtgctgcatgcacgtattatgatccaaaagttttagtatattctcaaagatatatgtagttccaaaagaactagcctcacagacgagaaaacatgatcaagaacacaaattgaacatgctgaatcgcagattgaaaagtaataatgtacatccaaatcacagtttgtcaaacaaggatccttccccttgcgtgtatattctctccgctggtgccgttggattgtggcgttgagtcgacatgttctgcagacggccggcgcggccggacaccacctgcaagcaacaaaaagattaggggcttattcattcaaatttcaaggaactaaagaaatccatcacaaaccactatcctggaacaacattcacgcatgcaaaggacaattaatctaccatctgttgatgacatttttttcatccaaatcacagtatttttcattctgaactctaggattaatttttatctacgtgtacgtacagagattaaaaggaagaagaataagaaatagtgtatactcatctgagtgtggatctgtgattcagaatttcatatataaactaagaacagtacacaccaccatcctggagatctggtagtagcgataggccgccacggctgccttgactagacatatatgaaaacaaatcacaactaatggtgaaattaactaacaaaggtgcttaccggatctcatcgagatcgagacgatcaattggattagacaaaatacctggccaccgtgatctctgtgcgttttaatccttgcggcactctagcagctgacctataacccgttctgatctccgcttaataagcgagaaacaacggaaagaaaaacgaactggagaaaaggagtagatcagcgcatcgccaatacctagacctattctcgttctgtcgagcggagccagccaatgccattccgtggtcctccgacgccggtagggcagaagacaccaggccgatggatcacgccgtcgcttccgactcgtcgttgacgccaaatcaatgatgtagatatgctgcccttgtcggcaacgatgccaacccctccgaagatcgaggtctccactgataactgatttatcgatctaatgagctgggaaaagggatttatctatccggttttccgattaccgcgggttaattaagattatgttttttttcttgttaaaaatgaaaacgggtccgttctgtgaatccggtaacgggcttcttcggggtggctatgatggacggtagatgggagcgggagcactagtcaagaaatcgtttttagtcccggttcataacccc

SEQ ID NO: 75816 - DNA, 2283 bp, Oryza sativa
aacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctgggtctgcaatcttcgcctcggtatctctcttgctcctcatccgactcctgtacgtgtggatgtcctccttgaaatcaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatcttctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattctggtccacagcatctctttctccgaatctgggacaaagctctcatgatctccgcgtgcacttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgcctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgctttcctgcgcgattgtatcgtacaatatctgttcctcatcgcggtcagccatctgttgatacaagaaacatctgctaagtcacgagacatttatgttttaacaatctaagtcttgtatgctaagtgtaaatgtcgtacattagaaccctacacaaccttacgtgctaagtccaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcggaccaattccgtagtcaataattacatactaagtctaattataaataaagtaatcttatattaaaactcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattgcatgctaagactaaaatagtcatgtatgctaagtgtttcgtgtgtatatgctaagtctaattaagactacaatagtcaattgctaggagtcgcaccaattccgtagtcaataatgtcatactaagtctaatttgcaataaaataatcttatattaaaactcaaataatattagaacactacgcaatcttatatgataagtctaattacaggtctctaataatcttaattaattgcattacaaatataacaatcatttatattattacgtcacttgcctgctccaattccttctagggctagctgttccactcaggcttgacggacgactccgac

SEQ ID NO: 75817 - DNA, 5268 bp, Oryza sativa
agcatcatcggctacgggaacctgattctagacacgccactcctgtcttggtcttggtttcctcagccgatggttgatgtcctcttcaacctcctgaaaacgctccctgttcctcaatctctggaccctccttttctgattcttcgtgaaaataccagaaggacaccattgattctttctgatcacctcatcttcttggccacgatcttgactcatcggacccaatctttgatgaacagagagtcttgcctgtttcagccgattatccctattatgtggtcggcttgagctctcgatgatatcactgcatccagggcagttttcaatggatggcaacctcatcccctcattccagcagaatctgaagaactcgcaaccccaatgaggatcaaaaccatcgtcgtattcttcataactcctctcctgctgcttgtcatacttcttctgatacttgttgataatcttagccgaatttacttgaaaaccctttgcacgggctctatcggctgcttgaccagctgtatgcaccatattaataggaaaaggattccaatcgaccttcatcggcttcttggaatcatcaaacctaatctttcccccttcaatggcaacctggatttgctatctaaagaccttacaatcattagtagaatgagacccagaattatgccatttgcaatatctcttcttgcctaattcctcagccgatgggatcgtatgatcggtagggagctgaatctgcttttctcggagtagcaaatcaaaaattttgtcagctttggtgatatcaaagtcatacttctcctctttcccgggactctttacccattggcatggtataaccttttttgctccttacccattcggctgcagctatttcagaatcatcttcttcgtcatccgacccatacatatatggacaaacgtgattaactttctttgagcttttcctgacttccgccgacctatgctcaagcaaggttaccttctgtatcagatgcgataagctatcgaagtcttcggatgaaaatttctccctgattggaggaatcataccctggaaggccaaatcggctaactgagcatcagtcagactcaagctaaagcacttgttccgcatctctctgaacctctgaatatactcgtgcacaggctcatcatgccgctgcttgatcgctgtcaggtcggataacttcatctcatggaccccactgtagaaatagctgtggaattgcttctccaaatcggcccaactattgatcgacccatatggcaaagaggaaaaccaagtaaaagctgatccggacagagataaccggaacaacctaactctcaaggtgtctacagccgatgcttcaccgcactgagcaaggaatcggctgatgtgctcataagtcgacacgccctcttgtctcgaaaacttggagaaatctagaactttaaaccgattgggaagaggaactctttcaaaccactcagggtaaggctgccaatacaaacttccagtttcttttggtttaagtccgaattgctccctcattacatcggcgatgtcacgtcctgataaattcatcccgaaataaaaatcattttctaaaaggaataatagaattaattaaaatttgaaaagaaattggcaaacactaaaatacgtacaagaaaatttcgaatgtggcccggagaatttttgttaaattctccttggtctaaaatgagccctcaaattttacttgaattttcagagcactggaaatatttattaagcaacaacaactatgatcaaagtttattaaaaagaaaacttaaaaataatcctccttcctcctttgggccaagcccagcccaaagtctccctctcctccctctctttccctcctctcccgggcctctcctcctcctcccggcccacctcttccctccccctcccggcccagctccctcccctcccctctctctcccgggcctgcctctccctcctctcctcctgggccgcctccgggcccaagccgagcggcgccctcccacccgtgccgcgcacgtgcgtgcgctgaccgcgcgcctggccgcgtggggcccacgcgccggtcgtcttcctcctcccgcacggcctcttctctctcccgtgcaaacctagcgccgttcctcctccaaatccgccccaatcaagccggctctttccaaattaattggggggttttaatccccattgattcctcttcaattccccccaatttcccccttgaatcgtgcccccaatcgccgggaacggacgcgccaaccccggtcaccttgcaaggccgccgggcgcctattccgccgccgttccccgcctctcccatggccggctccctctcctcccctataaaatggaatccccatcctccgttctatcgttttagccccctcccgcgttctcccgtggcctcaccacccctccccgccgccgcccttctctttcccccgcgccggcctcctccagccgcctctccctcctcgcccgagcgccgtccggccatgccgtcgccttccccggcgtcgcagccgcctcctcttccccggcgctgcctccgattcgtggggaaatcatcggagacgcgcccccgccggcgtccagtggcgtcgccgccactacaccgtctctggccggctgctgttcgtcgccggtacgccgaccgacgtcgccgtctcctccgtcgacgtcgcagcgtcgtcctctcctccggctgctcctcagtttcgccggaacaccgccgccgccgcgccggcctctcgtttctcctcgtcgacgtcgccttcggtagccccttccgccgtgcccgtgcgccggccgacgtcgccatctccacctccggcatcacagcggcaaggtcgccctcggcctcgcctcccctccacccgaacaccgccggtgtctgtcgtcgttttcaccgttcatcctcgccggctcgtcgtctcgcggcgccgcctccgtcctcgtctccgtgcagccgctgccggctgccatcgtcgtctcctcgccgtccccggtcgtcgtcgtcgtcgtcctctcgtcgttcccggttttgctcgtcgtggcgttcgtccctccgtcaagccgatcgcgttcgccgcccgtggttcgtcaggcgagccgctgcagccccgtcgtcttcgtcctcgcctccgcgtcgccaagcgttgcaccggccgcgtctcgccttcgtccaaggatcgccgccgaagtcgctccctcgccgttcgcctccgtcgtctccgagccatcttcgccgcgcccgttcaccgtcgtcgttcccacgcctcgtcgcgtggtggtaaggatccatcctctcgctgccccgtcctagtcctttcggtgtcgcccgtgcccgttgtgcggttgtcgaccccggtacccgtgtactggtgtcggtagtcattcgcttgtgtgtgtagtgtccgtgttagtgtgcccgctcggtagccgcgtggtttccacgtgtgcagcccgtgtggtgtctagtggagtccgtttgtcgaccgcttgcctcggttgacacacgggatccgcttccgtcgacccgtggaccgtctctgtgtactcggtctactgtggtcctttaggttgacatgtggagtctgcatgtcaacagcgcagccttcctgtattttccaggctagcgcttacacatgttttataattggaaaacctaatcacaataatccgtcaatctccatgtaacagcattaaacttcggatgatcatatcttggtcatacgaaccccgaatcgacccgttcaagtctcctaatgtttgttataaactaaagaaccgtgtgctttctttttatgtattgttattgcttctttataggcttgtagctttgcttgtgtgcttcgcgtagcttctgtcgttccgaaggttctcgaagcgtggtttgcggtcgtcgccgaaggttcggaaggctgttctctctgagcaaggcaagtcacatcacccttgagcatattgaatcccactttacaaaattattttgatttaaattattgcattaccgctttatttaaattcccgcgtaatcactgttttatttagcacttcctattaatccttgttatagccttatcattgctattgtttattattaccttgttcaccctaggataaacaaaaccccaactagtgggtactctattaacagttccactagtatgaatctaggtagatgcttcgctgactaattaggcaacattaggtggttttataactttagactttgggaattctcatatcatttggacactgtggaatggttggcttgtgatggaattgaacacacacctcccccctctattcaaaaccccaaaatggttttaggttgggctcgaggtgcagggttttgctagtagcacctcggccactataaggaccggtcttcgggcctctgttgcaaagcactataaccacatgtctaatgggtaaggcttaactcggtgctcagtctagtcctgaacaaaaagacacggatagagatggatgaagtcgttgcgacgatggatatctctgaggcaaatgaaggctacacgagctgcggctcggtaatcgagatgtctaggcaaatgaagactacacgggtcggtgcccgttagtcgagatgccatggcactggactagtacacgggtggtctcacccctatgggtgtggcgcacccggtctagatcctgttgctaggggctcaatcctggcctgcctgtcccgggatatcggccgtaggcagggttgggtcggtacttttgtttacggctaggatgggtgaagggttatgtcacatgtttacgacgggttccaaggccatggaatgcggagtaaagatgtgtcttgtgggtaaagatgtacacctctgatcagagtaaatctattcgaatagccgtgccctcggatatgggcaagcctagcaatgtacccaagttagtggtttaattcttaaaaattgcttaacaactaaaaggtggaaaggttggcctgggttggcttgggacgagctgggacctaggtcgggttgccagtttggtctgaatcatcgtaggccttgggttaaggcaggttcgtgtgggtccacggccttgattaataatactgtgtagctctaggatcgtctttataaaatagctatgggcaactaagtgtcttttaaatgctgtttactgcaaaacctaatcccctatattattaccccttgtttcccttgcattaatcatgcatctcccggtgtgacttgctgagtactgtg

SEQ ID NO: 75818 - DNA, 19429 bp, Oryza sativa
ctgcccttggccttaacccccaccaccacagcccctcactgcctttcacctgcaaaaaccacttgcaaccctcacaaaaccaaaaaacgccagcagccagcttccctcccccctccaattttagcaacttctcccttaaaatctccccccccccccccccttgcattgcacctctccttctctacccacaccacccccgccgtctccgccgccgccaccaccaccgattctttctccggtgccacctatggaagagatgatcaagccggcaccggcaccggcgtcgtcggaggaggagaaggaggtggtggctactgctgctactggagaaaggaggcatgaggaggcgacggccgggagagaggagcaggaagaggaggaggaggaggaggaggcgccggtggtgctgaagaaggggccgtggaccacggcggaggacgccgtgctggtgcagcacgtccggcagcacggcgaggggaactggaacgcggtgcagcggatgaccgggctgctccgctgcggcaagagctgccgcctccggtggaccaaccacctccgccccaacctcaagaagggttccttctcccccgacgaggagctcctcatcgcgcagctccacgcccagctcggcaacaagtgggcgcgcatggcctcccatgtaagtaaagccccaaatctccggttgatcgatcgatcgagctgtctgttgttttccatctcaaagttgttgatgtgatgtgatgcgttgtgttctttgttttgtccccagctgccggggaggacggacaacgagatcaagaactactggaacacgaggaccaagcggcgccagcgcgccggcctgccggtgtacccgccggatgtgcagctccacctcgccttcgccaagcgctgccgctacgacgacttctcctcgccgctgtcgtcgccgcagcaatccgcggggagcaatgtcctctctatggacgcagccgatgccgccggcgccgcctcgtccgggtacaccagcgcgcgcccgccgccgctcgacctcgccggccagcttgccatggggagccggccggttcagctcctcgccgcgacgccgttctccgcgccttcgtccccgtggggtaagccgttcgctcggaacgcgcagttcttccagttcccgcactcgtcgcccgtgtcgccgacgacgccgaccgggccggtgcaggtgcacccggtcacgccggagctctcgttgggctacggccttcacgccggcgaccgggccagactcccgcctgtctcgccgtccccgggtgccagagccgagctcccttcaagccaattgcgcccgtcgatggcgcctaccacagccgccgccgccgccaccggcggcttggtcggcggagcgctgcaggatcacccaaacgcggcgagcctcgaggccatgctgcaggagctgcacgacgccatcaagatcgaaccgccggcgccgccggaaaacagaggaacggaagaagaaggcggcggcggcggcggcaatctgcgcggcgtaagtggtgagtagtgcatgtcgcgcgtgaagcattttcctcacattttccactcattggatgcatctcaagttctctctctctctctctctctctctctctctctctctctctctctctctttttaagtgtgttgctttattgtagaagagaacaaattggcatgattatgatgtgaacacatacatagatcagaggatgaacctttttgtttgtgcttccaaaatctccatttgttttcttgctgaattctacctacttcctgaaaagcaaattaaacaacaccaatttcatttacctcgactcacagatcactctagagttaacctgcttagtgagaaaccaagaatgggaaaaaaatatatttcttaccagcaaaaacaatagtacatattagttttaggagttagcaaaatcagaaacaggacagctctgcttggaaccttcttttgcttttctttttgatagttttaaggtaattagcactgcatctgcatgtactgatgtacagaggcttcagaggatttctttttgtccttgcaagacagtgacagcctacagtgactgcctttgatcttgttccatgattacttttccttatcttaccaagtagtactttaatgcctttatttccctttcgactttttttttctctctttctcactctgcatctgccgctttcctatactactacctaatctaatctgcagccaattcatgcttcctttttgttcttccatgattgccttgctcatcacctccaataacagtacgtcacattggtgtcatatgattcataggttaattgattatcataatcaagcaaatataaataggatcatatctaggataagagtactttttgggagattatctataggcacctatccaactagtgctgagcagaatcgatcaaaaattaattctgcgtaagttaatgaatcaactagttgagttggtaccaagaatcgaaatcgtgcaaaacaaaaaaactttcttgaaataatttcagttccttcatgagcaaatttttgacaaattgatgcccatcaagtctgaagatttttgcatcgtggggttgcattctgtactaatttcacttcaatttccaggtgacggcaaaccggaggtagagctcaaggacgacatcgagacactcttcgaccttatcataccggcgacgttcccggcggcggcgccggagcccgccgccgccgcgacggccgcctccgccgcgcccaaccactccagctccgtctcgcagcacagcagcgacgaccaggaccactccaacggcgccgacgtcctcgacctgcccatcctcaccggcggcggaggcggctcgtcggagcaggacgactggagcctcgacggcgccgcctgccagtgggacaacatctccggcggcatctgctgacatgaatttcgatgatcaacgctgcgtctgaaacattctgtgatcccaagaaccgctcaagaagagctcttttttttttcctttttgcgaacatttttcttggccttctttttttttttcatgtacctggggttaattaggttgtatcgatcgtgactgagcaaagtgcaaatcttcgatgcccccagtgaggcttttaacttcgtttttttttaattacaaatgactcggtctgagctgatcatatcaaagtttttatcggcatatatatctagtatctctgttaagacattaactgcctgattatcttgttagaatgttattgtagtgatatgttcttccaagcatgcaagaggcaaagattatagcgatcgatttctgtgatgttttgataacggtcttgtttcaagctggcagttggcagtaggtacacgctgtgactgactagtacttgtcccaaaaacgggagactgcaggagcacggagaacatccgtgtgttaggttgtgatcaatgtgttgctgccttgttggagaccaaggctcagattggctggcacctgatcgaatcatccagcaaccgagtctgtgactagatgccctgctagagcattcaggtgttgtgcctagctagttcgtgtacttttggggatattgcgaatgcacgaataaaatttggggaaatgagatcaaagtgccctccgctgctttagttgtagttttgtttttgataatgatttttttttgggcgaaacacactatacgcacgcttatatgcaagcacgaacagtcaccttatgaatacatacatgcgtaccctacctcaatttgatccccatttaaacgatatgatgtatttggccataatttaacttaagttacagttacactaccaattgcaatagaatcaggtccattttatttagtggcggtttttaaaaaatgttgtagaatgaaagtcatgctaacaatctccagtgtccagaaatatggttatctgcatcttagtcggtgcacaggctggaagttacacttggctataggagctccttaggagcatatactcttaattctctctgaaacaaattgagaaaacgagcttgcttatctgtgtagcatcagctttggatgggtaccccaaaaaagaaaaaaaggatggcattatgggaaacatatcttagtgaaatgtgatacaccaatctcatattttacaataacaaaatgtcaaattcaagcagtagcaggtggtcataaatccgtcgtgagattatagtggcgaaccatgcaaaaggtggcctctgctgccttccggtgtctcgtacgcagcagcggcaccgctggtcgaagaaaaaggagcagttggattgcatgatcagcaagtaccctccccatgctaaatacgtgttgcccattctttgctccttgcttcctgccataagttcctcccaaagagaggcttctctcttgttgtgactccttactgctctctgtcacggacagagtcctttcatttcttttcactctgtttttttttccttccttggggacaaaagaagcttctaatgattcttatgggactagaccacataatgcaacataggccaaggacatagcactcaaataggtattttccactatattttttttgacaccatattttccactgtatattagtatagctttaagcctttaaaggtggtttcaatcttctttgatactttctattttagccctcatagtttttcaatttatgtgaaagtccaaagtgttacactaaacacccagaacctagaaactaggccatgtttgggggagcttctagctgctgcagcttctcccaaaatcaaaagctcccccaaacagctcagcttttggtccagattctgagtagctgtagttgtagaatccaaaaaatgaactagaaaccagaagctaggaaacccagtttttccagattttcaaaagttggctaccaaccaattgtttctcagaatcttaagcttcccaaacagaccataaatctctcctctacccctccactctcccctctcttggaccctgcctcctatctcctctgccctctcccaccacctgacactagcagaatattttggttccatgatttcggtttaatatatagttaaaatattggattttggttttctgattaattttaccaccactagagtatatggttcaatgcagaaccatcgacaagctcgtgctggctgagtgaccgaataggacccaaaaaaaattaggggccccattttttctaattttaatctatcttaatgtgttccaacatgtttaaagctctttggttctatttttaaaaggcaaattttgctataggacataacgacttactgttttagctgtaggacaccgcacgaagtgagtattgggtaaagacaaatataaaaagaggaacttatggacttgaatcagacattgggttgacatccaaaatagagaggaaaagaggaagcaaacatagctagatcacgaaagaaagctcttgcaaatgtagctagctacgccttctcctccatttttccggtggcttttaccacccgatctgccaccaccgtccagtgcaaactatctagtaggccaagattcccccgacctaccctcctccttagtctctagcggttctcggtccatcggcgccatccttcgcctcttaaccaccccactcaactttgccccctactgtcggacctgcccaccacccattgccaaccctaccgctccagcgccgccacttagctctcctcccacccccactctcaccctgacccaaacccccaaaccctatctggttaggtcaccaccatctcgctgcatggaatcgctgcgacttgtcagagctaaggaagaaggatgctaagcacgaatcacccaaaatctataagattcattccccaaatttccattgaatgctacttagcaatccaaacaaaaaagagaaaatctctcgtatacctctgaaattttacctaatcccttctatacccctgaattttgcttactttcttgtatacccccaaaatttgattttgattccttccatacccctcccgtcagctaaccgttagttggccatctaatttctataaaaataaccattttaccctttggatgaacatagaaatttatgaattacattattaaaaatgtaaaagtttgtcgcatgagactattgtagttatgagtttttttgtgcgatacattatttatcacaaaatttagttttagataataaaataaaaaaatatgtatttatttttaaaaatcataaaaatgaggagcattcatacaaagataggaccaccaatgctcacaatattttttttatgaatgctcccgataaaaaaaaatcaattgtcctattaaaatttcaaataaatattttaatctattacatttgttttattttcaaaatttatgtaaaaatttcctgcactaattatttagtctcattagtttcataaaatgcacatactgtgcattcaaacaaaattttcaatcatttttcaagtttatattcaaatctaaagtatcaagggaaaaaatgatatttgcaaccaaacgtaatactgaaatgaaggaaaatgtaatagtagggacacggaagggatcaagttgaaattttaggggtatagaagggatcggataaatttcaagggtatgaaagggattgagtaagttttcatgggtgcacagggaattcacttaaaaaaaagatggacaatattgcgactaaacagtacatgtacaccaattagtttaacctgctaccattcttatatatctgaaaataaatgatatgcatgcatcatctctctcccacgtgggagtatgcaagaatgcaacagctcctaatagataagtttcaaataaaatcttcttttaaattatttatccgattatactattatattagttctaattaaacatttataataagaatttacatgcttatattctaattaaaaaaatatatgttgtaaattactttattatgtatgtagtattaattttatcgtatatgtacattatttttagatttaattaaattacttcttagatattcataatggtgtgagttatttacatttattgttatttttaagttagttctataatttgtgctgactaaattaaatttctcgatagactcatatttttaccctcgtagcggaattagttttattacaatgataacttactttcattttgtattaacctacttttatgatttatgtaaattactttatgctttattgaatttataaatatctaaaaattaatctaatcaaatttaaaattaatttaaatatatgacaaaagtagtttacaacacatatatatctcttattagaatataggcaaattttgctagatgaaattgtgacttcatggttttatctataggacaccgtacaaagtgagttttaggggaaagacattcagtaaatatataaattggctcatgggtactatgcccattagaatatttatttctagctgaatatgaaaccatatgaaagttataaaatacccatgggcacacatgtcaggtcaaccatctctcaatctctctctcgcacatgaacaatgaaatgggaaaagcatcatggtggtgtcgccgtgccatactcttcgaggtgtatggcgaggtggaagacatcgcggcgcacaccttcgtctccatgtagcaggagtgggcgtcgtctaccacgatggccatggtgctgatgacggtgagggggttgaaggagccgaagccctgagtagcttgggtggggcaatgtggaggagagatgcccgagtctggcacgaagccttgccttgatagcctcgttgctccgtgcgagcccactccatgccttgctcttggtctccgcctgtcggagccgctcctaaagctcagtccagcggcctccacctctacctccttctcctgccactatcgtgccgcggtagctaatgtcgcgttccgtatccactcgaagtccatccacactattgtgttgatctctacgctttgctcttgctcctgctcaacaccatcggctgcagtatgcttggcactatcatgctctagcgcattctcgcgcccctcactccttcttgtatgactttgagagagagatagagataggagacctgatatgtgggtctagaggtattttagaattttcacgctatttctctcccctactctactagaaatgattattctaatgggcacgatgttcattagaaaatttccacgtttacaaagtaccttctcccaaaagtcattttatgtggtacctcaaagttacgatgaactctaacaaaatttgcctagaatataattatgtgagattgtattataaatattttattgcaatgaatgtaacggtgtgaattagatggtaaattagataagtattttaaagaaaaaatataagaaggaaaaacctacatacatgacctaacaaaaacactcaatcaaacattatcccatagcgcacatggctaccaatcaagcctcgtcttacaagactaaatattgtgtgtgtactactatttagattttgtgttaattgtagcatatgtatcaacttgcctgcagcccatttgtcgaatggttggttggcacgacacaacttttagacgggttacaccgcgacaaacgagggtgatgcgattgctcgcgtttgatcagttacgaagtgggatgcaaatgcaagcgataacgaaaagggagcatcgcttacgaaaatcgatcccaaccaatctgctgcgcgcgcgcgcgccgccaaggccactcgcaagtcgcaaaatcatataccttcatcggcgtacgtgagtgagctcgagcaacttagcaagcacaccgcacgccgcgtcgctccagacccggccgccggcaacggtgacatcggccgcaggggcaattactgctcgatcgttgctccactcctcgccatggcccagggatgccgatgccaatgccatcataggcagcgctggcgctgctactacacttgttaataaatggcccgcctgctggctaaggaggaagccaaattccactacgatgcggcgaattcttgaaacttccttgtggcgatcgaggcccgcttgttaatgttcaatagcggcatatataagtccaatagaatggatggtacacccctactgtgtttcccttaacatcataggaggggtggtaatgggttaccctccaagcgataactaggggaaatttgtgcttcttctcattgattcaagtgttttacttgatttgtgtgttcctgccaaaaattcacttgatttgcgcgagcttagttggactgctgtgtcaccagtgctgggttgtacatcgtcgctgtcgggtgagatcctctatcataatgttactatcattatagtcattgttatatgggttccatccttctattgtcccacacgtcagtgcctgtaatgtgagtgtcattatggtagaggatgtgaacccgtcgccgtcgccatgtgagggggagactgactactaagttccatatagtttctaccttggactaccatgttgacatgttacatgggcaaatgtgacaaatagttgaaaaaaacaaccaccttagagggaaaaaaataaaagcaattttaagatgagcattggataattgccaaatctaataatggcaatagttaaattccccaataactagggtgcgtttaggagagaaggttgggaattttctctggcgcatgtaaaacatgataattcatgagcacgtgattaattaagtattagctattttttaaaaaaaataatatgattttttaaagcaactttcctatacaaatttttcaaaaaaaacatctttttacaatttagagaacgtgggtacaagaaacaagagagtagaagttgggaacatgtagttccaaatacaccgtaaacatgtggttcttaaccaaaaccaagaaaaaccagagaaattttaccgaaagttttttttatttaattgcttttaacttagcagatattcccttcgtctcaaatataaacattttgtccagatttatagttaaaagttattacatttttgggatgaaggtagtatatcagattgttttcattacacgaccacaagtccacgacgataaacccggttaccgcagtaaccgacggtaagaaaaacccagcgcggcactcaactgcacggtacattggtactacttcggcctttatttgccaaagatcaaattctattcatctcaaaagatatactccatcatcaaatgtgacgtcagttatcccaacatcaaattttgggaattttggcaggatagagtaataataacatggcccatcacagaggatgggccatggaatggtccgtgctaaacggtgtctggcactaatgcactgcagtctatgaaatctacgcaccacaaaaaagtgtataggaacggtgaagtcgaaattttgtttatactatggaagaagtgataattgcgtaagcaaatttttaaattcatttactaaattttaaaattcaaaagaattttcagccttatgccacaaaggcatgtcagggccacgttaaatctgatgcaagattgaaagtgacgatactttagagttgaatagtgttcaattttaaaatttaaggctgatccagtctctgcaaaagcttgggggggttctaaaatggacattttccttgatataggaatacgtttgatatatttttattttattgcttacaggtaagtaattatgatagtgaatgcagtttgctagatctagagttctagacagaaacatgatatgcttccagtaccctgtatgaagtaacaagcaatagaaagcacatgagcagcctatagcaatattagttcaatcatgacaaccaggccatattaacatgttaatcatgtacttataaacagataacaagaccaaggcataatcttccattaatacaatgcaactacattagttacgcatagttggcaaaaattttaatgtacattaggcagtagcatagcacatagcacattcataattcatagattgatttgacttaaaaagaaaaggggttgtatttgaagcacatattacagaagagcaattaaaatgaaacctactcaatttcgatatggtgatgcaagatttatatatacaaatctatgagatggtagaaactgactcacatataagggaaaattgcaaatattttttatcacaaagggatgctatacgattggcaatatattctataacgatgtttcctgaatcattgaagtatcgaaaagttacaaattcataattaaggaacagacttatattaaagatattagaagtcagcagtttatgacaggaaatggcatcactaaatcaccaatcagacaagaaacattgcatggagtccagttctcccgcttataaacaccattccacattcttccttatcgtagtattccatgtgcaatgtttaatgtgtaaatgtttcattgccacagagcaccgttatgttatcttgttgcatatatcaggtgtatagcaaaactgaacatttaataactaaatttacaaactgagattgttggtaaaaaatcgtgcaggataggagaccataccatagcaactaatacattttatagcaatcgactagttagtgtaatctgagttgattttaacagggttgtaaatggcaatccaaaaaagacgagtataaagcaactatttttttgcttcacaaggggggcaatttacatatcaacaattcagtgttcccattcatctagaaatgcgactaaatgcaacattagagcttcattcagataacaatacaaggacctatgatcagtataagaagctagaatgctagagcaatcccaacaaatggggcaaatgaatcccaattgcacaactactaaccttttcagaggccaaccaatgtctgaaacttttgacttcactaactgtgatccaagttttcatcacccaagtatcacaaaatgtccttgatgaagtcaagattgagcgtgtcgcggacaatcagaaacatgccaaccatgagtaccaccagtatacctgacgacatgatcctctgttcgatttcacgggggatcttctgcccaccacgggccgcctcgagaaggatcaacgccaacgtcccaccgtctaatgctggcaatggcaacaagtttattgcagcaaggttgaggtttatcacagccgcaaactgaaacaagccctcggcgcttgacctggccacctctgcgccaaccgcaatgattgcaactggaccagacaccttctccgccgtctgcgagaagttgaggaacgtctgcctgaggccgtcgagcaccgtggcgctcaatgcggtgaactcgcgcaaggcgaggacggtggcctcggccaggttgttggggtggacgcgagtgacacggaagtagggcgagagctgcacgccaatgcggccggtcccgtcgacgctggtgtccggcacgacggtgaggtcgatggacctccggtcgccgggtcctggccctgttcttgagacggtgacggagacatccttgttggggcttgccttgatgaggtcgacgaggacaggaacggaggggtccggtgcgaggccggggacggagaggatgacatcgccggggaggaggccggcgcgggcggcggcggagccggggatgacctcggggacgaggacgccggggagctgcgcctggacggggacgccgacggtgagcgcctgggcgtagacgatgaggaaggcgaagaggaggttggcggcgacgccggcggagacgacgaggaggcggtcggggacggggcggttgcggaggaggtcggggtcgtcgggcgggaagccggagtccgggtcgtcgtcggggaagccgacgtagcccccgagcgggatggcgcggagcgcgtactcgacggggccgaggcggaagcgcgcgagggcggggccgaagccgacggagaactgggagacgtggatgccgcgggaggtggcggcgaggaagtggcccgactcgtggacgaggacgatggcggcgaggacggaggcggcggaggcgacggactcgacgctggcgaggaggtcggacggggcggcggcggagacggagatgggcctggaggaggggtggcggtggcggcggaggagagggaggtgggggtggagggatagaggaggaggaggcttgagggtgggagagaggtgggtggtaatccgaatcatggtgggagggggagggggaggggaggaaggcggaggagtggataatctggcattctcttgttggggagtttgaggcgcgtggggactttggtggtgcgcctccgccgccggtgagagagtgaagtcgggaaatgtttgtgtggatgataagcgggtgacgctgcacagcagtaagccagaaaagtgagcatatgtttttctttttctctcgtttttaggcgcagaagcccgaaattcatttctcctgttgggctaaaagtcacacttatatgggcctgggaatctgggatgggcgtgggtcagcccgctggtaatgattaattggtccattcagattcaagtaatcaagattcgaaaaaggctatttatactccctccttaaagatcagatccgattgttattcctcaactataaaactgggtatatttactcctccaactattaaactatgcaaaactatactctctcagtggttttagaatggttttggccacatggagtccaatggatagcccaataattagagaaattaaaaactaaagtgaggctcacctgtcggtgattctcccatcttctcttatctatcctctctaatccccattcttctcggcctcctgaaggtcgacgctagtattgtcaagacagaataggtatcagtcggcttcgatatcgaaagtagtcttggccgtgtttggctttaattgggccaaaaacactagacgcaaaacttacaacccaattacacccaacacttcacataaagaaataagttcactttaggtccatcatcttaacgacgagtttaaattgcgtccttgaaaccataatacaaagtataacgcatctctcaacttgcaatataggtgtacacgagatccttaggcaatagagttattggttttagctgacatgacgagttgactacggtcaacccatcttaattagcacaggacccacatgggccccagatgtcagtggccaactcttctttccctccctcaccccttctctctacaatctctctccctcacgatggccctacacgagatggtggcgcgtgcatttgccggtggataaaggtggcgagcgatgggaagaagcatggcaaccagtaggggtgggcgttcggtttattagctcggcttggtttcatcagtttaaaagatattcggttttctagttatggcaaccgagttgtttataaaagaatacaaaaccaagccaaataaaccgagttacttcagtttggttgttcggttttaccgaacaaaccgtaggaacacgttgccatgagttccaaagcacacaatacttttttttttgcggggaaagcacacaatacttaagaaatcgcttgacggcacatgcaatggcagatcaagagacaaggagttttcttacctcacataccaagactgcaagagagtcatgaaacttggagaaacctggcaaccagtagactttaatacagatactccctccgtcccaaaaaaagacaaaccctggtttccgtgtccaacgtttgaccgtccgtcttattaaaaaaactataaaaaaattaaaaagataagtcacacataaagtattaatcatgttttatcatctaacaacaatgagaatactaattataaaaaaatttcatataagacggatagtcaaacattgacacggaaacctagggtttgtctttttttgggacggagggagtatgtggtagttgtacgtgcacacgctcagatcagtcgtctggagggagttggaccggcgcaacggctgcgacggctgcggcgatggtggtaaggtagccatccagccacgacttcgcacgatgatgagacgacgccgaacaacgctgggttttctaggagatgtattagtgttagattagtaggccttgggcccaattaaagagctgttggccttaaagtttgtacgttgccaggtttgtgatatgtgtctaacgtgtggttcagtttctcccgttttctcatattgtttggttcgtgagaattgaaaaccgtagataacaccgaagaccgatcagatgcaaaacagaagccgaagaataaaccgatgcccgaaaaaaccgacacttcttcagttcggctcagttttattcggcttgcggtcttcggggattctaacacgttgtagggttcttaatcttgaagggctactcgagccgctgcgcggcgagtttgaggccttccagtcagccatagctgcggttgccacccgtccaatccgcctcgctcgccgcctctcttcccgtcggtgacagcctttctctccatcacccgacgcccgcttcctagcctggagagatgggtccacgggaaggagaggaagaggggaggaagaagagttggcaattgacatgtgccaagttgatttagccaagttggtcacagtcgtcgtcacgttagagcatctccaacagcttctccatcccactctccaagcaaaaaattagctattttgaacaaaaattgtactccaacagcctctctattagaatagccaagccaaatgacttgccaaactcctctcctcaatggccaaatttagccagcccaaactgccttgccattggtgggtcccacgcgatacgtcttctctcacctcactctacgcgtcgtgactgctgcaagcggagaaggatgtggcggtggggcagcacgatggcaagcgtcaccatggcctcccgctcgccggccgccggcgtcgagggcatgaagggagcagcagcaacgaggtattgtcatcgcccgagctctcgcccattcctgcgcctctcctctccaatctctccatcacattcacgcgccattgcatcatcgatcgagcattcgactctccaagtagggagctggagccaatggccaccgccaccctccacatcgacggcgacgacgtcatcctcgacgtgggccatctggccgggcaggcgagcggcgacaatggcgacgcggtggacaatgcgttgatgaggctcccgtgtgctctcaacgcggtcggcgtcctcaccggcacgatggccgctgcggctgccaggagtggtggaggtgtgggccgcgatgtggatggccggggattgccgacagccagaggggagctcgacggtgctcggctgccgggagtggtcggcggggagagggagagtacctcggcgagcgttggcgttaggggaccgccgtccgtcggcatgcgttggcaacatcggtcgacgcctcgacgagaattcgggaaggaaggaaaggggaaaagaatgaaagagaaagaaggggggagagagaggggaagaagaggggagggaggctgacatatggatccgattttattttggagaggattaatagagagtttgttggagtgagtatctaatttgactgtctaaatcagaaggagagttggccatatgtatgtttggagagttcgatttggagagactatcggaaagactcttagccagaactaggcactgcccctgtgaccttggacacattgattttacaagttaagaaacataatttaaacttgatgtcaagatgatgcatcatgataacccggtccacaggggtacacagggtgaccactcctcttcccctctctgcatatgcgtcagccgccaggcgacggcggacggccaccgacagccgccgcatgcagctagggtcgtgcccgtgcgtgccggctttggcggtggcgtgtggcgatcaccggcgtcctcggaacgagcaagccaacgacgcgaggatgggacgggaccaggggaggagggcagtgccgcggcctgcagcggttgcgtgcaatttgcaaagcagtctggagcttggttgcgctggagattggagcagccgggtgggaaggagacgatcgagggtggatcatcggatcctgtttccgacaccaccacagtaaaggaaggctcgttcccaaatcccatttttatctgttggtgtgtaaaatgagaaatcaatgtacttcagttggttaatttttttttactgtaaactgtggactttatcactgcagagaccaaaatgaaggaagtatgtggatttgaaatcacactcttcttgttgtaagaacaccgaaattaataagcatcatgttctggatccatcagaaatgcctctcaagtcccatgaatcttttcgtatgctatatatttgtcaacatagattatagtttgtcaattgttgtttcattcatggattgaattttttttctaaatatgaaccttacatttagcttttagatacttcctctatccaaaagtctaatacctatttcattctttggttttccaaaagtctaaggcctatttgtaatctctatatgctaaattaaattgttgaccggaaccaagacgtccttttagtacttactccctccgtcccaaaaaaagacaaaccccggtttccgtgcccaatttttgaccgtccgtcttatttgataaaattatgaaaaaaattaaaaacacaagtcacgcacaaagtattaatcatgttttatcatctaacaacaataaaaatacaaattataaaaaaaattcatataagacgaacagtcaaagttggacacgcaaacctagggtttgtcttttttttgggacggagggagtattgtcacatgcatgtgtgtagttcattagttttgtcactgggtggatgagttaattacttcttggtcatggtgataaaagaaatatgtttttagatttttggatgaagggagtatctcttaatttctgagatatacatgcatttaaggtgctcgataaacacgtagctaaattattttattgttaactaacctgtaatctctctatgttaatttgtggtgttttgatattgtgtatattgttttcttttccatttaagtatcccatagtaactctgaataccaatagaaatcttccatctgccacagttttgcagtgcattccattgtatgggcttaaacataggaatctcagtaaagaaaagaatgtgatagttacaaccttttcaatcaagattcattatcagcggtgtaatgagatatatgattattccaaattccaatgcaatgtgcttgcttgatattatgtgaaatcacatataggtgaatttagctttggatgtggatttgtactgcacagtatttaactgcaggcagcgcacgctatccttttttcccactccatacagttctactattcattattcaatgtatgggaaggtagcctatgctcatgtatcaacagagtattttcattgtctgtttcttgcagaataaaccatgcacatgctgatgaaaagtgacagccagcatgtatcatgcatcccgtgagagctactatgcactgaaaattggtagtgttattctgtgttacatattgctactgatgacttgatttttattttattttttcaattaaagctgaaattaaacctcccattctggctgttgttcaagacaaaaggtccatcttttgctattttgttccatagcaataatgtcagaaaaagcctatataacatgtacaatacaacatatctgtgttagttatttaatttcttgcttgatctgtgaagtgaaatcagatttatgcatgattcttctttgtggtttatcagctgggatcacatgatgcagaaatatccaactttggtcttgtgttatgctacaataaggtaagtcattctttgacaaggggaagaaattccagcattcatcaaaattagtaatatttagtaaggaaaagtattacattgtattgaaagggtttcctttgtgacctaaattacaggtgtaacatgtttgcaagtgtaaaaaattatactaagcttccaagcatgcccttacatagtacacgcaatgtaatgttaacaaaaaatttggccatgaacatcgtgttgaatgtcaatttcatgagcacttttagcttcttttataaattcctacttccattgttggatacagattcaagatgatagatgatagacttaggctgtgttctttcccccattttcccaacccacctctctcgttttccacgcgcacgcttttcaaactcctaaacggtgtgatttatgcaaaaactttctatatgaaagttgtttaaaaaaattatattaatccatttttttaaaaaaatagttaagacttaattaatcatgcaataaaacaaacttcgttttgcgtgctagagaggaggggttccac

SEQ ID NO: 75819 - DNA, 4729 bp, Oryza sativa
catcacagatttgtaaatagagcatgtttcatcgtcacggtcaatcgccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagcgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgtagctcctcctctggtgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcaactgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcaccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccagtgcttctgatcgctctttaattggataaatataaccatagcgggagtaatcatctgtgaatgttatgaacgagtcatagccatccacacttttcacaggaaatggaccacaaatatctgtatgaatgatctctaaaattcccgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagttcctttgcaaagaaggaacataaaagacatctcgaagtaaaagtatgaagccattcgcgagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgttgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaatttggaagccatgttgctcattctaagtatgtggtctctaacaccacctccatggtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaaggtcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaattgacaaaataaaatggaaaaattgctactgttctct

SEQ ID NO: 75820 - DNA, 6538 bp, Oryza sativa
atcatcctaataaatacaatgcatgcatccaatagaattagagaacatgagagtggagaattttaaaaagtaataatttaatggaaaattggtcatagttaattgcctacatgcatgcataccttgtactcactccgtgctcgtaaaggaagtcgtttaggacaatgtttaagtcaaacattgggaatataaatcatgaataactctcaaattattgagtttgaaaatgtaaaaattatatgaatagaattttcttgaaaaatactttcacaaaagtatatatatatatatatatatatatatcacttttcaataaatatttttatagaaacaacaagtcaaagttgtgttttggagaccgtgtcgttgtcctaaacaacttcctttacaagtacggagggagtactattgaacatctaaaaaaatgattgtgccttatattatggaatggagggagtacttagggcagtcccaacccatagtgtccataagtagtgtctatggtgccatgtcaataagacatcataatagaaactacactctacaatccatggtttcttaaagtgggccattaataaatatatcatctctcttctctaccaatcatatttattcttcatctattatgaagacactattctctcccaatgcaaaacttgatagtgtctagtgtataggttctcgtgttgaagctgtgtcttgcatgagacctagtttcttcctctcttcacactctctcttaattaatatagtgtcacataagctaaaagtcctacatggcaatatagttaatgccatatacaccatcctaagtggagggttgggattgcccttattgtttgcccattattccttaataagccaaaacaattttgttagactttgctctaggatcacctaggttagatctagtcgggtggttctatttgggtttgatgaacgacattgtagatgaaagggagagggtttagataccgaccggttgaggagttcgtggaggaagaggcgccggacatcgtcgttgtcgtcgcggcttgacgtggatgcggcgccggtgaggtcgacggtgatgacggctgcggcagtggtggtcgtagacgtcccggcgatgaggcgtggcgcggcggtggcgtttcccgtcactggctgcgccccctctcgatcggattagggttttgtggggtggagttggcggcggcggtgaatctagaaacatgtgccgtgccggcctccaccctcttttatatggcgcagtgtgacgggggcccaccagccattgggctgggcgcccccgatcagggcgcggtcaaggcccccttgagccgttgggctcaaggggagagagatctatctaacaaatttatcaaggaataaaaaataatttataagtaaaacatttatatatgtgttttagtgatttaaaaggcaacgctgaaataaactactctgaaagtaccttaaaatcgacatcaaaattaaatttacaatttaaattttgctttggcttcgacttattagggcattcaatggggatcctacatactagtgatgtcattgcccatgaagctacaacgatcaaaataaacaaacttaggtgtgaaatatgacactgtccatttattttgagacagtgagtagatcgtatgaaaatgaagatggaaaggcattgatgctgttgtctccgtagatctcttttgttttttcctttcgttggcttgtgcaaaaacaaaatcctctgaatatatgtagtattctttagatcccaaaacgaggccccagtcgtgttaaagattgcggtaatgcaaatgcggttgttgtctctgtcagccggcactcaccacatcagccacagctagcttcccagctctttccatgtcaaaaaaagaacatattttttcagctctttctgtcacgccatacatgtgccagtatcatgccagtgaatgggcacacagctgacgtcttgctgactccatgtccgagccactacaccctctgaatggccagttttttcagggcctaattaattaattcgatccgtagtactaccgaaaattcaatctaaactttgaaatcatcagcaaatattcatagggcttatgattctcaaatcaaaggaacagaaaacgtaaaggattaagatgtcacctacactccatccttcagaaatttttccaagagctctcatcttatcctaagaatctatgaaataaatttgcaagactacaatcctcaggaaattggtagtgtccatttctataaaacgaacaatacatacaatggaaaaaaaaaatctaatgattcagttcctacaataattctataaaagtacttaaaatttaataatcttacttggctagtagcctagtactactcctacttgccacagcaaaaaagttttcttttcagctcccctcgtcagaagaaaaaaggcacgagaaatggggttcgctttcagctacaggcaggccgcaggcaccactccactgctacttccccttttctttttcaggcctctcacagtgtaagctacggggctcgtacccctagcctaaaaaatttaccccaagacactcaccccacagtgtaagcatccatatatgtgtggcttaattggatggagacaggtgaaggaaacgaagcccacagtgcctgttaccccaaatacgttacctcaagcccactgacgaaatttattccccacctacccttccacctagcgactcgtcttctcctccactccatcaccgtggcctacctctcctgccgcgccgccgctctgcttctcccgcgcctcctcgcctcccacaccgccgcgcctccttctcctctcctcccaagcagcagcagcaggagatggggcggtctacggcggtcggcggcggcggcttccgcggcgcggtctttggcggcacggtctgcggcattcttggcaacgactcaccatcgtgtgggcggctggcggttcttggcagcgcgcggcgaagactcggcggaggcggactcgagcagctgctccatccacggccgccgctctgcttcttctccctcgccgcgcctccttcccctccctctctgtctgccgcccctcccctctccctttcccactccgtcgcggcgatggtgaagggccatggtttggttgcgttgcaaatccatccattcactcccttgcgccgtcatggtcttcatcgccaccaccacagcggcactggcaccggcgtcatggcgcggccgccgcccgcgtcacactcaacgccatcggagagacgctttgccacagctgaatgtacacagaaaaaacataatattctctctctctctttgttttttgatctatttgtgttcttcgatttgtttgcatggttctgatttgattttgattttgatttgtatttgtgttgaagcaactggaagtgttctaggcccctccccggcagccaccggctcgtcgtcggcaccccgacccagcctcccgcgccaagcccgccgcccccaggagggcggttcggggatttcaccaggcgaaatcgatgtgagggcagagctcggccaggaacgatgcccacagtgcacgcgccttgctttttcggcgccgcgcgcttcctcgcttcgacgaagtttcgcgctccttagcttagggacaagtcgccaagtgaggtcccaggcgcatgctccacgtagaccaaaagctgagctggcgcgacgaggttacgcgccaactcagtgaggcctcagaggttggtgcactgcactactgtatttcctattcatctagtagaacactaggtagacctgggacttgggctgtactttatcgggccggcccaagtcacgtcggcccacacggtataaaaatcctggcccgttttggcactaagcacgatgggcccaagtcccacatcaactaggcacaatttccatctctgcagggcccaatggaccaactataaggctgtagctaattcaaccaagtaaaaaaaaagctctttcttttaagacaagactattcggaaagcaatgattattttcgaaatcaagctctctcacgaaatttctggcagtgtacggcaaatcaggtcgaaaactaaatctctgcggactaaaaggaacatatgattaattaaatgtcagctgtagcaattttaaaaaatagattaatatgtattttaaaaataaactttactataattttgttttaaaaatgtggacacaagagttggaacacaaattttgacaatttgactctttccaaaaactaattttacaaatgaatcgtggccaaaacttattttaaaaatgacactttttgtttagcgtcaaatcgtatgtcgctaaacttagacacctcagtgctacgtcaattggcgcagaatatcgtgtcaccgcggacgagagactgagtcggcgtgccaacgtgcattcagcgtcgttctatttggcgttgaggtgtctaatttcagcgccatacgatttgacgctgaacaaaagcgtcattttttaaataagtttgggcacgatttatttgtaaaattagttttcgaaaagggttaaattgtcaaaaatttgtggaagttggaaaggcggaggaaaggacacagccgaaagtttctgaaaaaaaaaaaaaactatgagcaacagtaggggagttgttgagtagtgcgatgcgatgcggtgggaggtggcaggcggcgaccggcgagatcgatgggttcttcgtcttccacctccctcgtctccctcctcctcccctgcctcctctccttgctcctcatccgcctctccacccacctcaaccctgacccgaccgccgccgcgccccgcttcaagaggacccctcccttccccctccgcttccgccatgacggcgccttcaagatcctccaggtccgtccgtcgcttcaagctcacctccactcgctagctagctagctcagcgagcttcgcctgatggccttcgagatttacctctggttgctcaccgggcgcggcttctgttctgtgcgtgtgtttgctatgctataggtggcggacatgcacttcggcaacggcgccgccacgcggtgccgggacgtggcgccggaggtgggcggcgcgcgctgctccgacctcaacaccacgcggttcctgcggcgggtcatcgaggccgagaggcccgacctcatcgccttcaccggtgcgtttttccccctcctatccccgctccgctcttggtggcgatctgcttcgcgcttgctcatctggtcgctgcccattagtggcggtccttgctaatcatgtgcaaaacttagtgctattgatatgtgattggttgattttttttttcactctcaaagtcatggaactagtactaaatgtgagtgttaatttacaagcaacataacagttactcacaacaaaaacaaattagttaatgctccatgtagtagtagcttagtagagttagctggcagaatgtctgaataattgtgtttacattcagaggggttgggtggaatatctcgccaaatcacttgttgtttgcctatgttcgcaattgtggagaagtatctccggcaatccactcgtgtattttcacgacccaaatgaaattacttagcaactagcaaagttctgtgaatccatgctttgggttttctgctgttactgaattagtggcagagtagaatcacatgcagtttccaaaaaagtttgactacatctcttcttctgggggtaaagaggttacctttttgaatctctacgttacgtgtttttttaaatttccttcaccaacaaaaagggggtcaatctggtttgcattgaatgcttgtgttgtttttaatcaggagacaatatatttgggggcagtgcatctgatgcagctgagtcactactcaaagcaattagccctgcaatcgagtataaagtaccatgggctgccattttaggaaatcatgaccaggagtccactatgaccagagaggaactgatggtgttcatgtccctgatggattactcggtatctcaagtaaaccctcctggttctttggtacatgggtttggcaactatcatgtcagcatacatgggccgtttggttctgagtttgtcaatactagtttacttaacctttacttcctggatagtggtgatcgtgaagtggtcaatggagtaaaaacctatggatggatcaaagaatctcaacttgcttggcttcgtgctacctcacaggagcttcaggtaccgctgatgataattactagcataatcacagcacccaagattttattggaatatatctccgtcattgtgaaagggggaaaatgcctttgttcattacttctgtgtttcttcttttacaaacttatgatgtacatgtaaatctgcattgagctgcattctctggtcaaatattttatcatttgcctgagcaaaacacacacccattagttaatctcagattattggttttcatatatcagtgttttttttcgaattacaaatacagtacttttgaatctatgcttctgagttctgactcacggtacttttgacagc

SEQ ID NO: 75821 - DNA, 11390 bp, Oryza sativa
ttatgatcgtcagctaaaaccacctgtaaaacaggcgaggtaattactttacactgattttaatacttaatgaagatgaagatgaagatgatatatacaattttacaattaaagggtaaaatcatattcgggtaatggttgtgggagttaaaatgcaccttttccatcggcgctcataaaatatcctgagtgctgctatacatacgaacttctgtctacgatgtttgtacgatgaaacacccttctctctctctgcatcagaacgagacaagaagactgacatgctccataagtccacgttagccgtccgtttgatcgtaggaagatcgtactcaaacgtatagcaatttccataaaatatcttgtctagcccaaattgtctttgacgtactaccagtcttacctctgctccggataaccagccaaaagctcttcaaacgcagtggcaaaagactaaaaacacttggacaatccaacaatgcatccggtagtactactagaatgggaatgtcgcgtcatttaattggttttcaacatcaccgcaaatcagaaatcaggagacaacaaaataaagggagcgctaatagcagaaaacaaaccccaactttacaacacttatggcacataaacgcatagcgagaacacacattaagggtagacttatgttgcatatcattgaaaaaaacacgctgcctaagaaaactgataagacgtccaacacttgcattacgagaatattaggggtgaaggttaaacaaatcaaccagttctgtattgaaaacatatgtgaagttgtaaaggtacggaagaaaatgccaaatagaaaaagtctatccgttgcaatttgtttacagcttcaacacttcctgtaaaagagagtataaaagaagttacaggagtgttgaaaatgggcatcaatggtccatcatttgatcagtgccagtacttaaaaaattacagacgtaaaaggagaacttagaaacctgaacagcagacatacttcaattgaagctaatttaagagagcactcaccttaagcttgctgttgcttcttctcaagaatcttcttccagcgcttttgatcgagcatcattgtcatgtcttgccagctgatataaataagtcaatgggcaggaaatatgtcaaccaacttgaattgcacaatgaatcaactgagtgatatgagcacatatggatgcacaatggccaggtttccatagattaacatatgactggcatgatcacatgggaaaaaacaaaaacaactgttccaaaaagtatgctaaaataatcaactggtgaatatatatgatactaaattaagatgctcaacaatgtaaaacatgaaaaataatagcattctagttcataatccatggccacacgtgcattttcagcctaaaatgtgtgaggtttcatagaatacttatgccttataacccaaacctgaacagactcaagtaatgctttatactccatccgttccaaaatataaggcacaaccacccttaacccaaagatcaagaaataattattatcatctcatagtttggatcaccctaataaatataatgcatgcatccaatagaattagagatcttgagggtggaggacttaaaaaagcaataatttaatggagaagaggtcctaattaattgtatgcatgcatgcatgccttatattatggaacataaaaaaaagtagttgtgccttatattatggaacggaggaagtacatgagaaacaaatggtaggagtttgtttgaaatcatgtgaccaataagtatataaataaccatgttagagtcacgtagagattacagaagtcatttaacttattgacatatttttaactttttagtgtaaaatggtcaagtaatgccaagttaattgaccaccttaacagtggagtacccacgaacatatgtacctccttaaaaaaggtgaatctacattctagatatcccctcatgcatccttggccaagacatcattgacgtgaactgatttgatctgtcaagtcagccaggccaggtcaacaagtttcggctaagatgcgaatcacgtctcacagccctgaattcccagctaggtgcaactagtcaattgaccaattccgacttcccaaacattggttggaccggcacactagctaaggtagatggccaggctccaaccacaacatgggagtaagagaccacaggaagaaaaaagttattcacacattgtgaacatctgaatataaattaccctcgtgacctctgtggacgcatcaaaaaatagtggatatttcaccgacttgtagactaatagaaggaaaatgttattccttagctatacagaaatttaataggaaatatgctatctgaattattcacttaatagttgttttaagtggcattatgacaatgcacttgggcccacaaatttgaaacatgacatgctaatcttaactatgaagttatcataattgcctgctatggctaacgtctgctagctactgttaaaatgctacacaccgcaatgcttgactgatgcactcttctctatgttacccgaagccaatccacctcacattgttataccagcaaagaaaagccaaccctggtaatgtcactacttctcaattggatttacagaagtgttatgcccatgttaccctgctgtcaagtcataaagttgagtcaaggtacccctggactgacttggcaacttggtcgactagtccacgacgacgactcggtcgtgtgaaaacaggggattcacttatcacctttactactattatactgtactaagcactatgtgttgtataaactatggactattgagtagccagcaagacaattgagttaacaagaaataaaactaaagtactaaacaaaatgtgccaattagcatggtaaattgatgatttgctatgactaatcacgactaatcgcacaacttgctatttggtcgagtcgtagccctctagtcgtgtggcttgaccaactttacaactaatctatgactaaccaggcaacttgattatgcacgtcacaaacatgtgtaataattcaagtgttactcagatcacaacagtgaaggttgttgatgggggtggtggaggaacgcgactaatgccctccagttctgatgtaattggttggccagttaggtcacactgtgacataaatcactaaaagtgtgggaggaccaaacagtaccatctacaagagtttataaaaacaatgttcaaaccggaagaaatcataaatttgatcccaaagatggaccctttaatcagtagattgaactgaatttcagctagtgaagatcatatttactcgtaaaaatatcacatataacacaccaccaacacaaacaccttatgttgatatatgcacgggatcaaataagcacagggcatttaataatggctgaggctctatctgttcgcaacagcttactcaatactaaagagttttgcagaagcttcataatttatatattgtgggtataaaaacaaactttttgtcaaagaaaacactgctgagcagaacccaataaacatttggtaattattaagaggttccaatacatatactcttaatacttaaatttattcaaatgcactgtgttccttgattcacattaacttaattgctttcctttcctgtgcatcttcaattcagaatgaatttattttttccttgaatacacaaaagaattgcacgccatctcattaagagaagttacaaaggaagaggaacacatccaaaaacaatcacgccacgcttaaaaactaaaaaaaggatcaaaccaacaccacaaggttggactaggtgcctattgctagtgaccgaacaaggaactcacgaagcgcagaggcaacaagcccagcaccacaggctgctctcttccacagtagaacctgaacattggggcttgccccctcgaatacacattcattacagtgattccatattttccagcttactagaatgatcatggagttgagccccttattttggtcttcaggaacacgtctagtagcaccaccagttagagagaagcgcggtagacttagggccttttgggggagattaagattccgagaagctgctgctgagaagctagctggtgagaatctagagaagctgggaaagcttctagttcattttgtagattctacaattacagatctcagaatctgggtaaaaagttggactgtttggggggagcttctggcaactgaagattctaggagaagctgcagctgctagaagctcccccaaacaggcccttaggcttcgttcggcagtgagcttttccagcttataccccacgttttccacgcgcactgctaaatggtattgttttttgcaaaaaaaaacatctatatgaaagttacttaaaaaaatcatactaatccatttttttagtttttttaaagctaatacttaattaatcatgcgctataagttgctctgttttgcgtgcataggggattagttcccaacaagctttgccgaacacagccttaggcatggaaaccaacaaattcagaatgaatttatattagggcaatctactgtagtatatctctttccatacaaaaaatgaggtcgaacagaacaaaaacacatggcacatttataccgaccaaacaataattatggagccccatcctggaaactagaacaagaaagcataagcatttgatttcatatgttggagctccaaaatttaagtgccagattttatattattgagttgtgaacacaagagttgaacaattttcttagtagtttttaacagaggaaaaaaaacaataaggctcaactatgtagtatattccattattccttaccatatttcataatcatctattgctgttatcttggggtaattttactacatgcattttgattttagcactgtttggttcctgaaacttttccctgtgttgtgtttacattaagaaatataatgggggtaaacaggaagcagggaaaaacattgtttgtcacctcattcatgtgattgccatatttatacccatgatccaattttacgctttgcacgcatctgtaataacggttatctgctagcaactagcatgccaagcaagttacgtaatctgggttaatcatttattaagaaaagaataatgtatgattatatatctaaataaactttcattcttcatttgctagctatatcagcatgatttatgcatcacatgtacagcagtagttgtttttcacctccaaaaccttttttaaaaaagataattcacttaaaaaacatattagctcctaatgcatatgcttttgcaattaaaagaagtccataatttctattatttgatcaattgcttagattgatgttgagcatcttgaaatttggattaaaattccttttggttgaagtcaactaaatagttgcatatgtgctgccacaatgtttcatctagtaatgacagatttcctaggtccattgcactacattaggtagcacaaaattaggtcacatagcaagaacatgcatgggaacaactttcaccaaattaaactatatacttgtccatgtaacctttaaagaaagttcactttaagacacaattgcatcaatcacaaccaaccttttgcaaacgtgatattgcatccaataaagattgaaatacacagttgacatccacaatagggcaggaaaacgatttagtggcaatggctaggcaaagcaaaccataatgtatgccacttatagtgaccttcccatagcacacgatagtacacacacgttgccagaatagaaggtagtttacaagataaagattgaatggatttatttattactcatgcattggatgagaagaagaaatttcagggaaatttttgtcttggatggaaggttttgctatggatgaggaataccaccaaaaaaaataaaaaatctactattccctgtacaaatatacctaactggacaaacacctagatccaatacgatgcatccacgaggggtatcaagcacgcaaagggaaattatctatctacacacacacagtagcacccatctagggagtacatggcaatcaatcgaaagaagacgataaaattcagatgaatcaagacgtcggagggggaggagcgggggatggaggagttggaagagcttactagtgggggagggacttgatgttggaggcgagggcggaggcgtggtggtggacgcaggcggcggcgccgagggcgaaggcgccggtccaggtggtgaccagccgctgcgggtcggagtgcggcaccccggagtcgcccctgtacgcccgcgcccagtagtcgtcgaactcgcccatcctcctcaccggaaaacctcggcctctctctctctcttctcctcctccggccggcggcgctaactccgggaagggattgggttaccacgcttcaggagaggatgtcctctcctatagacctgtggacttggtctatggaagatcgccttgggcccacgagaacgtccccgagcccgggcctcatgctcatgggcccattgggcccatgtggatatggctgaatagtgaatatatctatttgatttttgaaaagactagctaaatacacatgctttgctatggataaaatgcattttttgcgaaatgttctacccattgttctgctatggaaaatattcaccttgatttgattatatagatcgctatccatttagattgattattagttttataatgggagtagttggggtggtagatttaccgtcaccaccaccagagccttttaaagtagtacagattttgaatagggtttacaagtcgagtaggaattcatactagagagattttcttcaagcaaaagttttaaatacagataattttcctagagaagggtttcaattttcacatgagagttttgaatatataatggtttattagtttaaattgatttttctatttgtatttttttccaaaatattttcattcccagtttatagtgaaattcatctgtagatgttttactttagaacctcctatttaaaaaaagcgggaaactcatcttcaaaattcatgctaaaaggaaagttagtaatatgaattcaaaccctaatcaagaaaataatattaattcttgaacttgaatttaatcactgacatgttaccaacatactcccttcatatgatattataaggtgttttgatttttttctaagtcaaacttacttaagtccatctatgtttatagaaaaacgtagcaatatctacaatatcaaattagtctatttaaatatatcattgaatatattttttatactatctttgttatgtgttgaaaatgttgtggcattttctctataaacatggtcaaaacttaaaaaaagtttaataataaaaaagggtagaacattttataatataaaacaaagggagagggagtactttgattcctcgtcttacctttgtaaaccatgagccaccattcttctgtcatccagtcatcctctttagctatcatccagtcatcctctttagcgacattgactatgctagaattgtatttgggcttttggcccatacggagagtagttaaaataaaattctcaaaggtccaccttgtgggaggtatgcatgtgaacttcggtattacctttctagttcaaagatagtggtacaattttaaaagaggtggtgtctcctcgccacttgattaatgtgtgtggttgagaactagataacatgcactgcttgctaacctcacctcattgcgatgggggcgctcggcacttgcatggatggtgcgctaaattttgactcctagtaatggtcacaatctatctaggagtagttcggttatgagttgtggagatcatgtatgtcttgatcagatgctctgatatctttatcattttgagcttgagccaagcttcaagcaagttaacaaacctgagctaaaatttcagccatgtcaatcatgtatgccacctcgctctgctcactgcttgtgcttcgctccaccctacgcttcatttatgataggagaggaaaggtcctattgtgtggcaactgtacccaattcttttgttcgcctgctagtgacgtcatccctcttaatgagcaaacaaatcgatgttttatccctcttaatagtatgtcattcctatactcaaatgcaaatagaagggaattatgccaataggaaaaccgtcatgtcatcttctatatatgtcttgagcaaggttttaaatagcgggctaaggctcttagcggttgagccttgaaacagctaagggcagctttagccggctatagctacagttaaagcatttagcagttttgtaaaatatgagaaaaaaatcaaaaatttgatagaatttgagctaaaagttgacatatcacttatttcattgcacatagagttcatcaccaattcaaagttcatcacaaattcatacttcatacatagagttcatagttcctaactcatacaatcatactttcatagttcatactagaacatacagataccgggcacttgagttcatacttcatagttataaatttaacagtttatagtaaacaaataaacatgccacttgagttcttgacacaaataagaaacagttcatcacaagaagtcaggaacatgaccattaattaacaaaataagaacaacaagttcgtagattagaatattgcattccactaatcagattcaaagacaccatgagacttatcagaatcagaggatccctctgaaacatctccagcgccattgccatcaccatcttctgagtcagatgatgaaggtccgggctgcattgtaacatcattcatcaaagagtgcacactcctgattttcttctttttagggcgcacatgcctcttcctttttccttgagcctgtgatgtttctccctgtgatgctccatcttgtggatcatgttcagcaagctcattagaaagaggtacaataccagtaatgaactcattctcattatcagccacaacatcatttacttccttctctaaaggatccctgtctttgctgcctctcttgtttcttatagtttggagttaaatttcacaaagacaagatctctcatcctatcatgaagtagcttgttgcgcctctttgtatggacctatgaatacaaattatagatagataatttaaattactagactagcaatgtcaatgttttggggcaacaagtagcaggtaactcaattctcaagcaatcataccaatctgaaattatttctcaaacatataaacagctaaactatcaacaaatctaaatgtcatgtcatggtgagttctaagcttttacctgttcaaatacaaaccaattcctctcacaacctgaggagctacatgtcaaattcaaaatccttgacaccaatatcctcaaattgggaatgattgtgccatggttcaaccaccactttgctgcacaacaagttaaagttaaacaacgaagacaaaaaaaaaagatgatttccggcaatcatattaggttcagttcttcacttggattaaaattcttgtttctcctctgcctcatggcaatttcctttccaaatgtcccttgttgttcttgatacatgttgagttctgtaattataatgtcttgggttgcctcatccttaaccatctttgaaacacatgtaatcacaccttctctaaaggatccatcatgctcaatatctgacttatttgggtagtaaaagtatgggttaggggtaggagtcaccgctgctgcttgggggcaagagccactaccgtcgctggtcgcaatagccccgccgtcgccggtcgcaatcactgcccctgccgccactctatgtcacagccgccgggagaagtggagactgcacgagtggggaatggggatggaggatttagggtttaggtatggtctttggaccttgtgggcttcacaggccacacatgtcaaaagcccattttcattttatctctttatccaccgctaagtgcggctaaattccggtgttttagcggctatctccggctaaatgcagctattagcggccgataatatgtagcgtcaaactccgctatagccggagatttagaacattggtcttgagggatgtcagtgctaaaaccattttgctttgtattcttcaaatgattgatacggttacttgtagttttaaaagacctcacattgtccatcacgacaaagccttcactcactatttattattgtatttggtcctttagtgctaagcaccttggctgtcagcttgtccttcaccaccgcatggtccactatgacggagcgaccgagcattgcctgctcttcactatcttgccatagtacagtgaagttgttagttccaacgatccagttgtcaacctccacttgttacaaatcgatcgtatatatgaaaatctatgaataaatcaatgagtattaatcaacaccataagtggtatatactcaaatataagctcaaatggaaaggtcccaattaagtgtatgtgaataacctgaatcaaatacatgcataaataaggtataggatttgctctacataaatctatgcatacaaaatatttgtgtgaagtaagagtatgcataaatagagatgagacattgggagtttattgtcatgaccaaaaaatttagccaattttcatattattttgtgtattaaatgtctatccttgaatcaagccagggtacacaaaatggtaaattaataagcagatcgaaacgtaaataaaacataaatatttatagaagaggcacttagtcctcacacttaaaagaaattagcaacggaaagatgatcctactgtgacttcagctccattctacattagggtataagtcttagccctttaactctgtcttttaaatttaggcacttaacttctaaaagggaggaaatatattaaggttgagtaccaatcactatactcagcaagtcacaccaataatatagttgtgcaagggaagagaaagggaggtttatggatcttttgtataaagacagttgtgtacatttgtagtttaaaacagtaaaatttgattaattaaggcaagattaatctctactaaactacattacaccacgttgaacaagcccaaccaacaacctgaactacaccggttcattatgtaaagttaattaaggagcaggactaatcatggtgaaactggtcgatcgctcataactattcgactagttttactttggccagcgatgtatagttgtactcacaagacacaatcccctgtcatgtcaccatgcttggcttgacacatcaccatgcgagtgattgtgacaagacccttcacataacttacctcaagccatttacatcacactgcaggtttcgcccctacccttggcg

SEQ ID NO: 75822 - DNA, 3447 bp, Oryza sativa
atcccctttcagatcagcattctggcattgtctcaaagtaagccttgagagttccatagtgcgggcgaaggaatttgagaggctttgggacagaggtcattgaacttgtcgcagaacggatctcctgcctgttaagcataaatcaccattaacaagagaccaataagagaaatgtgaaaactgtctatgcactaactggttgaacaatgcaaagtgatgccaccaatagcagcagtagccactcagatgcgacattccagctgagcagatcaaacaatctcactatgacgcggtagagattagagaaattgaacagttaaagcatgacctcatagtaattgtgattaagtagtattatacccaagatttaagggcaaaaggataaacaagcctccaacaatgtgccgaagatctacattcttgcaacaccagcaattaagcagccaaaccaataactcgggcagaatttatgtggattttcaattctcaggactgtaagtttgcagaacaacaaactcttgcacaggacaagtaagcagtgcaaccaaaatacctagcagttaataatagtctactagatgacatgatcatccgtccaaaccatactatgaataatgtatggaacttgtaataaactaataggtagtgtgataaatgcatccacccaaacgaggtaccagatgacacaaaacagaaatccctgaactacgcatcacgcacaatcagaattatacagttccacaccatcagaacaatcctcgttacctcatgctctcgagggcgagcttctggacgccgggatcggtgtcctgcgcccgcaccacgtagagctcgagctgctccttgagcgccctggtcctcctaccggactgcaaccacgcaaagcaatccgtaagagagagatggggggagggaaggagatggcgaatcgggggtgggcgggtgggtagctcaccaggtcgtcgtccttcttctcatccttcttcttccccttgcccttggccggctgcggctgcggctgctgcggcggaggcgggacggggtccgagggggaggcggaggaggcgtccccgttggggtcctcgcgcggcggcatggcggagggcgagggcgatctccccggcgcgcggcggcgcggcgaggtagggtttaggaatcgagctccgcgcggaggcgagagcgcgagatgaggggaagggaagagaagaggagttggagactgctgctactggaacacgccgcaactcttggggagcgatgaatttcgctccaagaaagaaaaagataacgagagagaaagagagattcggtttaataaaggttttggtaataaactttcagtttgatgaaattgcattcttacattgttttcttattattattgtgatgatgattagtcgacggtttggctgattacatgttgggaatgaaaacataacatgggtacaaataaaataaaaacataacataggtaagtaggaaaatgagcattgaaatatactcctccgtttcatattgcaagttattttgactttatactagtaaaaatttcttaagtttgattaaatttatagaaacaattaataaaataaacatcaaattatattcattaaaattaacatttaatatatttttataatatgtttattttatgtcacaaatgttgttatgtttttttataaactttgtcaaacttaaatattaagaaaaatatcaaagcgacttatagtatgaaacgataatttttttattattttttgaaacttttgattttttttattttaaaatcaaacaattctaaaacttattttcaaaatctaaacattttagcacgtcaaccctcgtggtgtggcaaaatagtactgtcacgtcacccacaacgggcacgacaattttgtcatgccacgccagacaagatgacgtggtaagacaaacgttgtcacaccaattagaccgcgtagaaaaaaaaattgctagcatggcgaaacaacactggtactcatccattccatgttttttttaaccttttgaactttttaattttaaaattaaacatttttaaaactttgattttaagacctgaatcttttttagcgtggcaaaacaataccgccatgacaatttcagagaaaacgttatgccacatgcataaagaaataattacccgtaaacacggacacatatataagtcgttccattcgtaaggaatctaaccaaataaattatgctcaaattgtaaatgtttttcattgttttatgagattattggacaaattctctaggagaaaggttcgaggtataggtagcaaattgtactaaatccaaaagtagttcaagcaagctataacagtttgcacgccctgggcacttagtgacccttacataatttctcaggtgaagacaagactactttgagttttttagtgatttttaaatctatgatatgttaatctcgtgaactagcaaataattagtgaaattagggtaaaaatatcactggctgtctccatggatgcaataaaatgcaaacatttaattgatagaaaggatttataacagtagaatttcaatatagtagacactacatatattgtggcctatcatcgtctacgaccaaaatttatttatggtaaaacttttatactctattcatatagagttagcgatttaaaaagtcaaaaataagctagataagaaaaattcaaaatcaacttaaaatgaagttttaaatccaaaatttgccggtgaaagataagccaaccagcgaatgacggagctgctaacattctcatgccccatcgggtgccctaatcagccaaagataaaaccaaaaatagctaatcatgtccccatcgaatgccctcaaccttaatttcgagattgatttcaaaatattttcaatatagttcctttctcagtattggcttttaaatcaccaagaaacacgtatataaaatttttacctataaattatttttttctctaataaaccaaaacggttttgtagtgaatatggcaacccatgggctttcaaacattctacattctgtcagcctagtttggtttcaacctaaaaaagaaagcctgatctgatcggtgacagtcggagccacatgaaaacaacctcgccaccaccaccggcgcagcgcgcagtgtcgttcacgtgctgttgcttcttcaatgccgttgctgaataatcttgcgcctgccgcgaggtcactgacatgtcggtggtgatcagctcatcagtgccctctgcccatcactgaaagtctgaaaaaactcatccataaaagcagagccacttcaccagaattcaaagctaaatttatatattaatttagagtattaaatatagactacttacaaaactaattatataaatgaaagctaatttatgagataaattttttaagcctaattaatacataattagagaatgtttac

SEQ ID NO: 75823 - DNA, 1311 bp, Oryza sativa
gaacaaatttgactgctctttcaactgcaaaccatgcaacatcttcgcgaaaaaggaaaatcatttgatgttccaagagagatcacaaaaaacaattcagcgagtctctctgggtttctgattttccaaggcctatactgtagtgttacatgcaaactaggtttttgattcatccttcccttagatgatagtgaagtttgagaaaatgttcatcagattgtcgagtgcctcgggatagaatttccgtgcaaataggtagcaaggcctcttcatgccattccataggcacggtcttctcatcacttggtgctgcaagaccaaacaatttatcaaaatcctcctcaaaagaattgtgaaaatgtgaaaaaaaattaaatcgatttgtagaaacagtgttgattcaagaaatttgttcagccagtcagtcacattagaatttcaagttaaatctaggtaggaacatgtcaaatatgcatgcagtaaagaaggggagaacttgttcagtctcacagaactaacttgaagattctagtactagaaagcaagaagaggaaaagatcaaataactctacctttgcattgcttgtaacatgaatactctcatcaatggactgcaaaaattcattattaattagacaaatcccaagaatgcagatttttgcgaaaattggccattaaggaaataagacatgtatgtttccccttcttttgcatgtacaagtataccagaggctcaccgaaatattcttaagcagttcaaagcttgtgtcaacagccctgtaagctttaggatgccattttccttcagaccaatcaacatgtgtcactgaccaatttgcaattccagttggatcaaccatctgcaggtacaataacggcctgaaatcactgggaagtaaacacaactgaaaaacatcatttaagagtttttgagagttcttacattaaagagggttggcaaatagtgttcatcagaatagcagttatgccattcgtttcccggctgcaaaagtgcaatcacaagatcagtaaagagctaaaattcaggaaacaacagcaattcagtggtcataaagatgtagagaaatgaaccaaagcatttcattggtcatcggaattgattaaaaacaatagtagtacaagtcaaaactcaaaactactgtgtaacaaatgcagtaaggggatttgcactcgttatggtttaccagtgctagaccatataatgctgcatggtgtgcagaaaatacaaagtggggctttctatgtgcattcactgaggaaaaatcacaaggacagagcaagtagcctagt

SEQ ID NO: 75824 - DNA, 17450 bp, Oryza sativa
tgcagcccagacagggcaatgaaacgtgtaggcgatggaaggggaactgtggaagtccaacaaacacgggggccacatcttaatgaattggagcagatgcagatcgagatagtagagccctagagattaatttgtggcagagggggggggggggggagttcgatcgtatcctggggaatcaatgatggccatcaatacctaccgtgccaggcccggccaggccaacaccacaccccctgtggcaggcgagacacacgcatgctttccccctgcaccccggccggccggagctccgccgggccaccatccaccacaaagtacctagttattgcaaccccccaccgacgccattataatggccgcagctgcagcagaccgcgctacctttggctttgcacatatatcacggtatgatcgtcgatcgatatctgcgtgcatatgcatatggatggaggagagagatggacggaccggggctggagtccctggacccaaccaccggccggcatggcaccatgcaggtatgcatgcagcaattaagccaaccacctctcctttatcatcttcatcatggatgcacggccggcacccaattcaattcggtcgtagctagcatagcagctcaccccctctcttgcattaccattctactcgaatacccaataaaggtggtgtttgaatcttttaaagataagcattaaatgtttcacgcaaaaaaaattaaattgagtttaaatttttcgcacgaaacatgccatttagcagcttaaaaagcgtgtcatttattaagggtttcacccattgttcccaagatatactgggcgcacggaaaacagaacggtccattagcgcatgattaattaattatttactaattttgttataaaaatggatcattatgatttttttaaagcaactttcgtatagaaacttttttaaaaaatacaccgtttagcagtttgaaaagcgtactcgtgaaaaagcgagaagtggtagttgggaacacaaggtttcgaacgcagcctcagatgcataaatactataaatatatccatcctcatttgaaaaaaagaagtagaaaatgaaatatgctcaagacttttggattgagcgagtactaatttgtctagcaacctctagaaataaactctctagagcaggtacaatagcaggctataagctagctataaccacataacaagaagaaaagagaagagagagaaaaaagagggctactaatttatagccagctgtaacacggaccccaagacgttatgtgtgtatgagaggtgggatcggatattaatggtgtagtatatttttatagttaactcttgtatgaataggctacttcctccgttttataatgtaagactttctagcatcactactagaaaaagtatttttccaagcggccaaaagtgatttttgcaggtggggggttggaccgcctgtagcccaacgactacgaaaatctaacagcccgcctgcgaaaatccattcagaaaaacaaacaaaaaatcacgaggccgccgccgctgccctcctccggcgtccccgcgccgggcgtcgtcatcgctgccgccccgcgccgttgtcgtcactgccgccgccaccgccccgcgccgtagttgccgccgccggcctcccccctccctcctctggccagatctgggagggagggggtgaagggaggccgccgccgcggccctgcacgtcgtcgtcgccgccaccccacgccgtcgtcgccgccgctgccccgcgccgtagccgccaccgctgcccccgccggcctcccccctccctcctccggccagatctgggagggagggggaaggggagcggaacgccgccgccgcctcgcgccgtactcgtcgccgctgtccacgccggcctccccctccctcctccggccagatctcgaagggaggggggaggggagccgccgccgccgccgccggccttccccctccctcctccggccagatcagggaggggagggagggaagggagccacgccgccccgccaccttccacgccgccccgtgccgtagccgccgtgggagaggccggccttggagaggtgaggtgaggagagggccggccgtgggtgagggaaggggtgaggttttgagacttagaaaaaatctagggctcctatccaagtctatttatattcaagtctattttcacaggcggaccactgaagtggcgcctgtgaaaatcacaggcgccgctaggaggtccgcctgtgaaaatagatttttggactggcacattcaccccgatttatatttttgtaggcggtcatttggctctaaggtatgtccgcctgtgaaaataagacccccacgtcgagaaaaatgctttttctagtagtgcatcgcccttattcatatagatgctaataaatctagacacatattagcatctatatgaatgtgggcaatgctagaaagtcttacattataaaacggatggagtattaaatcagctatagatgatttggagccaatatttggctatactgtaaacttgctcttattattagagagatttttttttgtttggggggtatataaaattatactccacttgtgtatcgtgtattcattcattcatgtagttgttttaatttacacatttatatatatgtgcttcccagcaacaaaagaggacactattaaatatgctaattcattgcttgacctggccggcggatgacatggaggtagttgacaacataatggcatatagtaaaagatttcaataaagaaattaataaaccatgcatggcatgcaataggttgcatgatatataattctaatatatatataaactgtatagaatagtatgttggggaactctacttggcaagaatttagaaactaattttgtgacaaactgcatatagcataatataatttgctctaaaaagagcagcacttactttaatatgtttatagtagaaccatgacaatagtagtagtagctttatccgtcacacattgaggtcttaaactagtagtagtagcttttatttatttggcacttgtcttaatttgatctgtttccatctgaaacttctcctgctcccagctgaaccagaattatataggacgactagcatatactctttgccggcccgttccggaacttggagagaaaaatgttttggaaacaaaatgagatcatgatgaataatctccggcagcaggcatcaacggcaccaaccgaggttgctgtagcacttccaaacaacatctccctcgattgcatcctgcccttccttttctgcccccttttgggggccaagtgaaaaaaaaggtcgcatcatggtgtggcatagaataatacttccttcgtcctaaaatgaagccatttttgatgttagcatgggtattaagaaagtaggtgagaatgattggagaaagtgtgtgattggttgaaaagagaaagtaggtgaagaagaatggttgtgattgattgagaggaggaggtaggtgaagaaatagcttcattttaggacaagacactgtgctaaaaatagctatattttaggacggagagagtagataagctagtcccgacccccctcctctcctctcttgccccgcctatataatccccaaacatcgctttctcttggagtaggagaagggtagtagtttaagctatagctctaaagacatcaccatgcaacattacttgcgttattactatacctatccaccacctacacattttgtcatctccctctctctttctctctgatctgtctcagatgtttatgcacatatacaagttaatagttctgtggatctagcaatcccggcttgtttgtttttgctgctttggtttgatgatagctagatatatcgagagggagatgaccagtaagcttggaagaggaagaaagagagctgctaggcttgttgcggtctttttgcttgggtaaaaagaggtattggcgtgcctcaatccgaaggcatggctgattacaggcacctcgaccgatctagcgcatgcagccatgtttcttggattgagccgcgtcaatatctctccttgcttccttacttcatgtactgtgtcatgctcaagcatatgtcccctctccgatcttcctacctcgtcgagttcgtcggatcagttcccaaattaaaggtgttatatatatatatatatatatatatatatatatatatatatatatatatatatatatatatatatatatagtaaatttgtttggtgctccatggtgcccgggcaccattgttgaaattgagtatatacccaattcaaatgagtatgaaactttttcaattacctaggtattaacattaactactttactaactagtttaaagcaagtttgaactgaatttgaacttgtttttgttagattttgattctaggtatatagcatccatacatataattagttaggtatgtaatcatgtattgtgaaataaagttaaatttgagttgttttgttgataagtataggtatgaatcaaattattataactaggtatatactcacaatttgaaaattttaaaaaatttgagtgattttgtgcattagataccatggtgcccgggcaccatggtgccccatatgagtgtcctatatatatatatatatatatatatatatatatatatatatatatatgcttcatcttttctggggttcacgagtcacacagactagctgctttagaagtagtactatgtattgtgcatgatgttcacagttaaatctgcaattttttccatgctggagtgtttttataggtttgcggaaggaattaagttgaatatatatagctatataattatatatatatttatcttgcgatcctgagtcttctgacattttccatccaagttgtaggtctgatgcatggcttatttcaagatgtagtttctggtttgcttactaataacatctcttcaggtattcattaattaggaactactatactttacctactggaaggaggatttgtttaaatctataaatttgtgctggttgcatcctcaacaataagttacactgatctctctgaaccaagtacttcctctagcagataatatatgaagttagattttttttttcaaggtccaatgcatggcttaaatcataattttatattagataaatattataagatctaataagtttatgagattacaacagtacttattggtgacggtcaaaatttgaaaaaaatcttattacaaatgttaaattaatatttgtgaccggtgggagcatgtatctatcttaattatgtgttttgggatgcttttattatatttttctgcataataaaatattttttgagctcttttcattctaatccccccctccccccccccaacctgtgtgtgctcctaaaaagattgttccctcttatgataagtaatactccattatttcaaaattaaactaacgtatgccatgtaaaggaaaatagagggattatatatacggttatgcttctaacttcacacaagtttataactatactagttaggcacttcgtagtagctcacacataattagacgggaagatcttggatgaattgtattgttatggctgtagatttgcatttaacatcgttctgcatattaaaaacccaactgttctgaatgttgggtaatttagagctcatctattataagctatgggcttaattatgacaagttggcatatattaactatgaactattaaaacataaaaaaaaatctgtaactgatagtctatactgaagtagaacaaaataattacaattttcaattttataaaattattaaaacaagaaaaatgatgtaattgggaccccaaaaccgcgtacaactacgtattattaacaatttttttattaaataatgccaactctataattgagtctccaaacacgaaacaattcaatttttattaatttcaaattttagactcctcgaagcccttgtagagcaaaagagctgcacgttaactcctcacactacttaaaaaaccatttttccaaacggtcggttcctatttttgcgtgtggttgagccgctcatctgccctaaaatgtctgcaaaaatcgctattttttcatgcaggtggcgcaaccgcatgcggtaatttgattttcgcgtgtgggtgcttatgtcgtcctcacgcaaaaacaaaaaaccaaaaaaaaacaaaaatctcaaaaatcaaaacatcttgccgtcgacgctcgttgtcgtcggtgctgccgcccgccgtcactgtcgccgagtatgtgtggggttaggctcctctcgtcgtcactgccagatccgtgcggagccaggtgagggacagcccccgccgagcccgtcgcctgctgtcgagccgatcgtcgtccactgccgcaagctatcgccatcaccgagttcgcgtggggccccgctccttccaccgccgctggatccgtgcgaggctaggtgggggacagccaccgtcgccaaatccgagtgggcgatgacaccaccgagcccgggcgtcgcccgctaccgagccaccagccgctacccactaccgagtcgtcgccgccgctttggaatgagagaggggaggaatgagaaatgagagagagagagagaggaggtgtgaatgagggagaggaggttggagaggaggggagataataagggacttggaaaaaattgtagtgttgagagggaaaagaaggcaagttagaattctagcggatccccttaagaggcctgcccaccaaaatatattttctcatgcggtcctttaaaagatccacatgtgaaaatatgctcatttttttatgtgagtaagttaagaggtccgcttgcgaaaattgatttttgcatacatgcattttaaggagccgtacatgacacggttaattatggtccacttgcaatttaaaggggtctcattcacaaaaatcatttgtatagtagtgtcactagctgtcgtcgttgataattcatgttttatttgtggtttctctcttttctatatatttaatatgctctatggagaactctttaattatgggaaaataagatcgatacttgaataaagatatatatagatagagagagtgagttttccattcttttaggttgacggaaggattgctatggtttttctagaactagcagaaagaccaaaatcgaaacgaatggacattagtatatacaatttggcttggtagtggtacgagttatctcttggtgtagcaagaaggaatttttttttatatttatatttatttttaaaaatatttaaaaaataaattaccattttaaagtttggcaaaaatatactcctcccgcccaccctaatagagggagagaagggcctaaatgtaaaattttctacaacacataagacgtagttttgtactaattgtaaaattctcatatgatgtcggatgaagttaaaagtttatataaaaattgtagagctcgacgatatttataactttgtagttgacaactttttcattaaaataatttatgggtcataatatttatatttatatttgtatttagccccctctcgtgggttttcactaatctgaaaattaatattgattatttcatgctttaatagttttaaatgaatgaatggctaagtacaaaattatagatctcgtcgagctctacatctttgctatagagcttgtctccatcggaggttgtttaaaatgtagatatgagaatttgtaaaaataaatctaagacattataaggaatatttggacccataagttattttaatgaaaaattaatcaactacaaagttgtagatcttgtcgagctatataattttcatgtaaactttaacttcatccgacatcatacgagaattttacaatcatacaaatacttcatgctatgtgttgcagaaaattttacatttagagggtgagaaggatttaaatgcaaatatttttgaaccccgtgctgctacatcacataaatcgctctctattagagggcgggaggaggatatttttgcaaatatttgaaacggtaatttatttttgtaaatcttttaaaaataaatataaatataaaaaagttctagcaagaagcagctgtatgggtggtgtgggtcaattgggttgggctgcaaggaggaggggttgggttggaaggggtctataatagttgaattggatacatctgatttacgcatttttacatatatcttattgaattgaattcctttttgatgaaaaaataaagagcaaccatgcttctacagtagttgtgactaggggtgaaaatggtacggaaatggacggaaaccatcttttatcggtttcgttttcatattttttttcggaatcggaatcagaaaccccggatacgaaaacggaattgaatattatcgaaaccgaaaacgaaccggcgcgaatacggtaacgaaaatttatcggaaaaaacccctcaaactgataaatccaattgtcaagtctcaacggtcaacaattcatcataaaacacaatcatataagtccaattgttaagtatcaacggtacatcacaaaacacaatctatggaataaattatctatctttaaaagagtaatgctgttgataaatcctaaatgcaggaaaaaaatattcttatgtaattttagatttgcataacaaatattttttaaaaaaataacagccaaacaccatggtattcaatattcaatgcttaagaaaaaagaatccagggtatttcagttacaaaaattccagtaattccgagaaaatttccgaaaagtttctgaccaattctggagttccgatggaaactgcccatctcattttttagtccgttaccgagaaaatattgctgaattcatttccgtttccgaaaaattctgactgatagattccgttttcaaaaataggttcggaatctagaaagttttcgtacagttttcactcctagttgtgaccatatggtgcgatcagatccggcctgcattcatcttggcgattaaggcctcgcaagaccaagcaaagtagcatgcatcccaataaaagtaaacaccaaggtgatcttgacatccggtgatttccggcgaagcggcgtactatattccggcccccatcatttgtcttttagatggaacaagccaaatggcatatttataaaaaaaaataatttgtgaataaaacttttatataggtgttctaagcgatctaaaagcaaaatctgaaaaataaacttcgatgaaaaaacgttaaaatcaatttcaaatttatggttgaaaatttaaattttggctgataagcataagcgaaaagatgaggctgtcgatacgacggcgggtttcagattgatgagtgttgataccaactgtaggaccaagcaacgtagttgagaagagttattgttccacatagtatgtggtattgaaaccttggaaactgaagcatataagtagatgatagtataaacaaactgaatataaatgttgttagaatgcattttgttggaccaaaatgctgcagtttggtgggaaggaaattggaggaaatgactgattcatgtacatcaatacaaattgatggggtagagccgtagagggatcatcagactgcaggagaatttttgggaggaggatacatggggcaagagaaataaatctactcatttattggttcaaaacataactggaaatgtaaaccgaatttattcaagaagggtacaatctatttgtgcaagtaccctatatatactacttagatagcttttcagactgaaaatgtaatagacaaccttatcagagtgcttaaattcagagcacaaatggtaaaagagaataggcaaataggcattccttccctactccttcagaaacatttttctctaaaagagaaatagcaaattgaaaattgtagtatccggaagaaagtttaccatcactaccatgcaggaacaatgtgccaatatgtatgcatactaaaatgcgccattctgctatttttcttaaattcttcatgcttcccaatttttacttgaattttcgaagcaaacttaatagttttaaagcaacaaaaaccaatttccgagtttataaaaatgataaacctaaatataatcctctccttctctttgggccgaatctgacccaaagctcttactctttcagcccgtgcaaaagcgtccacttcttatacccctccactcttctcctgaaaaaaaatgcatactaggtcccttatttttacatcggattacaaagtcatccctcaacttagggtgtgtttagttcacgctaaaattggaagtttggttgaaattggagcgatgtaacagaaaagttggaagtttttatgtgcgtagaaaagttttgatgtgatggaaaagttggaatttttttttaaaaaaattacaactaaacacggtgttacaaaaccaagtcactctagatagttttgaccggttttatccgatatggcagctgagtcagcgtgagaccgatatggccagctaagtcagcgtgagacatgtaaaccccacgtgtgagagtaccctctctctcccttcctccttccccatctctctctctctcccacttttctcgtttcaagaaaatttcatctgggcaggccagccgacggggcgatcgaggcgggagaggaggaggtccggcggcgcggcaatgcgggagaaggggcaacgcggtggtggcggcagcgacgcgggagaaggggtaacgtggcggcggtggcggtggccgcgacggggcgcggaggaggaggcggggccgcctgctggagcgtgcggatgcggctccgtcgtcaccgccggctgtagagcgtcggcgcggctccgtcggccaggcgctgcaagaactagcgggagtgcgcaggaggaggagccagacgatgaggtggcggcgacgatgatgtccggacaggttggttcaaacatgaacctagacggcgagctccggaagatcaaggaccaattcgcgacatggaagaaagactacaagtctcggttgaaggagaccaaggtaaatattcagaaggttggtgaggagaaatgccggaaaagatggcgggggaagaagagctcaaagtgaatgcatttaatctaaatccgagtgcatttcgcttcattccctgctactgcatcaaagacgagacaatggaaaagactggggagtgaaaagattgcagcctcgatgttgaggttcttgtcttcctcatcacaaggctgacaagatgacgacgacgatgagctccatcgtcaatggcggtgctggtactcgtccggagttcagcttatcgaagaaaggattatatatgtgaaagcaagaagtctgtacatgcatattagttcttcgttgtcagtgcatgtatgccatcttgtatgtagagagatgaacctgagatatggaagggtaattaaatacagattatccgccatgagcgaatagagataatgtaacatcagtcctgtaatatgtgtacagtaaaaaatcatcgaatttgcaaggtgtttttactccattcctgccttgtctgcaaatatcttgtctctgtcgcaactgaagtctgcaaaaagattgttccttcagaaatctgaatgatgaactctggtgtactttttccctcttctcccatccctcgtgggtctccttctccccgttgggccgcagccgcccctagcctcctcggcccgcagccacagtggcccagctccccttcccccctcctctcccgcacgtggtctgcgtccaccctgtcggcccacgccgctcgcccctgcgcggaccagccggcccaagaaggcgacgcgtcatcgtcttcctccagccgcgcctgttcctctctcccccggccgaacccgagtgccgccaccacgcccatccacctcctcgctcgtttccacttccgattgattgcaaaaattgtttcctggcattgtggtcgtgggcattattacccccataaaatccctttcagcggagctttcaatcgtcggtttcaagtgcaacaactccaccacggccggccggccggcaagcttctccctgccgttcccgtcctcctcggcctataaggccttggtaggcacgtggggaggattttcccgggaaacgtcaccagggagggattggatggatcctctcccatcaccataatcccctctacccttccgtccagaaatttaactatttgccacttttagatttaccaattatttaaatatccttcaaaaggtttgtacttaaatttttttttgccctgcttaatttttttcccctctaagatggtggcatcttaattatttgccacttttgtctatctggcatgccaactaggggtgaaaacggtacggaaatttccgagaattccggctaccgtttccggtttgcaccgaccgtttcaatcggtatcggtaattgtcggtatcggaaatggaaacggtaatctttttcggaaatggtagcggaaatgatatggggttttttccgaccgttttgtcggtaaccgttttttatcggtaatttccgtcaaatttccgacaaaattccgaagaaggaagtcggctgggcctggctagcaggaggaggagcccattaggcattaaggagcagcccattccgaataaagaagccaactaggcctgaccgcatcgtcgtcttcatcggcgctagggcaccgccgcgccatgttgggcgccgccaccaggtcgccgacgccggccgcaacctccttcgccccgacggccttcgtcgcagccggccaccttccctcccccatgctccatcgccggcttccgtgccaccgagccaagcaccgagcgccgccgcaccgccccagcctcctcctccccaccgatgccgcccctttctcctctctccttcccccaccgccgccctgcgccaggccgccatctccggcgcctctctcctctcgggcgcgcgtgaaggagccaaaggcagagaagagaacgagagagaaaacagagaagaaatcgagagagcaggaaaaggaaccgagagaagggaaggataagagagagagagaaaaaataaaagaaagagaggaaaagaaagactgtgggatccactggcgggccccaccatcttgactcctctctgtgatcgacctggaaataccaaaaagtctagtttagcatgaaacttaattacaacagtagttatacagtgtcaacataaaagttcttatgcaatgtgccactgtaggacgacgatatagctatgtcaattgatgatgaaataatgaatgatgtttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttatcaatcttattgtcaacttattaatcatcatataacggtgttgtgtggcagcgtaatgatgcaagggtgaaattataaggtcatcttcatacatagttaaatgcgggatgataccacagttcgctgtttccgacatgaattttcgacttccgtccgatatcggtatattcccgttccgacggttccgtttccgagataccgatataaccgatatcgttaccgtttccgagtataccgttccgattccattttcgagaaaataaaatgaaaatggaaatggtagagggtttttccgaccgtttccgaccgttttcatccctaatgccaacaccgtgtaaaaatcgacgtgggacccacttatcaaccgcacaactctccccttcctctctctctccggtctgcttgtcggcgtgctcctctctttcccggcggcggtagtggagcgccggctcgcggttgcggaggaagagggggagtcaagcgctgctcctttctttcccggcgaagaaccatctcggcggcagcgacggcatgctggctcgcggcggcggaggtgggggagccatgggagggagagctgagtgccgccacagtcgaggatgggtgtacgcgctgtaccagacgtgcgagatcgtgctcacgtcgtttgcgccgacgatggttgccgtcctcgccgaacgcttgcctgcctccctcgccagcaagccatggaaggaggagggggagccgagtgctgccgcgagtctgacctccgcctcgccgtgctcagccgcaatcacggcctccaatcggccgatgtggcctccctccctcgccggccatccaccgacgacgctgacggctccgcatatctggtcgacccgtccccgccgccaacgactccatcccccgcggttctgagcttgccgcgctcttggcgaatcgcgcggcgaagcgaaggtcggactcccggcagggctcggctcccccctcctcctccgcaatcgtgagccagcacgccgccgccgtcgccgggaaagagaggagcagcgccggcaaccgatgggcagaccggagagcgagaggaatgggagagttgtgtggctgacaaatgggtcccacgttgatttttgaactgtgttgccatataggcataccacataggcaaaagtggcaaatagttaagatgccactaccttagagggacaaaaaaaaaagagcaaatctaataagagtatttggataattgacaaatctaaaagtgacaaatagttaaatttcccgattacaaatggcagggaaagctaatgtttgcttcagacttcaaacttaggccaaacaacattcaacactgctacttaatcttcatatcatagaaagtgccatgataactagaaaacatatagtcttgaaatttaaaaatagctttaccgaaaatttgaaatatcgtaaataaaaaagtaaaacttccggagaaaaataagaaaaatctgaagactgcctcaaaagattctaaaaattctcaataccacataaaaagatctaaaaattgcttgatataagggagagtgtcgaaaaaaatcaatgtactgaactggaaaactaaaacattataagggttactttgcatctttgttacttgcatacattgccaacctgacgcgctcacgtggcattcacgttggcataaataatatgtgacatgtttttttaccagatttgcaccctcaaacaaattaaatgattaatttgagcaatttataaaatgagtgactaaactacacccatcttacaagttgtcgtaaatgtgggtgtattttcctaaaaataattataattccaaggtgagctgctaacaaaatgtcaatcaaaatgtcaatggagaccaatcattcacccattcgcaacacctgatttactcatttttaacatcatatccatcagcacgatcaactaggataagtacactgaagactaattacattgcatacaaacagaaactaagagttccaaaaatccaaattctccataagtgcaagaacaaaagcacattactgcaaggctattagtagctccattacctgcgagagggagaaatgcattattggcagtgctctgcattgggcactaatccacgctatgaatagttagccttcaagcaaggaaaataaggctgcaagagttacagaaccaattttggcatgcaaatccactatcacgcacatgtccagactgaaattaccggagctaatggttaaagattaatcagtaactttctgaagttattagatgtatgtcgtacctcattgtgcacatgtatgatctaggactaaatatcacaagaagttgaagtcagtactgcagaagtgcatatcattagcacaacaaatcaacaatatgagtacaaaggactatctaaatgtagaccgcacctttctacgctaacatatagagagcaattgatttatgccctagtataaattccgaacagggcatgtcagtcctcactcaagtctgtttcctcttttgaatgtgaggtgagtaaaatgcatagctctcaaaaatgaaatagcttacaaaaatcaagcaaattttagaactttctatgtggtattcagaattttcagaatctttttaggcagtctacagaatttcttattttctccagaatttttttattagctcataatgattaattcatttactgaaaacagggcatggcagtagcaattgattgaggccatgtcctgtttggacttttctctatatgtttgtaaaattatgaactcttttcagtaaatgaattaatcaagaacacacagaaacgtttttttgagcttccatttttatgaaaacaacattatctacaatttttttttatgaaaacaaagacaatcagttttcatttggatgtttagcagcaaacataatagagaaaattctatttatgcacttataaaaattccaaacagaacatggcctcattcaaacctgcttcctcttttgaaggtaagtgagtaaaatatagctataaaacatgaaatttcttttaaaagattcaagttctttaatatttttttctgactttactaactcaattggacctttgaaaggtaaggtgtaatctgttatatgaacgcaaacaaacttgattgcattttgcgccctagtgcaattcaactacaagcaatcaccaaaaattataaccttaactcacccataatacacacatactgcttggtgaatggaataaaaaatagaagcagtagctgattcacgaggaacaaattaagcagccaccttaccaatagaaacgagcttggcagctaagtgagctaggttggcgaacaagcccttcggcctctggatcccccgaactgcttcaactagacagaagagaagatcatgtgagaagacgagagcggcagggacaaaccaccaactgcttcaacaagcaatgatgtaacagcagtaaatcttttttaaaaataatgaatttaaacatatttccaacttattttcaaacttgaaatgcaatgcttggataataaaatttgtgcatggtttgtttatttatacacttctaaaaattctaggcatgattacgattaaatcttcatttataatatctcatcacttttctttctataaagctaatgtccactaaacacctaaagctcaacatgcaagcatatagtaattatatctacaatttatttcattttaaaactaaacatatacatgctaaatcatcattttcaaacaattttcataatatttcaatccaaatattttcatcatttctctattatctaaaatatatcccgcaacaaagcatagggcatcatctagtttatattaactcttctgtccacacgaacagcaacgaggagaggagcaaggggtgtactggtgccgtggatctgggcttgaagaagactgcttggactctatgcagcacgtacaacgggcaggaagggaggaggct

SEQ ID NO: 75825 - DNA, 4359 bp, Oryza sativa
tccgagtgcaaatttctcaccagcacgtatgagtcatctcggtccattcacatatgccagcacaatgatgtgtttgactattatcggaaatgttgggggaaaacatgttgttttgttctgggcatctcagtataattgtattctgcacattatcctatccttgagcttatcagctaagcagactctatctagctatatgtgtttgtgttgtttaaagctttataattccaactaatttacaccacaggagatgcaatccattcaatacattgaaaaggattatgaaggacttccatttgacttccatggtggatttgttggatacatagggtatgcagatttgtttttgcaattcatatgctcttttgtaacttgtattggatatatatgcatagttaattggttattatatgttgtactgtcttgttttatccacagctagcttattttttaaaattaacatgtccactgttttttcctggatatgcgtagtttgttactccttccgtccacttttatagggcttgttttgatttggcatagtcttcagaattaaatttgaccattgagttatcacaaaatttattgttaatagctacaaaacggtgcaatacacgaatctattgttataggttttgtacactaagtttatgtgtaatctgattattgttgttcaaaacataattagcttgatttttgtaagtacacatatgctttattttttgtggatgaaggagtattcaactttttttctcaatctgtgctctttcacgtgtttgacttacatggttgcttcacttttttcttacatggttcattacatttccacttgtaccagatatggtcttaaagttgaatgcgatgcatcatctaatagtgcaaaatcaagtacccctgatgcatgcttcttctttgctgataacctagttgtggttgatcacaacaatggggatgtgtacattttatcattacatgatgaatattcttctggtaatggagatggagattaccaaaactcaatacatagtttatggttagcaaatactgagaagaagcttctcaggatggatgccatggccccaagattatcgatcaatggaaactcgtcgatcaatgggaactcatttaccatatcatccagtgtgaataagcaaagatttgtcatcgagaaatcaaaagatgaatatatcagagatgtgcagagttgcctggattacataagagacggagaaagctatgaattgtgcttaactactcagatgaagagaagaacggattatatggatgctttgaaactctacctgaaattgcgaaaacaaaatccagccccttatgcagcttggcttaacttctcctcagaaaacctgagtatatgttgctcttctcctgaaaggtttctgcgactagaccgaaatgcaattctggaagcaaagccaatcaaaggtactatagcacgtggcagaacaccagaggaagatgaatgcctacgtttgcagttgaaatacaggcaagtatctgatagatacttttttcactgttcaaacattatgattttggttttaccagtcctcacaatactgatattttcttatgtgtttcaacagtgaaaaagatcaagctgagaacttgatgattgttgacctcctaagaaacgatcttggtaaggtttgtgaacctgggagtgtgcatgttcctcgcctcatggatgtggaatcatataaaactgtacataccatggtaagtaccattcgtggaaccaaaatgtcggacctaagccctgtcgattgtgtaaaggctgcctttccaggaggttcaatgaccggggccccgaaagttagatccatggagattcttgattcacttgaaactagtccgagaggaatatactcaggatcagttggattcttttcatataacaagacttttgacttgaatatcgtgatcagaacagttgtcctgcacaatggagaagcttcgattggggcaggcggggctattgtagcattgtcagatccagaagcagagtacaatgagatgctgcttaaagcaaaagctccaacaaaggtggttgaagagtgcagtcaacaaatatacaacccagatcgttcggattcaatgcagacaaccgtaagttagaatggagggtgaaaacgagtcttcttatgaaaacacaaccagcattacaaggtttggtatacaatgaccatcagtttggatctgaaaaattcgatctccgctgttggtgcacatattaatggctaaactacaaggaagtcgcagcacacctattctataattgggaattctaaaagcaacaaaaggacattttgctgaaagaaaggtgcctatgccaaggtggtgaaaagcacattggagcaaaattcatggtgtactacaatgtagagttagactagattacagctgacatgccttctccacaaaacaacagtgcacatgattttattgattgattgattcccctattgtggtgattgcactgtgtaataataataaactgataaaagaaagaaacccatactgaaatgcatttcatagcagattcatatatatatatattggcatgtatttgcaagattgcacatgtctcacctgagttcaaatatctgaaatttaccatgtactgtttctcaattcatgctagtattgatcctactggtgattgccccatcttgaaatttgagatttgagggcgagatggctgtttgctaatggcagcacttggttgagcatggctggcatgagcactgaacaccagatgtaagcaagggttgtactgcaaccagatcagatttgtgagctgaagaaatcgtctaagattgcatcttttcaactgattccaattccaaattacaatgggcggccggcctggcacgccattattccaatagtgtttatgaatcaattgcgcacgtcgcattatcggattgtgtcgtgccatcatcccagaatgtttctcatacgcaaatacacccctgtgagtttcacaacttttcgtagcctttttatctctgctcatgaatatttgactttaggacaagatttgatcaaatttttaaatgttgataataatgactcatatgtttacttttaaaaaaaacaaaaaaacgtgtggaatttctttgaaaaatgtaaaatttgctagattttacaaatttattttagtataacatcaacggcaaaatcttcaaaagtttcaatctttacttaaacgtcgattatttttggactgatagaacacttgcaattttggatggcttatggttctaagtttgggaataatgaaaaggtgagggagtttagtgtgattttgggaggatgagaaatatatatatggaggcgaaaatttaaaaaatggagccactcgcgagccacgactcgacctcgccgcggcggcgacgacgacgacgaccagcacgcactcgcaccggcggatcgccggcggcggcggaggaggagacgatgggcacgacgtcggtgcagaagagctggcgcaaggcgtgcggcgcgatcaaggactccaccaccgtgggcctcgcccgggcgcactccaaggacctcgacgtcgccgtcgtcaaggccaccaaccacgtcgagcgcccgcccaaggagcgccacctctccagtacgcctccttctcctcctcttcttcctcctcgcctccgccgcccaatccatcgctcgcgacctcgcgtgctaactcgattgccgtcgccgtcgccgcagagatcatcgccgccgcgtccggcgcccgcccgctcgccgacgtgtcctactgcgtccacgccctcgcccgccgtctctccaagacgcacaactgggtggtacgccgccatcgccaatgttttcctcatcgctcgccgccgcgtgatctgctgacgacgggggtggatggatggtgatgcaggtggcgctcaagacgctggtggtgatacaccgcgcgctgcgggaaggcgacgccgcgttccgggaggagcttctcagctaccggcgcggccgcggcggccattgcctgcagatgtccagcttcaaggacgactccaccccgctgggtcagctcccaatccaatctgaattcctgcataaactgaactggattaacatgaactcaatcggttcaaaaaattttgtcaccgatcgttctcatttctttgtgattgcaaatttgaaatctccaattgctttgctcagcgtgggattgctcggcgtgggtgcgcacgtacgcgctgttcttggaggagaggctcgagtgcttcagagttctgagatacgacattgaagcagagcgtctgaggacagcagagggagctccaaaggtttgtgaaattgtgattatggctt

SEQ ID NO: 75826 - DNA, 2906 bp, Oryza sativa
tccactagcgtgagtgttcaccatctgttgcagattagaaaggatagaagaagaggggttacactaaagataagaccttaaccaggttaacactgatctgatgtgtgtagaccattatattgttcaagttgattaagcaagcaacctagtatagtcacacactcatcaatgaacttctccaatgatgggaatgcaaccatacctacacacaaagcaaacaacaaacgttctaccctactaactattcttcaaaattactttggcggtataggtgctaagacaggatccaaacttcattccatcttgaccacttggcacttcagttcttcctcgatccactttacttaacctccatcagtagacctcattggcgtcttcaggtttcaaccactagtttcagaactacttcaagttgaacgagagaggagagtagacaatgaaacaatttgcaaagaattctagataaggaagaaaggagaaattttcacaaattatgttttcggaaaattagtccttaaggtttgaccatttggcttatcctacagtcgagatggctctgataccaacttgtcacgcccggaaattcactagtaatttccgaactaatttgtgcatagaaccctcgtccaggaatcagccgaggtacacaaactgacaatttaatatactgaatcatcaataatagcgttacatacttacaaaagaaaagaaaactgcagcggaattacggtctagcgaagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaatcagaaattttaatcaacactgaacagcacacccatgctgtacaggcccaaccatcctgaacaaccatacccggctgaacagatctaactccaaaccaggagctaagcaaattattaccagttaatcatcaataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaaggggaaaatcgtaacaataccctttgcacaacacaactcaaaacagtgcaccgttcctggatcataatcacccccttataaacaaggcatggactccccagcgacccccgtggacttctcgccacttctcagtctggcgcactataatgaaccatgctatacaaaggataaagccgttgcccacgctggcttgtggttggtacggttaatgtctcacaacagtagctcgcgaaccggtccttaattgtcatgagcacaaccatcaaaaccatatgctcacaacccaccttaaccaggttttaattatcaattaattaacatcacacgattaaccatcgtgagctaccattaaatataaccataaataataatgtagtatatatgattcatcccattagtgagctaatgtttctaagcattgctaagcaattatatatataacttttagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaacaaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaagactaataaaaaccaaataaacagtatataaaaaataaacaaacatgtagatcataattttagatgaattatgagacttgaacggcctcattctgacttcaaatgaatttattatgaattttacaagattaaatctaattaaagcccatttaaaaagaattaaataaatttaattcaatttatggataattttaatatgtagatctttattttagaaaaatttagcaacttgaaccacctgaaacggatctatggttatttagttatgattttccgaagatttaatctacgggaaaaagataaaccgatgacgtcatgctgacatcacccatggccgaaccaagatggcgacctcgccggagatagagcggccggctgcggaaaaggagggcatgtacacgtagaggacgacgagacgaacccgatggtactcaccaacgcgacgaacgacgacggatgacggccggcgacgaagaagcgacggcggcggcggcttgcacggtggcgacggctctacgggtcacgggagaggacgggagagggggcaaacgaaagaggaggactagggggtcctatttatagccttggattgaagagatcggactcctcccgcaagaaatcgatccgggaaaatcaaaactcggttttggagataaactcgaaaacgagtttgattcggataaaatacccaacgatttgctccgattcttgggggaaaagatagaggaggatgagaggatcaaaacccctcaaaaatccggaagaaacggggtcggattggagcggacttggaggcggaaaggcgacgcggcgcgcggctcgggctcagctaggcagccggctggaggttagggacgacac

SEQ ID NO: 75827 - DNA, 6847 bp, Oryza sativa
cgtggactccttgcagattgttgccttgatcgctcggggagccgtcggtagcacctttagaactcggttgagccgagccgcctggagcttgtttcacttctccatctttagaagaaccggtcccaggattatcagcaaccacttttatcttatacttctgaacaagcgtgcccttgcgggtttgcatgaacgagctcaggaactgatcccgtgcttgctgcatcgatgcttcaaactcctgcttctactcaggcgtgaatttctctggatcgattggcatgacgttgtcatcaatgatgtcggtcaatcctggcttcggcgccttgcctttaacggaacctgggcttgatggtggcggtggctgtttctcggccatgaggagggactgacgtctgacttctaatcaggtcccaccgggtgtgccaaaagcgtgttgacagaaaacacgtggcttgggagatctgcttaactccagtgcaggtccaaaattcgccttcggatgtattagtgtgccagttgatttgatcctgtaatcaacaagaaatagaaacaaagaaaccgtagttaaatttataaacgatagccgatcggctagatgccgatgacatatcatttatctttgagccgatgtcatctgtgcgtcgatcggcagtcatgaataagtaaaaaaggactaaatctactcgatcggctgtagatattaacaatatatactccttatatcgatgtctacttaaatcaagtgattgggatagatcggtcatcatgccgagacagtataaatcacttagatcgaaatatatgtcaataacaagactatatatgtttatagcatagccgatcagatagatctagcatgtatcggctaatactccgatactactctatatcaagatattaaagcaagtataatatattgagcaaaagcctaacatacttagatacggcaatatcttaacataaagggcagatttaacatatcaataaggcatatagaacaaatgaagttaaatcagatacgatcggctgaaactccgatactattctaatcggcaactagaaggcaggctagagatcgatattctaagcacgacttaacagatcaaactcaactgatgcaacattaagtataaaaagaagaacaatatctagacaatcaagccactagaaatttcatagaatgatagatatcttatataatctagatcaacgtcaagatctaacctaatcggctgtcttctgcatacagatattggcggatagtagtctagatggcgatattgctagagattatgtaagatatatgataatttgatgaattaaataaacaagattagagtgtcatgaagatggaagcactaatcctaagaacgcaatccatcacgacgaattttacctcttgttgaagatcgaaatcgatgcagctcaacccgaaagcaagaactcgtcgaaacaaaactaaagcaaaaagggtggcgatgcgccgaaattatgttgaatgtgtgtgttcaaaattacatagggctcggggtctatttatacccgaggattacaagatatgcccataccggacacaaccattatctctaacaaactctaagataccacaagtctttgcggcagacttttgcccacacttatctataaggaattcacataaaatattctaattaatagatacaattgcctttccaggactctatccatgtgtggcaatcatcttgaagtacattaacttgaacccgatgtcgcgcacaagtcgtattgtcggaatcggctatatcggcttatttagctcgactcagactcagccgatcttgtcgtagccgatctggacttcagccgattcctaccctgttttcaaactcgatctccgcttccgactttgcttcgatctaatcttctctccgctgctaatgttaccaaatttggttgttaacaacttctaatattccttattttttaattccgaatttctattttttcttaattgtatttctatatggactctatactctacttctaatatttcttacttttaaatccgaatttctattatttcctaattgtatttctatatgaactatatactctacttctaatattccttatttttaattctgaaattcagttatttcctaattgtatttctatatggactctagtctcctcttctaatattccttatttttcaattccgaatttcaacaatttctaaattgtatttctatatggactcttctttttctttttctccgattaatgtgagaatttctaggccatgagagcgaacgtggaggcttctttttctattcctttgcatgatatgaggctaaaaaatctgtcacttgtcctataatatatcagacaaggtttttctacacctaggtgccatggcactcattatttgtatgtgactcaaatagttataaaaaaattgaaaaaatgtagtaacatcctttgtgatgatacaagtctatacacaaatatgcaggactaaatttgatctaccattagagaaacaaaaataataaaatcagacagtgaatagtactcgtaaagtgcaaataaaatttattatttttgtttcttcatatatcaatcgaatttagacttgcatgtttgtatagtgttttatattatcatgatctatcttaccaaattttataaaatttttatacaactatttaaattgcatgcatacacctagataccatggtgccatgatgtataggcagtcccgactttctttttacttctacgtgaacagtaccatgcaactgcatgttgcctgccgccgcctcacaaaggatggcttcgcggggggctacgcgtaggtgcgtgcgtcggagataggtgcgggagcactggcggcggaggcgacgcagccgcgcggggccatggaggtggcggagccctgcgcgaccggcggaagcgacggagccgcgtgcgccggcgtgggaccgtgcggagccacgaacgagcggtggaggcgcgtgcgccggcggggccgcgccgagctatgtgcgggcggcggagccccgcgcaaccggtggaggcgacagagtcggcggagccctacgcgaacggcggaagcgacagagccgcccgtggccgcggaggcgacggagccttgcgcggttgcgacgtcgactcagcggaggcgctcgtgggcgacggagccgcgacggccggagccccgcggcgctcgtggaggcgacgatgccggctggccgaggcggcgacagatgcacggagttcccttgccgcgccggggcgcggtgaccagcggccgaagcttggcgcgctagcggcagctccggagcgttccgagccacgcggggctagcggaggcggcggttcccgagtgtgctggcagagcaggaggcggagtaccccggcgcgcgcgttgcatggcgcgtggtcgtcaagtttgacgtggttgtgggttccatcctgaccatgctggcagtacgtattagctattctagctagcactgcaggacagcacacgatcgtgatggctgcacacgcatgtgcgatgcatgctgtgccgcgcaccacctctctgtttctttcttctttttcttgtgcttctgacggcctgagggcgctagtagccgcgccgttgttcagcggcggcgcacaaggacgaagcctccgcgaagcagtctaagcacgacacggaagcggcgtcgtggggcctgacgctgtttcgccatggccgaagcatggaacagcggcggcgcgacgaggccgagtccacgcggagcattgtcggcgcctcaaggcccaccacgcgaggccgaagcgcggcgcggcgctagctcccggcgccgttgggtggagccggcaaggagccacggcctatcgcgcatcagcggggtcacaaggtcgaagccggagctcgatgtggaggcatgccccgcgccggaggccagccgaagttgaacgcacgggttgatgtgcatgagcgtacgtagttttttttttttttgagtggctccgaattcagcctaccacgggctccgaacgcagagcctaccgtagagaggctcggaatttggagcaacttgcggagccttagccgaggcttagaattgcaaacctacacagcttaagactgcaatatatatatatatatatatatatatatatatatatatatatatctcaattgctaacctatcttttttaaagtcgcggagaactactccgtccggccggaaccaggacggtctcgacgctgacttcgccacggagggtacttcactgggtctcttggacgcggaggtctcacattacttggccaagaaaattgcttcgcagaccggagaccgtatgaatctcatcatgacatttttcctttttgttttgaagagtcgcagagaactactccgtccggccggagccaggatggtctcaacactaactccgccatggagattgcttcaccggtctcttggacgcggaggtctcgcatgacttggccaaggaaattgcttcgcgggcaaaggctgcgtgaatctcatcatgaccttttttccttttgctttgaagagttgcggagaactactccgtccggccagagcctagacggtctcgacgctaactctgccacggagattgcttcactggtctcttggacgcggaggtctcgcatgacttagccaaggaaattgcttcgcggggcaaaggctgcgtgaatctcatcataacctttttttctttttgttttgaagagtcgtggagaactactccgtccggctggagccaagatggtctcaacgctgactccggcacggagattgcttcacaggtctcttggacgcggaggtctcacatgacttggccaaggaaattggttcgcggaccagaggccacgtgaatctcatcatgacctttttttccttttgttttcaagagtcatggtgaactactccatccggccggagctaggacggtctcaacactgactccgccgcggagattgcttcatcagtctcttggacgtggaggtctcacatgtgatttgaaatgtaattgcatgatattgtacctactattgcccgaggcagggcaacagcggtggtgcgagccgatcttgagcgcgtaggtggtgcttgaacgcgcaaagatgtagcctagaggggggggggtaaataggttttcctgaaattcacaaacaaatcacagcggtaaaattcagcaggttcggaacctccgggtgtggaacaccggaacttccgatctgctcagactgtccggaacttccggtgttctaaccaccggaacttccgggcaacagaaaaaattgaagatctagcagagacttaaactaatttgcacgaattaaactacaggaagaaagagcaaatacacaatcacagcaacatgcatagaatcatcacagagaagacaaaggcgattttttcccgaagttcgaatcttgcaatcctactctccgttgaggtgctccaaagagctgggtctcgattaacctcttgcctcacccgtgcaaagaacctcgaagaagtccgaggccttcaactcaacatttctaggtcattttctagaatttgagtgaccaccaagatctaactcacaaatccttctagaaaagaccacaagtgcaagttgctctacctaggagaacctctgaaatctcagcacaagaatctttactcacttacctcgtttccttgcggaggtaaggaaaaccttcacaaactttctcgagacatccacatgatctttggaagctctcaggtggcacctaaccgtttaggagaagatctccaagagtaataagcccaagtaacagcccacaagatatccaagtgctcaaacacacctagtcttcaaaccttctccaaatcactcctacactctcatctattctctcaatctcacaagaatggctctagatttgagtggaggaagcaaagggatcttgggagagtctagaacaacctagggcatgaaagaactgaagtgaaaatggccaaaaggtgcgatctggatatatataacggctaggtgacgacatctagccgttactcacatttttgaactggaagaggtccggaagttcctgacattcggaacttccagacaacacttaggaaaatttcacatgtcgcaaggttcggaagttccgggtccagggaccggaacttccggccagccttctctatccggtctggacccatttgcaaaaatggctcccaaaaatattctaccacaaggaacccactaagagcactttttatatctcagaacaacacttggaacccctcttaatagtacggtttttcctaaaactcgatttcaaaaattaaactatcctattgaccttggagcttcaaatccgctttgaatgaatgttgtaggggtctccaagcatcttttgatgtcctaagttcaccttgggagggactaattacctgaatatctcaataaacacattagtcccttaaccttatttatcattaatcaccaaaatccactagggagataaatgcaactttagtgctgacccttggccgtgtcggcggtcgctgtgccgagccctgcgcagagtggctgggacagcgccatcaccaggccgtgcatggcgtgtgcccatgctcaggtctgccggaaggctcgggatgcgtggccttcggcccaaccgccgcgtcggcgaggccgcaggggggaggtctcacatgacgcggccccgcggcggggccgtacaaggccgtgcttgtccgggcggaagctcggcggaaccgcacggggcccgtggcaagcgccgcccctggaaccttgctgcgagtgggagcacctctttataatttactat

SEQ ID NO: 75828 - DNA, 2257 bp, Oryza sativa
cggtgaccggaggcggcgaagccacgcgcgaccggcggcgcacgcggccggcggaggcggcgaagccggccgcgcggggccgctgacgcgacgaagccgcatacggccggcggaagcgcaaagtggccgcggctcgagccgctcgtggccggtggaggcggcggatgcgcacgcggcatcgctatacgttagccggcggaggagtccgagccgtgcgtcaggtgcggagctgcgcgtggccgcggaggcgacggaccgcacgcggtcgcgacgtcgactcggcggggtcgcgggcagccagtggagggtgtcggagactcggagccgcacgcgaccggcggagtcgcgcgtggcctcggaggtgatggagcctcgcgacgctccacgcattgccggaggaggcggcggagccgcggctcggcactgaggcggactgccgcgtcggccggagcttcgcagcgctcgcggagtagcgcgtggaggctgccgctcgctgcttgctacgggtttatgttagtgatatgtcctagaggcaatcataaagatgattgtatcacatactatgtttacatatttatccgacattattcctggaaatagataactcattattggttaatctatatgtgattctttcatgggactctttatgttgtttgttactatttctaaaggattctgatcaaatatcatatgtggaacaaatatgtttatatgatcagcatatatattaattgatgatcatgtctcatggatcatggtatagagataccaaattaataatatggacacatgttggtgaacatgttgttggatagacccaacatgagacactgcaagagccatatgtattgtgtcatcagtgatctcatttagtgttgctgttgaatccttagacctgagattatcatggttcacaacatgtgtagtacactggtggagaagtgctttttagtcccggtttgtaaccccccttagtcccggttttaaaaccggaactaccaatccgggactaaaaatcgctatctttagtcctggttcaaccgcgtaatctatctatctaatctctttctttttcgttcacgtccggttggtgttatcaaccgggactaaagaaagggaactttagtcccggttggtgagggaagcggcagtaagatggtccccttttctttttttttcttttttattttctcccgaattgagtgggatatatcccaaatcaaacccaaatccccaaatcaaagtaacatcccaaatcttaaagttacttatacatacaattcaaatatatcacaaatcctacaaaaattacaaacatatcaaatacatcacagatccatacaaacgtgcaatgaatcacaaaattatccacacaaatgtgcaaatgggatgccgttgccgccggccgccggccacctgccagccgccatcgggtgcggccccaccggccgccgccgcccgtccgccgcccgacaggcggcctcgctccgccgccgctgcctgaccgcgcggcggcctcgctccgccgctgccgcatggccatcgccaccgtctgccgcacggccgccacgcggccggctcgcttcgtcaccgcctgtcacgaccggaaataacccaacgggcgttccttacgtgggtgcattattccttttcccaggaggcaaggtacactaaaagttgatacaattcagagtttaacaagcggaagcgtaaataattaatttattacatgggcggcgaaggcccagcacacaaagacaaacgggaaacagcgaaagactagggcgacgaccacaggcgcttgacggcaggcacgagctagacaccaaagccttcatcttccagaaactcctcttctgggtttgggaaaaattgagcaagactgagtacaaccaccgtactcaacaagacacacccacaagtgcagaataaatgtaagggagtacaagggggttatcatataaggggttagggtttgtagtaaacagcactaaaagacacttagttgctcaaagctatattgtaaatatgatcctagagctatacaagattattaatcaaggccgtgaacccacacgaacctgccttaacccaaggcctacgatgattcagaccaaactggcaacccgaccctgggtcccagctcgtcccaagccaacccaggccaaccattccacattttaattgttaagcaggttttaaggattaaaacactaacttgggtacattgctcggcttgcccataaccgagggc

SEQ ID NO: 75829 - DNA, 16304 bp, Oryza sativa
tctagaggaataatattataagccacaacatcctctgttctttctgcatctttttgcatgactcttttcatctgaatataacagaaagggatgttatttatgcacaaaaaaatatatgaaacattttattgatctcaaaatgggttaaaaaaggagcaaaacgaattcattcaacagtgctgtttgaactcactgttaactggtaacaaaacattcgagaaaaggtactactgcctgcggacctgaggttatttgcattcaacacatcatactagcaacaaaatgtcagaaagaataatattccttgccagacagaaattattactttttactgttcagagaccagaagatacaactttgaccaacaaacaacattatgtccataagggttgtgttattaaagaatgttctataaatagcatggacagtaaatatactaacgtgttgaattccgattgtcagagcaattgtcttgttaattttacttatttgcaactagaacaatactacaatagtcttctagtaaaagctactacctgcgtcccagtatataaggatttttagggttgaacacaattattaagaaagtaggtataattaaatgggggaaggttgtgattagatgagaagtggaggtcggagagaaaattgaatgatggagggttgtgattggttgggaagagaatgttgcagaagttgttacattttgggacaaattctaaaggctaaaagatgttatattttgggacggaggagactatctatgatgacaaaaaatctatacatatgcgaaagtggctatagcctagcggttacagtgctcaagtagcacttctggtcctgggttcggctccccaagagagcgaatttcaggcttgaataaagaaaaaaataccatgggggcctccctcactgtttccattcaaaagaaaatctatatacacataaaagtacatcacttcactcttataattttagtgaatacattgatacactaacactttaccagtatcttactgcagaccagtagttaaaacccattccatactaaccactcaaccataataccaaaatacatggcatggagagcagacctatttttgtttcctttttttttaacataattgaaatttagtaggaaaaaaatagcatgaactatatattatcaaggtgagcaacaaaaacctcttcagatatcaacttttctgcatcctcaggtgaaatttcccttgttatttcctctataactgaccataagaccttcaaagtagcaaggactttcttgcgcttcagagttttgcgttccaacctactcaaacaatcagggtggttaaatcacatactatgggtgacatttaatgttcaacaattgtgcttgaaaaacaagcatcttgaaaaaaaattaaactaccaattcagcattttagctaagtgacagacataatttcatagagaaatacatactctccaaggttaccgctgaacacagcagattctctcaacttcatttcatcttcacacaattcatcaactttatgcttttctctgtatagcttataaaattcctgcagtttagcaacatcctgacttcgatctatagcaccaccttccctttttgctagcttttgctgaaaaattgagatagaaataatcacttttagaaaaataaaatttaaatgtcaaacccatctgcttaatttgtataattcaacaagccatggttccggagatgtgacgtgttgtaaatgaggaggactcacaaggcgatattgtatgttaaaacactagagcgctggccatatgaaataaacattgtaaatccatcacaagaacagttcaaaatgatatacttttgtagcgctggtagagcataagattgtggcggttgacaccataggtccatactatcattctacttcttaaaaaacaaagatgtgaaatcacttatttgtattgtattctctatgtatggcttttaccgacatggtttgactgtatatatgaaactcaataaggttctatcttggaggttgtgccagatgtacaaaataacatgtgattatgaaaaataataataaatcatatagaacagtatgaacataccctgataactgacattaaacctgttttgaactgcagtacacctctcccttcgctatttggatccagattttgggctagtgtgtatgcatgctcacatactgcacattgaagtataaacacaagaaattgtcaccgaactgcatttaaacttcatatgggaaagtgaattcagttgctaaaagctgactcaattcatatcgttgatatacccttcgattttgtggagcaaaagccataaaaaaattcattgccagattagtggctgaaaacaggaaaaaaccttaagcaaccaagcacagttcaccgataaaacaaccttaagctaacatcggtttttacctaaacagggataaatactaactaatctcctttgagttagtaaaagtttactattaataactgactggagaaattgccaaaagcataggcagtagtatcccagtacagagatttcagaacatagctggactaattatgggttgtttgcagcagattcagtaagttgactgattttcaatttagcttaatgaaaagaactaaagactgacaggtgatgcagattgctaattgcagaatgccggattgtaaggcactagcatacattggtcagtgtacatccaatcagagcaaatcaagtttgaaaagtcactttaaccatgtcaacgagttgattgatagcaaactcaggcgagtaggagcacgaaaccagtaaagcattagtccgactgtaacaactaaggccatgtttctttcagcttaagattattatgatctagattattgagtcagattactataagctagattgttataatctgtagtagaataagcggttagttgtttctttcctaaattattagagcatagattattgggtttgcaagtctaaagagggagcggggtggcatggtgggtaatttttcacccaataatctggaaaaagctcacctaaatgagcttatcagattataataagctggactccagattataataagctacttcaataagttgtctgtttctttcaacttgctcccaataatctggattataataatcccaagctgaaagaaacagggcctaaatacggtagatggtactaagcctgatcataacggttgacgaaatttagtagtacaaaaggctgtaacaagcaaaaaaaaaagcaaaagtactcctaatggactagcataatcaattcgtgtagccgatgctaactgcagaaaataccaggaaaaacaccactaagtgaacactactaataactgtataggtagggcaattctgagccgcggcgacccatacagctcacaagcctaacggagcgagaaatggtaacgaaacttacgaatcctggcgacggtagggtcctcatcctggatctcgtcggcggcgcgaagcacctcgtcgatgtggacgttgtttccgagagacgacggcacattcccggcgatgccggtgacgggcaccccgaaggcgcctgccaaccgctctccccgcagcgccgcccgcaccaggcgctcccagttcgccgccgccctcgccatcacgaggccctcagatctaaccacacgctcgctcgcacactcagaggccactcgtcatagcccctgctcaccaagctgcttgcgatcgacctccgcgtcgaagcggatgggagatcggagattcggagctagggttttccgctctcggcgcgcagggaagggaggtggccgtgtttcaggggctcaaacgaagaggaggaagaaagcgtggggaactggggatatgccgagactacttttttttctcctttttttttgagagtgcccttttcgcgtttggcgagaccgcgagacggtttgaaaccttttgatgcgactgcgatctggaacggggggcgtgtcagcatgtgatgccgcatcgcgcgtcgcacagggcagcccgctcccactgtcaactgtccccacacgagaatgggtctagggcgcaagagttttgcggaatttttatatggttaattaatgtaatgtaatcttcacaggttctttataaacagtatactagtagaattatcgttgattacctagacgcgtgacgattagagcagtacaataagctgacacagcaggctgcaaaaatttccacgtcatgctattcttacatggagaagagaaaaacgaaggagagagaataaagcgagcgacatatctgcagcccggcgatagcacaagttcccatgcggaaagctcgcgtgcagtcgatctcacggattaaaaacacatattgtgggcctcatcaccaccccttttgatcccatgcgccagattcatgccatggcgcggcactggtacttattttcaggcgacaacacaactacctacatagacagagttcactcttgatcatacgcaagtatgtgcatgcttaattaattcccggattatgaaactgtaattagcatagtatagccattctattgtataggttggctctattattaactgtaaaatgacatggatgtaattagagccaactactggctatactattgaccttgctcttagagcaggtacaatagcagactattagccagctataagcatattttaatgagataaaagataagagagaagagcagcgggctacagatctgtagccagctgcagcacggactccaagacacagtgtgtgtatgacatgtgggaccatatattaatagtatagtaagcaactattgtataaattagctattagattgactatagataaattggagttagtaatgggctatactattaaacttgctcttagaggtggtgtatctgtgccagtgccacctatgacgcgtgtcttgtggacttgtggtgtttccgcgactagtgtacgaaataattggcacgcaataaagacgtgaccaaagctacgcggattttgagtgcgtaaaagtcgtgtggtggatgggatcatgggaacacgagacagttcgttcgtcaaggctttcctcccggtgggctggcgaccgggaaaagctaggggaataagtctatttgtactccctcaacttttgtctttggttgaatcacgtccctcaaccgaaataccatgtataatacctccttcagctttgaaaccagggcaaatcacctcccttggtggtttagagggcgatttcatatgtcgtggcagctgacttcgatgactagctgagtcagcttgtgagtcccatctaccagcctcttcctctattctcttttccatccctcgtggcggcagcgagacaagcgccgaatgccggatggaggacgccaaagctcggggaggttgcggcggcggtgttccggctccgtccgcgtcggaacagtgatgcgcagtccactaccgcatccgcgcgctgggcgaggtaaggtggcgacactaccggtcgctgctcgtcgcggcggaggcacgccggatgagggagaaggaggcggaggcctcgaatgcggtgtgacgtggctacggacgaaggcgcttgcctaatcggtccaccgcggcggcgctccacacgcagctccagcaagtggcggtcgcggcacaagcgagaggcaaggcggtggaggacgacaacaacaacatcggcgcggcgaacaatgctgagtcagggttcatcgacccagatagagtataggaggtgaccccaccgccgtcgtcgaggctatgttggacatgttggtgtggcagtctctatcgggatgccggtttgtgcgcaggagaaggcgatgacgtgaatgaggtggcggaggagaggcgtgagaagggaggcggcggtggcagggagggagaagaagaggccacggcgatgccgaggaggcgaggatggggatgaggtggcgaggcttcttcacctctgctctctctctctctctccgctcatgccaagctcttgccgctccgctgagctcccgccgtcccgccgctcccgccgagctcccgtcgccccgccgctccactatcctgctgctcccgccgagctcctgctactccaggtcccgccgctccatcgcttctgccgccgagcttgcgcaactctctccatctcgctcgccgctagggataaagagggaggagaaaggtgactgacagatgggcccaaaatttattttattattttactcactgacatgtggttcccattcaggtttgtttttattttaataccatgtcgatgccacatgggatgaagactaagtcaacccgccacataagggccacgtaggacgaaactgccgagagagtcgatttgcaacggttttggaaattaagggatgggttataacctgttttgcggttgaggggtgcgattcaaccaggcgcaagagttgagggagacaaagtagacttattccaaatgttgaccagtcttatcgttagaccttcagataagtaggaacacatcctatgcaaagttttgggtgcacaattcatctacaccaataaaaataatcataacaaattctaagaaaaattgtagtacatatcgttatcattgtagggaaaaaattgggtaggttccatttggtgtgtggcattcggagagtttcaagatctccgatcaccaactgtaatctaattgaaacttggcggttaaaaatgaccggatgtagaacatgaagcccttacgctcttagccgtaatttttcacctccttggctgccagtgatgccgaagacatcgacggtagttggttgtggatcatcctgtaatgggcttgaaattgtccttcgagtttcttcaaacgttttcatgggatggagaaattagggttttgggaacaaaaaattcttaccgtacgagagatcatcactcatacatgggacttttggaattaatgaatgggccttagcccacttgaaaattaattctttggaaaatcacaaaagcccacctcgtaggatgacatgcatgtggagtttagtaccaccttacttattctaggataggggaacctccttaaaagggaggatgccctcctagccacttgaagcatgtgtggtggagagaagagggggaacacacgcgcgcgctcgctcacctcgcagggcaggcggcgcgcgtgcacgacgtaagcgtcgaatggtccgccaaaattggtccctcaccttgcgcagatgcagcctccttttgcagttttgttttgctgcaaattcggattcgtttttgtttttggaaacgttccgaaaaaatccggtgcgtacaaacggcgtggagtccggataagttacgcgtgacttatccggttcggttacgcgcagtggagatcgtgcgggctccctgatcaagcgacccttctctatataaaccgacccgccgtcttcacgcaacacacgcgaaatcaatctagggtttgcctcctactctgtgctgcgccatcgctcgtagattactccatcctgctcgccggcgtgcacctgcgattgggagagcaggtctccggaacctctgccttcgacgtcctgcaccgagagaaggcggcaataaggtttttgggaagcgctttgcgcgactgctccctgttcgtccgtgacggctcgtcttcctcttcgctcgcgtgctgcgtgccttcgtagacgcctgcgaaaagtttcgaccgaacagccggtctttccgccacctcggtacgtgttcaatatgttgcgcatatttgatctgttcatgttatattgtgtagtttacatgtgtagatctaataatgcgttcatgctagttttcgtctgtaatgtcatgatttatttatggaatatattaaatcattatatgcctataatctcaacagggacagtactcttatatgcgttagtgggacttggggccgggggtgtccaagaagaaagggaaaacaccttcgatcatagcgtctctctccagcacacacactctttctctctctttcacgtagacgaaggttggctactattagccagtttgtacccgctcatcttatggttgagtagcaaacgtatggtacagccattttcatggttacagactacggctcccatcggataccctattcagttaaaggaaaagtcaaattttgaattttaaacttaattttgatattaattttaatatatttttaacattattttttatcattaatttttaagttatcatgaacacttatataaaagttttacctataaaattatttttgttttctaataagccattttaacttattactagaaaatatgagcaaacaatgggactctactcgtttatgcgttggattcaaaccccacattgtgacgtataatgacatgacagtatgacacactctccttctcggacaccaattaagctgtacagacagttgaccgcttgattgtgtccaaagaataattattcagttactgtcagacaactgtttaccggtgcagtcttattggcttaacctgcacgagtgcagcaagcttagagcagtggtgttgtaatgctacagccccaagtcgtattatcgtatatacatcaaagtatcgaacaccctgaaaggatatgcacaataatctcgacgatggtcacttcagaaagaaaattacactggcccttacccaataataacccaaacaaacactcatgctccatagctaaaggactactctctccgtccaaaaaaacccaatccagattcaaatacaggattgagttatttttgagacgaagggagtacactatgtccagattcaaactcaggattgagtttttttttcaggacggagagagtaggagagttgcaaagatagtttctgcaagtcccacacccctactcaactcagtcactttgctagctagtactattgctctgtagtactccgtattgtactactgccaactgtgacgcgaaaatgtgatcagttatgagagcagtgacatcaaatgtatatttcttctgatgaatcgccataatgctggcgaaggcgactctgtctgtctgtcttctccccttgcatatcgttccgctatgcagtgggcctcttgcactataagcatcaatcgacggagctgatcatgattcatgagtagtagctgatgctggacgacaatggcgttgtttggacagatagtagcttaaagttcgtagtaggagtattaattgctttttttgtctgaatcatagcgattcattcctcaaaaaactgaaagttaacacagcttttcaggtggcgaaagcaactacagaaccgcatggataaacgcaacgctcgtcgtcagcagcatcccctttattcttcatcatgactgacacgatacaacttacaaacagtaaatcgtaatttacctctggtaccaggagaagtgctccaagctgtttttttttcccgaaaatgaactccaagttacttttagtgtaacaaccgaacatgttacctcttgaggcacggtaaatttctgtgcaattatattgcacggcttgatcgattcggggcatgcatatgaagatatgcacatccaaagcagaggcacgcatgcatagaaaaagaagtcgcaaccaaacaagcagatgcatggctagccagctgcattggcgtttggcagtgtaggcagccttccattcccgtctttgatgaccgagcaacccccgctgaattggaatggtttttcgtagacagacgttatttgtcgtatgggcgtctccatctgacggctgttccaggacaggatgggcatgcaagatcgatgctcgtgaaagcgacaagcagctctcgccgcgcaagagatgaagacgggagaaatggaaatgctggatttttttaaaatatattttgctctctttaaaaaattattttacaaatgtattcataaaaaacttattttaggaatagatatttttcttgccgccagtgatcctggcaccgagatctaacgtctgagcatcaacgatattagtgacgacactctcatccccataagccgagatacagaagggttagctcctaagaaattagcgcttaggacctatttgtaattttttttaaaaaaaagactacaatctaattttttattacaaacatgtcatcgacgttaaagttttgtaagattttttttacattttaatccttttttaaataataataataaatctttaacgtcgatccccttcacatcaacagtttggctattagggggatgactagacgagggtgtcgtcgcttagacattgaagcttgacactgagaaaaatggtccatttataacataatttttttacagtgatctatttataaactaaagctttcaaaaagtatgaaaaagtaaggccgtgtttggccctgttcactttgttgtcaaaaaaaccttaccaaattttggcatagttatcaaaattttggcaactgacaggattttttatatagttaccaaaatttagtagcaaactaaatgtagccacttttttgacaactttactaaaatttggtaaggttgaaaacggcatcaaagtgaacaggcccttagtttcccccctattcccaactttccatcacatcatatcacattaaaaactttcctacacacataaacttttaattttctttaaactttaaacttttttcagaaactaaacacaccctaaaacaaaaattctagaacggaaatgagtgatgaatggtgccctgcagctgcagaggataggagtatgggtggcctgaggtccaaatcagcagagggccgggacggacgacgtgtaaacgtccatccaggcgtccatatgattccgggcgggcaggcatgcaggccattgaatccgagtctgcgtcagcgcaatgatatctgctcctactacgcctctgcctgactgcctgcatgcgcatgtctgagttggacatgaacatgacctccatcgcatcgattgcaatcaataatcgctggccaggacgtactcgtacagtacgtgtcattggtctcctgtaccaccccaacgtagtacgccgcattcactgatccagcgcacgcacgaatgcacgatgtgatcaagatcaatcgatcgagccacagttttttttttttggccctttccccttgcgtcacccccggccgtacgcgcggccgtgcatccctgcgctgtgtttcactgtgtggcgtccatccatccaacaacgcgcggcgcgcgcggccccggcgttttgcacgcccttcgtccatccggcgctggaattttgtctggttgatcatcggtcgccttctcccccgaatgattggatttcgtatacggccggggaatcgcgacggattctggggtggggggtggtcctcgcggcggctctggcacggctcgatcggattcaagcaatgcaagctgtttggattgtgtgtatagcatcctcaatagcctggacctctctcaactctcatctgaaatgagatcgaccagttggcaccatcgagtggctactggctaggcagtttggtacgccgttctccgcgtacattttttttttggactgttccttgtacgttactactacctacgtatcttcggcacgggcaccggcccatctctgacgctgcactgcatacctcataatctcgacctgttacttgagtttgtgttgacagtttttgaccacccggattgaaatagtttaggaagtttttcagtcggataacacatgcaagctggcacagctgatatatatatatatatatatgcaatgacggcatttcttatcattaatcgatcgtgttattccaactccgctaattacaatcatcatccaaatgaatagtattaattagtttggttgattattaaacaaattagacacattattgccttattggactgaagaatttattctgctgatcactttggacccgcgagtagactgcaagtcttttgaggggactcctacgagcaagtttaatagtatagccaaatactaactctaattcatttatagtcaatctaatagttcattcatacaatagttacatactacattattaatacttggtaccacttgtcatacacacactgtatcttggagtctgtgctacagctggctacaaatttgtagcccgctgctcttctctctccttattatcttcttaaaatatgtttgctattgtacctgctctactaaactcatcatcatggtagcaatgtactgtcaattgtcctgctgcgaggttaggagaagctactactaattgtctagccctttaaaactttaggttaggcagacgtagcactcgccgggcttgcatgattaagggggtgtttggaagagaaggccaaactttagggggtgtttaggaactagggactaaactttagcctctctcacaaaagtataagtctctcccctagggacttatgtttttgagagaggggctaaggtagtgtttggttggagggactaaagtggggctaaactttagcccctctcacaaaaacataagtccctaccatagggacttatacttttgtgagggggactaaatttagtccctagttcccaaacaccccctaaggtggtgtttggttggagggactaaagtggggctgacttatgtttttcaaaaacataagtccctaccatagggacttatacttttgtaagagggactaaatttagtctctagttctcaaacaccccctaaggtggtgtttggttggagggactaaagtggggctgactcatgtttttgtgagagggactaaatttagtccctagtttccaaacaccccagtctctcccaaacacccccttagtccctctcataaaaatataagttcctagacttatatttttgtgagagagactaaagtttagtccctaatttccaaacatccctaagcttagctgcatcgacgttaacaatttctattcccttccatttgggcacctgccgtgtcaggtaggacatcttgaaccgggagggcttatctgcagggaactcatggcccatggggtgcccattcttcccaatcgtgtgcccgaataagaggtgcgaaagcgaaatggccatgcaaaagtaaagtgatgacgatgaactagccagagaatataatatccaaagactgatcattagctctaacactgacaacttaacaaaacaatatactccatctctatctcattagcacagacagctgcctttatttattccagataagattgtgttagagctgactagatatgtcgaaaaccacgttttagtttaggcgtcctgtgtatgcaaattgcgtgctgtgccgttgtgctgtgcatggtactactactgtagaaatatgaagtctggtcagacgagacggccgcatgcaagccagctgcagttgcaaatgcaagcagactgcaagctgcagttgcagcctgcctgcaggttttgcccttggctgtacctggcatggaggatcaaagtcagctggcggatataaatatggccgcaagcagcaagcaagcgtgcgacctggcttaccagtaccaaccacagctggtgcaggcagtatcagcagctcatctccctggagtatctatccagtatatctacgcatgtgttggtacgccatgggcaacgtgttggttgaattcgcgataagccctcacgttgactagtttaatccgtcaggctagctcctctcgcgcattccattcctaggggcttcgaccgcacatcgcagtggaggagccaaccgagggagtgcgtgcgtgcgtgtgtgtggactgctctgttgtgtgcgccgaggcaatttctttatcttacgggagacgaggaaaaggtgggcggcgcggcgagctactagcagaaaagatggcgagagagcggaaaaaagcctctccggccgccgtgccgtctgttcgttccattattccagccacgtacgcgtatatgacaatacggtgcactcgatgtgggggtagatagatggtagatgttccgatcatatagtataatccatcggcggacatcatgaactgcaatcatgtattgcatggatacattgagagcgaacaatcatgagcgagttagatgcaccaattattgctgtagaactaatttggccgatttgtcaaaaaatggaacccagggaactctgctacacacaaccgagtatatggagggcggatgaagatctatctgtttaagcttaatcgaaccaaatctaacatatcttcactgagctcaaaacaagtctcctatacagctctatctccccggtacacgaagagatgtctctttccggttacagggacacatcggaattctcttttccacgtcgagctgtgggagcattgttcgataaggcaggctcctgtaagagcacccgtaatgttaaatataaaacatatacatctcagcaacaaactagattagtattaaaccatctcaatagtatgtctacattggtatctatagctctctaatccattgcctcgtttttctttatagattatctctaaattagtagatagttttgctctctctccatttaattttttccaagtagaaaaatatgctgacatagatctcttgtagagagtctatagataaccattgcgggtgtcctaatccaaaaacaatcgtaatcgaagaaagaaagtactccctccgtcccaaaataagtgcagttttgcactattcacgtttaacgtttaaccgttcgtcttatttgaaatttttttatgattagtatttttattgctactagatgataaaatatgaataatactttatatgtgattaaatattttcaattttttaaataagacgaacggtcaaacgttggacacggatatctactactgcacttattatgggacggatgtattaaagtctgaactcggcgaccaataaataatcctctagcatatcagcacgatcgaattgtatatttgtttattcgcgcactgtcattctccccacgcaaagcgacaagcagcggctcggaaaacggcttcgtggctcggacatctgtcgacaaaagcgacaccccgctggagtcaaagaatgattgaccctcgtctcatggtctcatccactgcttcttcttcccctcatctccctgccccgaggcctctgggcccatgagctagaccatcattagccctgtcgttgacaggtgggcccaatgtcccttggtccctgtgggccccactggcaggcaaaagaggggaggcaatggactggtactgaacgttctaaaaagacgccgccgagtcgctcccgtccacggcgtccagctagcgttttgccgcagtggccaacaaacggccagcgatccacgggagcgacgcggattcgaatcatcggcattgccgcccctgcacttccactggagctagttaccgcccagcattggctctgtggctcagtggcgcgcatacagctcgctccactgacgtctgcttcacaagtcactgccatagccgcggaggtcacacttttcttctcgtgtcaaattaaagatgatgtgactgaaaaattgtgtgtgtatgacaggttgatgtgatggaaaaggaatgaagtttggatcaaaactttgaatctaaacacaatctacttttgagtaaaattgatcccatcagtgaggaatgatttattagcagcaaaaagaaccgttgcttgctgcacatttaaaacttgtggcaatgctaagctagtaagctcatactagcccgtaaaatacgagtatcttggagtgcaaatgtgcaatgacactattcaaccgagctatacgccgaccacgccattccatatcttcgaagcagaagttacccctaccttaactggtgcagttacgggtaagtgtcgcttcagatatgatttctcggaaggaaatcgtggggagtccatacgacatccatggacttcaccggaaagtaactccacctccagctccaagcccgggcttcttctagaggaaaggccatgaacccatcgttttctgatccaacggtcaccctgctcaccgggagcagtttgcagcaaattcaaattcaactgggtgaccccccctgcattgccattgcctctctctcctctcctcctttcgttcgtcctgcttctgctctccagctcaccgccagtgccgcccatcactcacgcctcccacccactgcccctgtccctccctcccctacataaacccccgcactccccctccttgttgcacgccactcccccctccccaccaccattgttcaaatcatatcacctccagtttttactcacaa

SEQ ID NO: 75830 - DNA, 601 bp, Oryza sativa
atattgctttgttttcccagttcatgtgcctagttaatttacttttctgttatgcgcttatcttgttgctaactggaactagcagatatctccatcacgcatgttctcctctgtcctactttctgttcttttggctaacatattatcttattaccacagtcatggcgggaatggcaccagagggatcccagtttgatgctaagcactatgattctaaaatgcaggagcttctgtaaggaatcttatactgatacgttttatctcagccatcattgtgtacggcaatgtctgtctatttcctgtacaggatctaccgcttactgggtagtcttttaatgcaggaaccaaggtgaaaccgaggagttcttcacatcttatgatgaagttcatgagagttttgatgacatgggtctccaagagaaccttctcagaggcatctatgcctatggtaggtttataatctttcgtgctttttttttgtgtgtttgccatttgaactgttattcatcagacctttttttttgttttataggtttcgagaagccttcagccattcagcaaaggggtattgtccctttctgcaagggtcttgatgtgattc

SEQ ID NO: 75831 - DNA, 41369 bp, Oryza sativa
aacctctataaataaacttttaaaaatacacacctatatatatatatatatatatatatatatatatatatatatatatatatatatatatatatatatatatatatatatatatctactactacttaaaaaataagaggtgcttccatcgtccatcaaaaaaaccgggtgaaaaaaaaccgggcagaaaaaaccaagtttgtccgataaaaaaaccggacgaaaaaaaaaatccgatccaaaaaaaaagtgaaaaaaaaaaccgggcgaaaaaaacacccgtccctggcaaaaaaacacccgatcccttaaaaagggaaaaaaaaagtccgagagacaaaccgtttaatgaataaaaaaagcgaaaaaaaaagagtccgattccctggagaaaaaaaatctgatttccctggaagagatccgatctgtattggattggagaaaagaaaaaaacacttctctaggtgcttctgtcgtccgtcaaaaaacgggagaaaaaaccgagcgaaaaaaaaagaaaagtccgataaaaaaacctggcgaaaaaaaaccgggcggaaaaaaaacaaatatgtccgacaaaaaaaaaggaaaaaagggaaaaaaataccgaaacgaatccgactacatcgacgcggtaaaaagagtttaaaaaaataaaaagaaaactgtcctattccaaagaaaaatgaattatatgtatcgtggagcaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaatcgaccgggcgaaaaaaagaaaaaaatagtccgatccgaaaaaaacaggagaaaaaaaaatgggcgaaaaaaaaatttgtccgataaaagaaaaggaaaaagctgaaaaaaatctgactccatcgacgcggtaaaaaaaggcgaaaaaaaactttccgataaagaaaaaggaattatatgtgacgcggtaaaaaaaaataaaaaaaccaggcgaaaaaaaagataaaagtccgataaaaaaacggggcgaaaaaaaaacaaatctgtcctatccaaaaaaagccaaaaaggggaaaaatcaaaacgaatccgactccgtcgacgtggtgaaaacagggcgaaaaaattccaaagtaaagggagaaaaaaaaatcaaaacgaatccgactccgtcgacgcggtaaaaaaagggcgaaaaaaatccaaagtaaaaggaattatatgtgacgcggtaaaaaaaatcgatcgggcgaaataaaccgggcaaaaaaaaatctgtccgatccaaaaaaaggggaaaaaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaaattaaaaggacggaaaaaagcgcggaggaaaaaagtcaaatttatattcgtcgttttttagtccatttatatatcttctttatctctaatctaatctaatctaactataaaaagagaagtttctacagtatattaaaaaaggaaaaaatgcgcgagaaaataaaaacggtttaaaaaaacacgtgagggaaaaatgtcagaaaaaagcacaaaagaaaacgcgctagaaaataaagtttcgtagttctaattttctgattgttatcgacatggttatgcatgaaaaacgtatattatcattacgttttttcacccgttgcaacgcacgggcatatttgctagtatatatatatatatatatatatctcaccacgtacatatgtaaaattctaagatcaaaccttgagttattgacactgacaaatgaaagcgctcctcactacaaaactttgattattttataaaaacatggtgattttttaaaaacttgagttggtcgtttctctaccacaaggttttgtccttacaaggttgtaaactatatcacctcctctgatttgttttaaaagcatggtagttcctgcgtaataggtggtaatcttcaccacatgtttttagtttccaagtttctaaagtcgtatagcactcggccagtactcgcaaccatatatagtaatagttactcactccgtcccaaaatataataatttaggattggatggaatacatcctagtccaattaatcaatctggatgatgagctatccagattcgttagactagaatatgtctcttccaatcctaggttgttatattttatgatggaggcagtatctaactagtgtttcttcacgcatgatttcattccagtgggtggagtcatgcactataattttaagattggacttgagtttttttttgggagggggggggtgaaagatcaaaattgagttagtgacaatgacatctcacaaatgaaatcgctcctcgtatgcatgtatgtacggaattttttaaaatcgtggtggttcctagctagtactctctccgtttctaaatatttgacaccgttaactttttagcacatgtttgactattcatcttattcaaaaacttttatgaaatatataaaactatatgtatacatataagcatatttaacaatgaatcaaatgataggaaaagaattaataattatttaaattttttgaataagacgaacagccaaatatatctaaaaaagtcaatgacgtcaaatatttagaaatagagggtgtatgtggcaatctccaccacaagtttttttttttgttctttacaaggctgtaaactatatcacctcctcagtgtatgtatgagatctttttctaaatcttcaaatcatactagtagttcctgcctagtaggtggcactgtggcagtctacactctacaggactcaacaattaactaataactcacttagggtaacatctatctgagagcagagatagatatagcaaggggcagagcccctaccagtcatcgaattcttcattgaaattttagttgtggaattgaggatataatttttatagctatatactagatatagtacaggttggctgaactcaaaaatctttctagctctgtcagtgcatagaataaacgttggtccacttgattttttttatcaatcctgatgggtagagtcatacaccgcataatttcatcgccgtagtatcgatgcttccataatgtttcctttttaaaagtatatatatacaatattgcccatgagatgatcctgttaattagacatatatatgccgtgcataattaaagatagcatatggtttgccggtaggtgaaatgaacagtatagctacgcgttcatcacgcgttcggcctcaatggcaaatagtcatgggcgctgggaattagtagtcttcgatcgattacgacgcaaccaatcaattaaggtcgaacttaactacagcttcatcatccaaatatataaaaaaagaaaacgtcagattaacaagattttcttcagtttgatcgaaacctagctagccagcgatcaacctgtacgatgcctacacgcacacgtcgctagctgcccaccaataatggcattgttaattcttccttggcagcaaatgatgcactattttttttattgcaccttgttgctgccgactaaaataacagcgtaacctagtaagaaacaaaacaccagagttagtacctctgtcttaaaacaatataaaattatatgagatatattctagtgatataaatttgatatgtatagactctctgtccagattctctctgtccagattcgtagtcctatgatatgtttcattcaatactaaattgctacgttatgggtcggagagtagctaattggtgatcaacatgacagaaacaacccatctagcgtaggtctcatcggtagataggcttcaactcgatctgatccatttgtaacagttcttgttgcgtgcctgcaatgaatttctcaaacagctagctagctaaccgcaggcaatttatacttgtacgctgcgctaaatgcgagtccatttgctcttttgcgctgaatatggaatggatgacatggtttgtgataattattcgagggtataaataaattaaatgaataaactattataaagttgaatatgaatttaaaacggttttctcatatataaattttttctaaaaaaatatcataccgcttaggtttgaaaaacatgtgcatattatattcgtcacatcattctatcgtaagttgaagatttgaactcaaaatcttgggatgctacttagatcattgcaaccactagactatatgctcattcgcaggggtgtaaatatggagcaagtatactactcactctgtcctgaaaaaaacgaatctaagactagatgtggtatattctagtacaatgaatctggacagaggtatgcccagattcgtagtactagaatatgtcacatctagtactagcttgattttttatgggacggagggagtacatatgacatcaattgatgcaagctagatggttttctgtcagattaccaacctcaagatgcaggtatttgtttcttaacatcgatcaatctataggaataaactcagtaatgatcggatcagtgttgtcgacttgtcttgtccatttgtctcttggccatcgtctgattgtgtcccttccaatgcacaaacgggcgtaactgtcgaggcaggagccaaagaacaaagctagcagaagctctgatcacttcgtgtccccactccccagtgggctgatgatgacctgatcacttagcttgcaatatggctgacttgaacccaaattaatgaagatcaagctcaattatgcagaaatatattccacttatccatttttatcctcctctgcattatcttcatccattattgccgctttgacctgcagctgcatgcaaatgcaagagaggatcatatgctgctggttggccggtgaagccatattgccactgcatgggctcatgcacttggatgcaggacaagtgttcatataaacgtacatgtacttgatgtactctgaactcaaagatagaacatggcctgaatgcagtcagctgcttgattgcctcaataattctgcttgtttattgccattttcagcagtatgattgtccatattgtatttatgccttaattgctgccgttagtggttgcacatgcacctagctagtagttgacaatcaagtaccaagtatcaactatcaacccatggtcggtataatattcttcagttttccatcaagtccaactttatgtacaatggagatttcctcgatccaaaatccaactttaatactttgtgtacaatgaagatttcctttttttttatccccaagtccaactttgtgtgcaatgtaattgtagatttctttgattttccaaggccaatgtcaatttgtttgtcaccataattaataaaaaaaacaaggcgctggaaaataccagcgaatcggtcattgataattggtggcaatatattatcctattattacaatgaaaaataattcgtggcaatatattgtcctattgcaatgataaagggcttgttcagattgtagccaaaatgaacattaccaaattttggcattaattttggcaatttggcaatattgacaagttttggcatgatttcttatgatttaccagagtttggtaaaaaactaaatggatgcacatatttggcaactttgctaaaatttggtaaggtttattttggctacaatctgaacaggcccaaaattttctgcaacaaataaccatattttgttgaaatgatttataatcgtcgttttattcaatatttttgttgcaaaaggaaatgagctatcgccacacaaaaaagttattgttgcaaaaaacatattctatcgccacagttttatttttctgccaatttgcatagtccatggccatgataagttacttttcactattttctattgctacgattgttgacgaaaaaatcgaacacaccggcctgagagatctgcttaactcctgtgcaggtccaaaggttgatgagatgcgggcgtgccagtcaatttgatcctgcaactgacaagatatgtaaacagctgatcaaatagccgatcggctgacaagccgatgtagtagttccagctgatagccgataatagccgatgccgataccagccgatagcaatagggtttaagcaatcggctatatgtccaatatagataatgatatataaggcaatcggctgttgatgatgtgataaaataacaatataatcgagtagaaaccaatcggctagaaacccaagatatagatagaggcacctcgactcctgatatgggttcacaagccattacatttcggttgaaggtccgatgtcattaaatccacaggattagataaacagtaaaaactatgttgcgatcggctaaaatccaacttatatgtatatgcaatccttacaagccgatgcaacgttcagataacttatcggctagcaccccgataaaacattagcatgaacttttcggcttaacaagacttatattatcaacaacaatctagtaggtcgaacctaaccgatgcagtatgagattgtatatgataatctaatactcgatgagccgatagatctatctaatgtgatggatataacaaatctatttagaacaacattgtgattgtagagatatatcggctaagacagaagatcggacctaaccgagacagttccaacaaaaccgatgcgtctctaaacacaatgcgattagagatagaattgagatattaggtaggcaaatatatcaaccaaaccagagcgatccaagagatcgagacgatgcagccttgaacaacaccaatacagccaacagattcaccaaggcccgacggaacgtaggacttatcccttcaccggagatcgaaacccgatgcagccccgcgtcaggtgcccaaatcccgccggaagataagtaaaaaccttagggaagagggtggcgatgcgccgagagtagttgtattgatcgagattgatagattacatagaccccgggtgaacatatttatacccatgggttgatacaagtccttgttggacaagaaagaaactatcctaaagataaaaggaaaacataaagtccttatcggacactaaacacacttttctaaagataaaaggaaactaacaaaatattcctaattaatagataaactgccatgccgcatccttcttgaactcggactcttctggataaattccctttagttgatccgactccatctagaacacggttgctggcgattcgacgactcccatcggctgattccataactctgaagccgatactgactctaagccgatgatgactttgggcttaccaaatttcactattaacaacgatcaacaaatttgttgcaataaaaaaatttgttatctcataatttaacttaattttttatatggacacggattgggacaaactttatatgaaacttataggtctagatgagacctacaattttataagtgacatctttttcatttgaaatcttttagatactcaaatccatgattcaatctcagctaggtggctcaaatgaaaagatatgtaatttctaccataattgatgcgtaggtgagttagtaaaggagagcgtgcgtgggagaggtcaagggttcaaatcctaggcatgacaagatatgaaaaagaaatagttatgattatagtttaatattaataaaaattttgatttgatatatatatagctaatgccacgtatgaagtagtggcaataatcatttattgcaatatgactttttttgctacattgtggcaatatcaaaatttgttaccacccaataaaaatcgttgcaataacctattaccactatatttgttaccacggctagcaacgattttataatggtggcaacatgtatctattgtcacgattttaacattgatgccatgatgtttttcgtggtgataaaatcattttcctagtagtggaccaggtgtcatattttggtttttaatttgcaatttgcgtagctttatgatggtgttttcctactttttttttctatggaagatgtgatatctagcacgaggaattgtcctatgttgaaaaggaataacttagtcttgaaaacacagaatttttaattgatcaaaatgaccagaagcagaggtcatccattcttcagcaggtgaatttcaaagatcaggttcaaatttgctagtctaaacttagttataaaagacaaataattgtgaagaaatccacgaagaaaatctcatcccgacaggtactaatcagcccgggcttatgtagaggtcatccatggcccatggttactgattacatttctgttaatccacagaacacttaatttttagaatacaacatataataggttcatgattgcactgctcacgtttacaaaagaattacaccaacttcttcatggctcacatagagttcttctctaagtgagagcatttctggagttctcttttcttttgtcctcaccaattgctggtgaggaggtattgtacctacagaaagagacaatgtttcttacttcagaagaggaaagaaactctcttggtactcagaataatctcttataatagtcttctccaatgattgattttaaaacaaccagatgcttcaaagccaatgcttcattgccctatatataacaccagctgcagaccggtcttcgcaaaaaggcactccatttgctttgttatactcatagctcctttgcttcaaaatgacgagcatttaccaagaattcattcataccaagtgtcagagcttcagaagcatttgtagatatgttcttcattcaattgtcctcatctatagattcgtttccttgcatgttcacccattctggatccaactgtcctacttcttcttaattaacctcctaggttcagttttattaatgtttctgaagccaagcagcccaaagttcaagccaggttacattgacatgttgttcttgtcaacctctgctatgaaaacggagcggatacgaacggataatgcttataccatattcgttttcatattttttaccggataggaaaacgaatatggatagctcgaatacggaaacaaatacggattatctcgaatacgaataagaatcgaatatgatcggacacgaatacggaaacatttttttctcggaacacgaaaaccaactcaacttctaatagaaacaaatatcaacatatataattagctcattttatataaaatgaggtataatttataaatattttttaaaatttaaataatattaatagtatggactagtgttaagagataaactactattaaaaatctataaaggtatattgaaggttatagagttagaaagaaatggggtatgtctcatgggtcctgcggatatccgaatagcactgttcaccggatatccgaattattatccgtatccgacggaaaccctgataccatatttgtattcgtatccgggagaaaatattcgtattcgtatccgtatctgaactatccgagaattatccgatccgaaaggtatccgtatccgtttttgtccggatcggacagaaactatccgctccgttttcatccctacaactaacccatagatttgtcacaattgggggatttactgttaccatataagttggcccaataggcacaatatagattacatgactagaggaaatgaccaaaatacccttcacatctatacctttaacaccccctatcaaatgcaatgtgtatgcaatagcattgcttttgaaactagacaatgggttaatgaggatgatgatccatatatttcattttgaaactaaaatcaaagccatgcttgaaaatattgttgaagcgtgcaattcttgaaaaatgatgacgaagaagaagaattcatcccctcctcaatgaagtggacctcggttcttcggctctcgttaccttgaagccttcacaaactattcttcggctctcttcactaaatcggagacgttgatgacaatggtaaaggaccttcacatattgttcttcagcccttcactgattgatgatgatgatgatgatggtgaaatgacaatgatcagctctgatgtggagctgatgaagttggagatagattggcatgactttgacgaattgaaggatgtgcaatgagtttgatggactcgatggcaactagcaaatgacacaatgataccagtatatatgcagctggacttgaatagatagactagataggaaacaaaagaaatcgatttgtagagtacattgatatgccagcaaaagacaaaatgctggctgcccagaaactgcagactagctgattctatccaatttggtagcagagagcagcagctgatgaagatggacaactcctggtgatgaaagaccacgaaaactttcagtaaagcacaggtttggacagcaaaagcatgaccaggagctgtgagcaactctttgaagcattttgtcaagcaccttgtgttagtagttgtgaagaaatgatcaggaaatcaacctaatgaataaggtggtaatgacagtagcaagcatgagaaataagatgatatgaattaatgagccgagcagagaccaatccaagccatgcgtagaatggaatttgctacaatgctgctgctagcccagaagaaagaagaggcatttgcttttgctgctgttactagctgatgaagaagagaaccacaggttgccactgctgctactaaagatggtcagccctaaacccaacctatccgaagagaaagaagacagaataaatatgcagatcagacacctttctttggtgctgctattggttgcctgctgaagatggacgacgatgcaatgcatactgctggctgctgcttgtttgctgacgacggcgccgcggctggatttgggactgagatcggatctgatgacctcagggccggatcgagctgctctcaaccaagatgacggctgccgctgcacctagttgacgaagatgacgactgacgagacgattggagttgatctgaactgaggtaatgatgtgatggggttttgggcatcgagccaccggtggcttgccggagcgccgaccgaggctcgccggagtgacggctggggctcccataccatgtcacaattaggggatttgctatcattgtatattttttttgactgggttatatattattatattgggactatataaaaaaaaactgaaaaaactttcaattctaactaaagtataattatagagggctgctacaaaacgggattccgttacaacgggatagacatattaactattctcttgtacgagtatcataggtattaggtcctaggtatcacaggtaccgggtaacaggtatcgggtattatgcagctgataccataataggtatcaggtactgtctcatataagggtatctcgttccaatgggataccgttgtctaggttttctaataattataatataatttcactataactatatttatattataacttgtatataagtattttttaaaagcaaacttgtatataagtattaaaataatatatgcagctatatatatgacttgtgaagatattacaatgtagatacagtagagtataattacattgtagttacactacaactatactcaagggcaaattcagtgtggatactagggggaggacttaccccattagatcaccattgatagaaggagatgaaatgagaagaagagggaaaaaatgaagagtaggagggactgaagaatgaagaaggactaaagaagaaagaaggagataagttcccctagatctgtccctaattatactatatactatagttacactttaagtaaaaaacttacgatattttttttgtctaaaaaacttacgatattttttttaccaattctgtgttatattaccacagaagtggcccaatagacaatatagtagattacagggctagagaaaatgaccaaaatactctttacatctatacccttaacaaacatctatacccttaacaaggttgtacttaacaagataaaaataataatattctgtctttctatgggaatatttctcatattcttcttttttttagtgcatatgggaatgtaggactaaccactggttacagctgttcgaggttgcaaaaactgcacccggggagcatctgccaggacaagccgttcagcttgtccggatggtggagcgatgaaggaaagttgctgctagtctttgtgatgctctatggaaggctcaaggccttcaccaaaggtacgggtgaatattggaggctatggtagaagctgaagcctgaacagaatcacttgcaaaggcaggtgaatcaagtgcagtgtatgtaactgtttagggccttttgaatcgtagaaataagaaaaatgaaataatagaaaaacacatgattctgacagtaattataagtgtaaaatagatgattgcaaaagataggaatgatcgtttgattggacatttggaccgcacaaaaaacacatgaatcggatgaaagagatagactcaaagaaatttttccaagagattaaatatcttgctaaattttgtcctaaacctacatgtaatgagccattccatatggattttataggatttaaaaaattcaatccttctaatcaaagggtcaaattggaaactttcctataggatttcaattctataaaattccttcataaatcctttgattcgggggttaagtggatccatgccattgcaaatttacccaattgaaaatatatcattactatttatgaaatcaggtggatgccactataatgtttcaaaattagaacatgccaccccgtcacgaaatctgtcaactctgtcatgtgggacctacatgtcagtcccatcttcaccaccctcccctctcttctcttctccccttctctctcgacgtgagatggttgtgatcactgagttcttgacagtgaacctgtatgtatattattgggcttgtatgtgttatattggttgttaattgggcttgtgaaatattggattttaattgagcttgtcagagagtggtcccctccagcgggaggctgtgaggcccccctttgtgagttcggccgggggcacgggtgaattcttgaggagtttttaggacgtatgtgaagtggattagagggggttaatttctaagtgacgatgaggactaggggatgattcttttgtgcttccaaagtctctgaatccctggtgggcaagctaaggcagatcaatcctttagccgctggcctcgaaggttcgatcccccctcctccgctaggcgcggtcctccttttatactctaaggggataccacatgtgccgcaagagccaccatcgggaagaggaaaatattctctacatttaatgcatgtcttgagccttgatccagaagtcatccgcacgtcggctgctgggcaagtcccatcaaatcctgctggctgacacaggggacaacgctgtcattcggtatttaatgcatgaggacctttggaagtatgcatgtaccgagagcacaatgtcggccacgtcccggctggtcaagccggctgttgattggatgaggggcacagagctcctcatcatcatgacgagacagggcatacctgccctcatgccgcctgacatgagctcggggcgtggggggcttgccgctatcccatccattcatcacccggtcgcagaccggtcacaggtgggtcacagacgggtcgcaggcgcacgacgcacgcttcccgtcgcattcggtgcgacggagcgcgcctgccccgcttgccataaatgcggttaggtgggtagcagtcgttccacttaacatgcatgcatggttgccatgcggcacctgcccgaggggctcgggataacccaaaccctcgggcccgaggggtgcgggggtggtcccgagcccgaggggggatggccgccccccacacaaggacgtgctcccatgggggatttattgcacgtgtcctgtgggggtagcctctccctcctgggtttggtacccccggcccccgggcccatatcgccgacagagcttatgcaatattggatgttaattgggcttatataacctatctgatatatgagctattatttggtatagtgcttaggtctatacgggctgttgttgggtgtaatgcttgggcttatataggcttttgaaattggcttagctcacttattaatagatactaatgcaaatggatataatattgggctgaaaactatgagtaaagtgctacatcttaaatggaccatgcctaaatctaattgggttaacccataaacaggctactcactatatggacctagataggccacaaagacattttgtgatgttttctgagatagataatgacaaaaataagtgtcataaagttaatgacgaaagaagaaacgtcactagattaatgacaaaaaaaaaagttttcatcaaagaacataattagagacgcatgataggtgacgaatgaatttttgtcacgtgagcgtcacggattttgaaacatgacataattgtttgtttttgtgatgtaagtaaaacgttacctatcataagatttcttatagttatagttatgcttgaatattcaagtttctaattgggccatagtggataaaaaaacacccaatatcatttctcttactacaaagatacgtaatacttttgcatattttgaaaaaaaaaacccaatatgttgaaattgcaattaatataaaattgttgtttcccaaccaagtccctttttttttacttgtattgagtcagtcgccatcaaattatcaatgcaactactccctccatccaaaaaaatcaacctctccctcctagaacaatatatctggacatcccttcataggacaatgtatctagacatacactgtcctaggttgattttttttttggggacggagggagtacgcatggaatcatccatccacgtgatgtatgtacctagtaggtgctaattctcagtgagtggtcttaataaaccttctccggtgtcttttccaaaatttgacgaattcagagaaatcttaagattagattaataatgatcacgggtttagctccagtttcaattcagtccagaaatgcttttccactcaaacaatcatcctttgtttggatcagtcgggttgtaactgcatgctttcatttatggtatgccattttttcacgtataacgaactcgatctctactcgtcccctggccgaatcttcaagggggctcctctctttcctattatgggagatccacactccaacatccacataatacaatggccaatcaatttgtcaataatacatattggataatgacctaggtgagcatagactacatactgtcaaaaatcccaggtcgcagccatcagatgtgggagcatagacttaggtgaaatcctagaaggtgtcccggcagtaagagcgtaattcccaatgaaatatcttggactacccctagccctaggaaggataaaaactgaaagtgcattaatccccttggtgggtttgggtgattaatgacaaatgtggttaagggactaatgagtttattgagctactttcagatgcattagtctaaggtgtggaagatggatgcttggagaccccccccccccctaaaagtataaaatcaaagcggaccggaactcgagaaatgcataggatagtttatttattgcaatcgagttttaggaaaaaccgtactattaagaggggttccaggtgatgctctgagatgtgtcaagtgctcttagtgtgaatcaagtgacatttccccttggagtcatttttgcaaatgctccatctgtctagaaatgcatgtccggaacttcctgtcttccaggtccggaagttccggtcttgtgaaaaagattttcctaagtgttgtccagaagttcttgtcttccaggtccgaaacttcctgtctagtttccagttcaaaattgtgagtagcggatagatgacgtcacctagccgttatacataactagctcgtttccagctcgttttttggccattccacttttacttttcgaccctagagctgttactagcctctcccaagtgttccttaccttctccactcaatcttgagcccaattcttgtgaaaaagagagattgagagtgagagaggaagatttggagatgtgtgaagactaggatcttgggtgagcacttgaaatatctcgtgggctgtcatctcggtgcttattactcttggagatgatctcctagacggttaggtgtcgcccgcgagaatccgttgcatattgtggatgtcccgggtaagtttgtgaaggatttcctctcctccgaaagggaacgaggtaagttaatgaagttcttgtgctgagattctagaggttttccaagtagagcaactcacacttgtggcgaatttctataagaaggttgagttggatcttggtggtcactcaattctagaaatttgcctaggggtgttttgggttgaaggctgtggatttcctctggggtttttgcacaagtgaggcaaggggttaattgagacccagctctttagagctcctcaacggagagtaggatcgtaagatccgaacttcgggaaaaaatcgctcttgtctctttctgtgatgtttctgtggatgtttctgtgatctatcctctacttagaatacctgtgcatcatcgtgtgaagattggcttagtctcctattccgaaatttgaatttcatctttgttctgttacccggaagttcctgcctaagaacaccggaagttccgggcctagcagaccggaagttccggtgttccttaccaggaagttccggtatgtttgaattttaccgctgcgatttgtttttaatttttagggacagcctattcaccctccccccccctctaggcttcatcagcacgttcaaaaacgtcagatatgtagtccgtcttcgacaagatcaccgggcgcatagccaggtggagggggaagaatgtcacgccccgaactagtaccgaccggaactagcctgtgacgctccaaattaacctgttaatcgataccagtcccaggaaacagtgctggtatcacagggagacagaatatcacagcaacagagatctctttattatagagtagaagtacagtcatgttgggctgcggacagatcccgagctcacaactacattacaaaagggaaacggaagccaggacttggaccaaacatcacaggcgcgacttgggaactaggccgaaaccctaaaactcatcgaagccggcttgctcctggaagaactcctcatcagtgggatccgcttcatcttcttcagcaactgggagggggattatttatatagagcaagggtgagtacgggagtactcagcaagccaggggaaataagtgtttaatgcaggcttcaaggagaggctggtgtttttgcaattgattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaacttttcaaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggttgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctaataagctagttactcagccaggggtgtcccattccacccatgtagtcgtacttgtcttatgtttggatgaaattccaaggaatcggtccttaagtgcgagagcgggaaaccgtacacccggtacattccccggtccacgattttggaaattcatttagttcgcaagcgccgacccaggtgtcgggttttccaagtcttttgtaaaacccaagttttacccaagttgtttttcagattttaagtttgaaggcgaccatcggtactcgcacagagtgcacgaatatcgaggcgcaactgggtggttacaaggggacatggtataacaattaacaaaggaaggatcaaatgcaacaaattaggcaggtccgccaatctgccttgcagacgggacaacagattaagtgcgatcctatcaatgcataatattttgcaagcaatataattaaatttcaaatataggctcaagatgttcaaaggtggcttgccttgctcgaaatctggagcttgatcctcgaaatcctcgcactgcgggtcttcgggctccgaaactacacgtgaaacgggacaactcaacaaacggcgaaaataaggccctattaatgacctctaagcgtgccattagatggatctcgagatttgaggaattttggaagctgaacggagtcaaacggatttacggttgggaagatattgaatttctaagattattggatttttggtctaaagggaaaaggatttaattaaatcctttttggaaaaagaaaaagaaaagaaaaggaaagagggagggattatagacttttccttgggcggctagggcgcggcccaagggaaaaggagcggaccggccgagctaaatgggccggccggcccaaggcggcccaagtgcgcgcgcgggaggggaggagagagagggccggtggaccgggctcacctcgcgcggtcccaggtgggacccgcttgtcagcggctcggctcaccgtgcggagggagcacgcggcgcggcgctagggtggaggatggacgtgatacacgcgcgcggttcgcggtggacgcgggtgcggcgggtccacgcgcagcctcacggctcgcggtggaacgcgcgcacggggagggactgaccggggtcggcccgtcccgacctcggctgagctggcgccgtcgtggcgcctacgtggctgccacgcgggccggcgggaggtagacgacgacgccggccggaacggacggcagacgacagcggtgagcggcggagcgaaccacggcgataccggcgaaagcgagtacaccgggtggctgcacaggacgagaggagatgagccaacgacccggattcgccggaggatgcccgacggcggcgaattgcggcggcggcatccggcggcggaagaagggggaaacggcgacgaggtcacgaggggccgattcccggcggcgagagcatctacgcggctacgggaatccgatgctagcgtcggattgggcggagctacgccgagcgaggccggcgacgagcggggcggcgacggcggcgagcacacggcgagcgtcggcaacggtcggggcggcgccggctagctacggggaggctactcgtgctaccaccgaaaactaagggggggagatggagcgaggaggaagaacggagggaggcactaccgtgcgggcggggcgccgtgacgagaggccgacggcgcgggagtaatctctccggcctcgggccgaggaagaggaagaagagggcgcgcccggagtgcccttccgcgtcctagtgtgcaccggctcctccggcacacacgcgacgacgaacggcgacggcgaacaggggcgacagcaatggcacggaggcgaatgggagaggaagggaaaggggggaagccgggtttaaatgggcggcaatgtcggtttgggagaggggaaccggcattggacggtcaagccggcgagctagcgctccggctagcggccaaaactgcgacaggaggtgacgccggcgagggggaaaaaggggaaaagagggggagaaaaggggagctcgtcccttgccactttgggaaaaaggaggaggggagcgggagcgtcgcggcagagggaggagggctctgcctccgtctcttggcggcttgcgcgcggggaggcggggccgaggtgatgacgacggcgatgacggcggggcggtttggagcggcgcgacgacacgagcgacaggcgctgacgacggcggcgaccaggcggtcggccaccacggcacgcgcgcgcgggaaacaacgggcggcgcggcggatttgagcggcgcggctgatttgagcggcgcggcttgggcacgcacgctggcttgcggggccgggcggctgcgcggctgcaggcgcggcagggcagcggggccgggcggcgcggacggcgcagacggcgcggctctcgcgcacgcgcgcgcggcgcgcgggcagagcggagggaggggcgctgggcgcggctctcgcgcacgcgcgcgcggcgcgcgggcggagcggaggaagggagagagagagagagagagagagcgccgggagggagggggagatgggccgagagaaattcggcccatcgaacccgggggaggcaaaatagacttttgcggatggatttgatttggaaggatttggattcggaaatgaactcgacgatagatcggggattgagatcttgagatggcacggacactagacaacaagcgaagaaacaaatttcgcaattagggtttttaagagataattttcccgctaggcgccacgacggaacgggcgctacaaagaacatggggccggctggaagagccacgctcgtcaagtcagtcttaacggcccaaccaatctacctcctcaccgcccttagagtttcaaaggaagctcttgggcaactggacaagcaacgacgccgctttctctgggccggcacaggtgacatcacaggaggaaagtgcaagatcaattggacaaaaacgtgcatgccgacttgtcatggaggtctcggggtacttaatttggaaaagttcacgagggcactacgtttacggtggctatggcatgaatggaaggacccaagcaaaccttgggcgggcctagaaacgtcgtgcgatgaagtagacaaggttctcttcgctgcgtcaacaaagataaccgttggagacggaaacacaacacgcttttggtattccgcgtggatagatgggcgcagaccaaaggacctcatgccactggtctatgcaatctcgaagaaaaaaggcaagtccctatgacagggaaaggaaattgatgcttggatcaacaacttggaccttgaagccaacccgtcaatctcggtggaccttattgaacaactagtctccttatggattgccgtgagagacattcacttaaacaatgagcagtcggaccaaattgcgtggaaactcacaaaccatggagaatactcagcgtcgtcggcttaccaggcacaatgcttcggcgcgacagacacgaactttgactcgctcatctggagagcttgggcgccagggaagtgtaaattccacgcctggctggtcatccaaaatagggtttggacctccgatcgactcgcgacgagaggatggcaaaataatgggctctgcccactttgccgcagagaaggcgaaacagccctacatcttcttgtcagttgcaaatacacgaaaagaatatggagcatggtagccacctgggtagcttactagcagctcgaccctgggcgttgggggatgacccaaactgtcaaaaattggtgggagactctagctaacacggcagaggtttctaagagaggtttgcgcaccctcatcctcctcatagtttgagagatatgaaaggaaaggaaccaacgaatcttccagcacaaggaggccacgccatctttgctcttcgtcaagataaaggaagaggcgcggacttggacgatggcaggagcaaagcatttgcgagaccttctacccctccatgtataatatttaaagtgtataaagtttttcgtttttttgtatttaggggttgttttttcttccgctatattcaatggaaaggtacaacctggtgttgttttcccctaaaaaaataatgaagataacattggtacggcgccagtaggtgatagttgaacatgtagctatacgcggagctcacgcgtccggcagcctcagtggcagaaatcattcatcatgggctgccaattcaagtctatgattacgatgcagccaatcaacatctaattaactagcttcctcaacaaattaagctgaaaaaaaaagagatagagatcgagctagcgacctgtacgatgcctacacgcacacgtacgtcgcagcctccaataatggtattattttttttcttcactgaataatgcactttattttattgtaggctgtgttcgcatgcaccttttcccatcccctctccttcgttttccgcgcgcacgcttttcaaactactaaacggtgtgtttttttgtaaaaagtttctatacgaaagttgcttaaaaaaatcaaattaatccatttttaaaaaaaaattagctaatacttaattaatcacgtgttaatggaccgctccgttttccgtgcgcaggagttaggttcccatctcccccatccgaactcagccgttaacgtccagcagccaggttcaactggatcgctccacgtttacattaatttctagcgtcttccatgaacttgtcttctcaaactgctagctaaccgcatgacaatttgtatgctactccctccctcttataatataagcactgtttaaccatttatcttatttaaaaaatttagaattattatttattttatttgtgagttaatttattattcaaagtactttaagaacaattttttattttttatatttgcacatttttttcaaataaaacgagtggccaaacaatataaataaaaagtcaaaatcccttatattatgggacgaagggagtagctgtgtgcatgcttgcgaggttaattacctcattcggtcatagatttacttaacaagacaagattcgatcgatcgaacgaactaaaatccatccataaatcttagtgtgttatcctaaacatttaatatttaatatttataattggagagtagttttctctcttaacagtattgttgatagccaaatttgtattatgatccaattatagcaaagtttagctgaattcaaaaacagacccgaacttcccgtatgagacaagtctaaccttaggtatatggcgggtctgaccaggccccaattggaccttaggtgtataatcttagagaggggggtggggtgggggtgggttgtgttttaatacaacgcaccacatctgtagtatagtatatatatatctctctagatatagccatatttcaagctttcagaagttcattgcaggtatgcaagtgatgtatcatctctgtttatatagaaatgtccatactacattcgtccttttttaagtataattatagcttttcgtgtctaacgtttgaccgtccgtcttatttaaaaaagttatgaaaaaaaataaaaaaaaagtcacacataaagtgttatttatattttatcatttaataacaacaaaaatactagtcataaattttttttcaaataagacggataattaaacgtttgacatatccggtgtaaaactatggtctttctggtatttatgacgtagatcaatcccagataagattgagggatttctgtcagagattaccaatcaacctgaggaacctgcaggtgtttgtttcttactgcatcaatcagcctgtactacgaacaagaacaaactcagcaatgatcgatcaattgtcccaagtggccatgtctcttgtccattgtcggattgtcccttccaatgcccaagcaagcgttactgtcgaagctagagccaagcagatgagctagcagaagaagctacatatgcaaatgctccatcattgtccctttgaccttgatcagttaattagctgcatactagtctgtccaaaaaaaaaagtaaactctagctacgaacctatgtatgtacggaggattatgcaagtgagagagagagaggatacatgctgctggttggccggtgaaggatgctttttgcatttgcttttgcatgagctcatacactactgagatgaacgtacctgtacttgatgtactctgcactcaaattaaagatagaacatggcctcaatgccttcaatcattctgcttgtttattgccttctttaattagcagtttgattggtccattttgtatgccttgattgctaccgttagtagttgcacatgcacctagcaatagatgccgatcaacgttcccatccatggtcagtaccatgttcttcaatttttccaagaaaagttttgtgtacgatgaagattttgttccattttttccaagtccaacttcaaggaattaaatttaaaaatacattatttatttatcttttcctcaaaaatatacgagatgtaatttctttggcacaaatttaccaccgtcgttgagtaggaatgtgaaaatggcacgttatatatcgctgaaccgttgcacgaaaataacgacaccggtggccacgccgcggtctcgcaggacggtgccacgagggcgcgggacccagcacggtgtcattgggcgagtgtctgagacaccaacaagcgagatgaaacaatgattagtgattaattaattactaatgatgctgattaaagaaataacaataattagtacggtctcgcttcaccaactactagcaaaatggtataatgattagtattaatcaaaagaaataacaataattagttaattgttaatgacgctaattaacctattaatcaccgagttagccagttaagagatgcgaagtcgtagtctcgcgcccgcgtcgcgggacattcgccgcgcgaattggcacggtaacgcacgcacgtactcgcacttttattctgcaacaatgatatacttatgtaaatccttctaaatgtgtatatttatgtaaaatcagtggaaaatgggtatattttttaaaaaaatttcccaattttaagtatcgatggagattaattttctctattttttttggcaggtctaatcttgcgtacgtacaatgaagatgtgatattagaacgctgatgtactagttgcaaaggcagaaatagtctcgagaaactcttatttagggcctgtttagatcccaccctacaactttacaccctatcacatcgaatgtttagacatatgtatggagtattaaatatagaaaaaaaaaaactaattacacagattccatgtaaattgcgagacgaattttttaagcctaattagtctatgatctgacaatgtggtactacattaaggccctctttgtttaggattaggcttattggcttagacttttaagtcagcttattggcttatatgatttataagccggtggatttaatgtcctaagtttagtggtggagtcatacatcaacctcacataagccaaaaaatcttctccaacctagtttttggcttaatagtgttagagtggcttatggcttcaaaaaagccaaacaaataagctgcttgtttgtttaggcttagacttttcggcttataagttggcttataagcctaaacaaatagggcctaaatatttactaatgacagattaattaagcttaataaattcgtctcacagtttacaggcggaatctataatttgttttgttattagtctacgtttaatacttcaaacgtgtgccagcatatccgatgtgacacgccaaaactttacacccctggatctaaacacccccttaatcaaaaacaacaagtgttgggacttcagttcttttctgagaagatacctggctcgaaggctcatcggttcgctcattggcaccggccgtatacacggttgtccctgcccgtttgagaaatcgccgtacggtggctgaggcgcttcacgacagagggtggattaggaacatcaccgccgctcttggcgtccaagctatcctggagtatttcaaactctaggacatcctcagatcagttcaactctcggatgagcctgactctctgacttggaggtgggagtcctcaagggagtattcttctcggtcagcataccgtgctttgttctcgggtagaatccgttttcaatacaagcctaattggaaatccttggcgcctcctcgttgtcgctacttactttggttggtcgctctcaacagatgctggacggcagaccgtctccagagccatggcttgtcgcaccctgtgcgttgcgttctttgtgatcaaagtgacgagactatcgatcaccttttggttgcatgtccagagtcttggcagctgtggtggattgctctcagagcaattgggctttcgaaatgcttgccgatcaatgaccttcctttcatcattggctctgtgatagcaaaaagaagatgaccaaggcgcatcgtcggggatttgacaccatcgcaaccctggtagcatggacgatctggaaagagagaaacaatagagttttcaatcaggtcagcataacttgggtggagatcgctcgggccatgatagacgaagctgatctttggaggctggctagggctgccatacacaccttagtagtccatgtagatagagagaggtcgcttggagattaggctctaatgctcttgcacctctcctgtatcctccccgtcttgtttttcttttgttatgtccacttgtacataaactttatttcttcttaatataaagatgcgctccttgcgaattcccaaaaaaaacaacaagaagcaagtcatctttctttttttttttttttgacgctgagcaggtaatcattagaacagttagaacttttaaaaagacaaataatgctgctgaaaatattccacgaagaataatctcatccggccaggttccaagcagccagaacttacttatgcagaagctagtcatccatgggtagtatcagtgtttacacttctgagaatccgtatagtaattcttctcagagtgtgggtgtttctcgagctatgcatctgataaggaagcattgcatctatcaccaggaaaaccaaataattgagctacagattagttataccggtcttactgtccaataattgatttttttaatggaatcatagtctcacagataccaccaaagccaatactcctccattgcctgcatataaataacacaaaagcagaccggtcttggcaaaggacactcactttgctttctcatactcgttggctcgttgctcctttgcatcaaatgacgagcatttaccatgatttcattcataacaagctgcagagcttcggaaggatcggtagatattttgttaattttgttgttctagcccatagattcattgccttgcatattcacccattctggattcagttgtcctacttccttctcattagcatcctaggttcagttctattgatgttcctgaagccaaccaacccagaattcagaccaggttacattgacatgctgttcttgtcaacctctgctctgacactttccagcctcatcaccatcgaaatggaggttctctcaagctcacaaattgtggttattacactgctgatgcttctcgggggtgaagtctttgtttctttcctaggcctcatgcttagactgaaccataagcacaacccagagttttcaggggacaaggtcagttcagttcctatcgagcttgatacaatcaactcggcaagcactgtgataagttgtgaagagctgcagctggaagcagcaattcctgaagttccatcttccaccattaaggatttgaagaggagcaagcgcctgaggtggttcttaggatttgtagtcttcagctattttgttgtgatccatgtcgctggctttctgctggttctctggtacataagtcgtgtctcatctgcaaaagctccactgaagaagaaagggatcaacattgcactcttctcattctcggtcacagtctcctcgtttgcgaatgtggggctcgtgccgacgaatgagaacatggcaatcttctccaagaacccgggcctcctcctcctgttcatcggccagattcttgcaggcaatacactttaccctctcttcctaaggctattgatatggttcctggggaaggtgaccaagttgagagaactgaagctcatgatcaagaaccctgaggagctacagtatgattatttgcttcctaagttgccaacggcgtttctggcatcaactgtcattggccttatggcttccttggtcacattgttcggtgctgtcgactggaattcttcagtctttgatggactcagctcttaccagaagattatcaatgcattgttcatggcagtgaacgcaaggcactcgggggagaactccatcgactgctcactcatcgcccctgctgttctagtactgttcatcatcttaatgttagttcatgacacctcatctatttatgtttcatgtcatccaactaatactgttagcttcagccttcaggtgatgacatatttgtctgaaactttactttcttggttttcaggtacttaccaccatcgacaacatttgcactgtccaatggagatgaaaaaactgcaaataagaaagcgaaaagaaaattaggtttagtggtgcagaacttggcattttcacagcttgcctgcatctcagtctttgtgatagttgcattcatcactgagaggagtcgtctcagaaatgatccactcaacttctctgctctgaacatgatatttgaaatcatcaggtgtgttcctctctcttgattatgcaatcaaaattctcgtatcaatctgctaagttacactgggcatcaagccaatgatattgtaggcaaaataaaaacaacgaaacacgataaaataataaacttcattagcaaagcaagccaagtagtaagatccacatctgacacctcagaatctttcagaagacaagaaaactaacccaaacatagattgttctcaacaagataactattttgtactattctgtctttctaaaagagtatgcctgttctttcttttttttttttgcagtgcatatgggaatgtagggctatccactggttacagctgttcgaggttgcagaaactgcacccggggagcatctgccaggacaagccgtacagcttgtccggatggtggagtgatgaaggaaagttgctgctagtctttgtgatgctctatggaaggctcaaggccttcacaaaaggtacaggtgaatattggaggctatggtaaaagctgaagcctgaacaaaagcacttgcaaaggcaagtgcatcaagtgcagtatatgtaactatttagagttctgcctgaaagttcaggtttctaattgggccatagtgtataaaaatacacccaatattattcctcttaatacagtggtgcgcaatcctttagcgtattcccgaaaaaaagaacacccaatatgttgcaattgcaatatagaactgttgttctccaaccaaggccgagtttagttctaaaatttttcttcaaacttcaaatttttttatcgcattaaaacttttctatacatacagactttcaacttttccgtcacatcgttccaatttcaaccaaacttctaattttgacgtgaactaaacacaccccaagtctttttttttgtacttgtattaagccagtcgccatcaaattatcaatgcaactaacacatggagtcatcagtccacgtgatgtatgtacctagtaggtgctaattcccagtgagtggtcttaataaaccttctccggtgtcttttacaaaatttgctgaattcaaggacatcttaaaacaattagtaacgatcacgagtttacctccagtttcagtccagaaatgcttgtccactcgaacaatcgtactttgtctggatgagtccggttgtaacagcatgcttgcatttatggtgtaccatggtcagcaaggaactgaatagagcagtggctgatagaggattgatttctgtccagtgatttctgtgcatgtcctttgaagcatggcatcagaatgcttcctagccatgaattttgtaacagctaaacatgctccagtgctatcgattggtagtagctgcaatctctttctggatcatcagtgcaggacatactcaaggcaaccaaatctatctattaacttattaacttattaaaggaaaagaaaaaggagcctacacgttcactctcacggcctagaaattctcatattactcggagaaaaagaagaacagagtccatatagaaatataatttaaaaatagttgaaattcggaattaaaaaataaagaatattggaagaggagactagagtccataaagaaatacaatttataaataactgaaattcgaaattagaaaataaagaatattagaagaagagtataaagtccatataaaaatacaattaagaaataatagaaattcggaattaaaaataaggaatattagaagtagagtatagagtacatatagaaatacaattaagaaataatagaaattcggaattaaaaataaggaatgttagaagtatagtatagagtccatataggaatttaaaactaactaaaattcagaataaacgtaataaaattaaaagtagagtttagagttcatataaaaatacaatttacaaataactaaaatttgaaattaaaaaaaaacatgagaagaatagtctaaagtcgatataggaatacaatttatacgaatctgaaattcgaaattaaaaattaaagaatattaaaaaatgagtttagagtccacatagaaatgcaattagaaataataaaaattcaaaattaaaaaaaatattggaagaagtgactagagtctatataaaaatacaatttacagataacaaaaattagaaatttaaaaaaaaataaatattgaaagacgagtctagagtccatataggaatataatttacaaataactaaaatttgatattaaaaataattaatagctaacacatatataaaatacaatatgaatactacacattagtagtttcgtaaagttaattcaaaatttaaaattatgttgtcattttaatatatttgaataatacattgagaaaacatatatgttattatatgagagaaaatataatgatgttagccgcgtaatctgcgcgggccgtcatgctagttcaaataacttgcacgaaagagatgagttgaatatacttacctaaatgatactaagtggtggtaccgtaataattctattaaccttcttgttcaaatacaaaatttcagagatgctttggcatccataaaaaaatcaccatatcattccagatgtactgtaatcattttcgggttttccataaaaattcagagatgatatcaaacagaggcactgtaataactctattaaccttcggatgtcggcaatgttataccaattgccaagaatttcagtcaattggttgaggagcatgcctgcctgctctttcaataacatgtcatcttgctcaaacagttgctattctcacccattacacttgcttatccacagtcatagttgccttaccagtatggcaaatagaggaacaaaaattcagcacgcatgcaagcagtagagcacttctttctatgctttttgcaagcattcgtgtatctacctgcatgctccgcaacttaacatcatgttctgaaaggcatctcaactatgttacacatgtcttcctcctctccactaatattaaccaatagacagatacactattacagtgccttgtatatatatactctcactgagattggttgtcacctttatatttcaatacagcagttgtagttccatcttgaatcaagacaaacacaataaggagctagaggctctgccctctatctccaatgcctattcggctgcatatctttgtcagttctgcaaggcatgccatcaactcgtcggcattgatttgtcggttcatcgcattccatcttagcccgcttttgattcacctgtcctattttcttatcattgatgtacttggttttgttgccttggtggtgctcaggccaagcaaccacaagtacaatcctcgctatatcgatatgtttttcctatcgacatctgcagttacagtcacaggattagccaccacacaaatggaggatctttctagctctcagatagctgtcctgactctcttgatgttcttaggaagtgagatgttcctttcctttcttggccttgtccttgagtcgagcaagcaaaacaagcatgatcctgaaaaccgtagagtaagttcagttaccgtgtgtgagcagtcacatctagaagaggcaattccacaaactccatccatgaactccactgatatcaagaggagctgccacaaatacttagtgtttgtggtgttggcatacatgattattattcttgtcactggttctctattggtgttcatgtacatagctcatgtttcaagtgctagagatgtgctaacaaggaaaagcatcaacaaagctctttctcgatatcggtcacagtctcctcatttacaaatggagggttattgccgacaaatgagagtatggctgtattctcctcaaacaatggcctcctgttgctactcatcggccagattcttgcaggcagcacactgctccctatgtttctgaggttggtgatatgggcattgagaggactaagattagcaaaagctgaagagccagacttcatgatgaacaacagcagctcagtaggtttcagtcacctgctacctaacttgcagacaatatttcttgcagctgtggaggttgcttttgtaggcatgacagtcatcctcttctgctgcttgaactgggattctgcagtgtttgcagggctaacctccctccagaagataaccaatgcattgttcatggcagtgagtgcaaggcaggcaggagaaaattccattgattgttcccttgttgcgccagcggctttagtactattcatggtcatgatgtgagttcctctctttcaagctcttcacatttttcaggcaacaatcagaagagataacataacacggttgcttacatttctcaggtacactccatccttgacaaagttgttctcagcatgtcaagatcacaaacaaatcggcccggaaagcgacgatagaacaagcaaggggaaaccattcctgaagacgatggcattttcaccactagccttcaacaccacagtgataatgctggtctgcatcactgaaaggagatcgatctccactgaccctctcaatttctccacatttaacatcatctttgaggtgataaggtaattaagttgcacatctactcaccaaattcttcttctgatactgttcttgctccctccatgattaattcagctaatttattcatcacccattgcttctgcacacagtgcctacgggaacattgggttgtccactggctacagctgctcgagacagctacagcaccaggatgggattgcttgccatgagaagccatacagcttctcggggtggtggagtgaaccagggaagctgattcttgttcttgcgatgctctacgggaggctcaactcaaaggattccacaagcgcacgaactaggtgatgatgttatgcaagaatcaagaatgcagtgtaccatcccatcaaaaaaaaagaaaagaaaaatggatgcactcaactatgatctgcctctatgttcaaatttcaatgattggcgacagcgcacttaccggaggcggcggagggtgatgcccttcgcgggagtgcctcgctgcgacaaacagacggcgccgttgcgattcctgcaatttttcacaaatgtagacagtcaaaaaaggccctccttttcttaaaaattaatggattattaaaaaagaacacatttatcccccctttaacctttattattatatcaattagtaaattacactaatttaattgtcaatcatagccaggatcatgttgcatgcaagtatctagacgatgaacaggggaacatgttctcaaatgaattgatagatgagagaacaggtaaatgaacaatgtatctaccaatgcttctgaagttctgaaacttgctacgaatgcattcatggtaaatgctagtagtcattttctgcaaagaggtccgagtatcacaaaccaagttgagcttcttgccaagatcccagaaatctcataaaccattcccctcgaggaactagtactgaatataaggagtatactataaaaaaaatgaatcataatcagctataatatcactatttacagcaagaaataaaataataaagaaatagaacctaacaaactctgataagatcattgtggtatcctaaaaatagcaaccagttcctaaaaaacaacaaccaaagtatccacggactgcaagcaaaagggaagaagctaactttgtgaaagcaaacccccactgtaccaaaatatatgaacaccacaactcatgcaaaactacaagcatggaaagcatcaaagggcatcgatacacatcctgaaactcattttaagccatatcactgcagtatattataaataaccatccagtccacataaaactataataaaaaaagataccttcattaaaataagacatcggaatacacatcacctatactctcaatatcactctagcttgcattcacccataaagcagttctagttcatgcctctcaatgtcactctagcttgtattcacccttaaaatgtcactccagcttatattcgcccttgaagcagttcggttcatgcattgggcgaacttagcatctcgggtaggatcgaaatagatataatcgtccccacacatgcctactctattgcctgcccacttcccaccactaatgattcttgcattggtcagctcatgcgtgccatgcgccatttctgtgaagtccatgtcgccaccacaataattttcaattggatgcgcaggatgcataatcctggtcccttcatattcataataacaacaacgagcttctccaaaaaagacataccaaaaaaaggttagcatcaaaatacaagaaagaatcattctataaattatatttaagaaaaggacacaatcatatatcaaacataccatgttttgattttcttgagacagtacagcaaaaggatacatcatcatcatcattactgaattcagcaaagaataacttaagtccacttccaacttttgggcttgccaaaaagtttacatgtgaatatggacacttgaagtccaagaagttcatctggctgcccacacgctcatttgcaacacagattacttgaagatcatatagatatccctacaaccatgaaagaagtgaacttgtagaaaaatggcaattataatgacattatgaaaaggaaaattacacactaaacagatactcttgttatcctaatcaatagggaagaagtgaacttgcaaaagaaaaactacaatgacattatgaaatgggtaattccacactgaacaaatcctttcatcgttatcctaatcaaatcattagggaataagtgaacttgcagaaaagtgcaaccataatgacatcatgaaatggataattccacgctaaatagatactaaactaggaaagaagtgaacttgcataaaattgcaattataaatttataatgacattatgaaatgataattccgcgataaacagatcctttcattatctcaatcatcaggtaagaattgaatttgcagagaagagcaattataatgacaatatgaaatagataattctacactaaatatatattttcatttccaaatcaatagtctaactagagagcaatactttgaaagtagcacataatatggaatggaaggtgctaacctttttccttagtgcagcttcaatctttctacgaaaaaaaccctattgagtgacacatttttccttgaacgctataaacatatccaatgcatctgtagacagatcaacaattgtctccaaagatttagcagagatgcaatttgaagatggcaacaacgtagctagctgaagaacatcattcgaggaaagtggggtagaagcacacaatagtgatttaacggcagcctgcaccttaggtagagattgagtggaaaactgtacataagcttcgagctcaggatgaaacaatgcatccgctgcagccttgtaggcactgacatcccagctggattcccacccttacactcctgccatttcaactgctttgcaaactttcagattattctttagcagatatatcatggcatcatgctcaaaaatctcaggaatgcatgtaagcaattgcttgataaggccacgaagggaccgggactccacacgaacaaaggtggaggtgcagatcatgtccacctcaagtttctccacagcagggaaagcagagtcataccagagggtattgatgatgatgttggtcacacaactgaatgggccatagcagtaaccaccattgacaaaggcaaggtggtaatgagcccgaacatcttgcattggtaatcgagagattgccttgatgtacttggcatgaatcttgtcaagtaaaacagcccggagtgatattgtcaaaccacctggcaccttctcaccattagcatcaccagtatgacagttacgaagccgccgttcatcagcgaaaaatcattggattgtcagacttcaagcgtgagcggcttcttcttcttcagaattccagaaagcaacaagatcttctcaagccgcgatctgctattatcacggcctgggtgacgaattcaagatgagacgccagcgaaaacgaagcggcgatgaagccgtcgacgttcggttgcctcgcggatgaggctgcgcatgtaagggcagccctggcagcgtaggaggagatttggaatcgttcgtccttggtgttgtagcagccgcgattgagctcgatgaggcggacggcgacgaggaggtcggtgttcgcgaggcgcaggtagcggagcgcgtcccaggtggggaggtagcggaagtaggatgtgaggaaggtgacgagcccctccagcgatcgctcggcgatggctcgtgtctccgacgacgacctcgctgctgctgccgatggcgccgccttcgtcttgcgcttgcgcttcttggcactgtgatcgggagggagggaggagagggtgttggcgatgatattggtggtagggtcggcgaagccgaagcagacgccggcggcgacgagaagcggggcgagctccgtcggccggcgatttggttggaagacttgggaattcgagggggtttgggacggggaattaaaaggtcgaattccaaccaatctcttatctggggaagacctgttaattcgtgagacttggagggaattcaatgtgaaaccaaataagggatgatgactaaaaatataactcccacgaccaatctcaccatcaactccctccttaaaactcccattcctctttccttctcttcccaaacatgccgttaaggtttggcgtcgacaggggatttgatttgatctgatttgatctttttttttcctcccctttctccctcgctcctccggcggtccggccttcgacacttcgacagacaactcaggggggaagacagagagtgagtgggcctaaactgggccagattcaatgaataggagttccgtgtgtggcgtgaggaataagttcattttaggtcccttaacttgtcaacgaatccgattttcgtccttccaccgaaaaacaacatgtctctcaactgtcaaaaccggtgaagcccaaggcgttttggacggcggtttgcgctgacgtgatgcctacatggctaatttgactcggcctaaaaattgtgggcctacatgtcagtaacaccaaaaacaataacttaaaaaaggtgggggcccacatgtcaatctcactctcttcttcttcctcctcactcccccatctcccctatcttcatctctcccctctcctctctcgggcgtgacgaccgatgggcggcgggaagaagagcggtgcccggcggggagaagggacaacgtgcggtgatggccgccggaggaggaggagatgcggggaggcgtaacggtggcagccagaggaggaggccgtccgccacgcgctgctcccttctttcccgtctcctccaacgccaccatgccacgagctccccctcctccagctcaacgactgccaccaacacgaagaggtatatgacgataccaaggatgagaagcggtggcatggggagcagtgccgcggctgcggcggcgacggcgtcgattggaagaaagagaaggggaagcccctcgctctggccggccgcagaggacaccgccgacgccatggagatgctgcggtccaaccggatgctcgacaccgccgccatcgtcagcccgtgcgccgccttggtgcatagtgggatctgtgcagcagcgccaactacccggaggccgacttccactgcgccttccgcatgtcccgccccacctttgacttcctctgtgccgaactcgctgccactgccgcacgtcgccccttctttgctactactacacaagtagcagtagcaaagaacactcttgtactacttccttttcaacggactgtccttggttaaacatgacatcttgacctatctcagcaagtacatataattattgtagcaaaaaagaatctataccagaataccccaagcatgaaaagcatctttatcactccagcttgcattcacccataaagcacttctgattcatccctcgcaatgtcactccatttcgtattcacccttgaagcagtttgatcggttcatagctaggattgggtttttttcttttgggacggagaggtacacattgtttccgagaaactacaattcatcacaaaacttgaatttcttgatcaaagaagatgcttcaatgcactatagaggtaaaaatcctaatttatctttcttatgagttagcagtgtacatgatatctatcacacccgtgatgcttaattgtcacacatgaaaaaggtgttagttgtgttgttattgctagaatgaggttaaaggtgagttttgttgatctgtcatggggaaaatcaaggaattgagcagttggtgggattgctcacagagtaacataacgaggctccaaataccagtaatataattgttcctcatgctgaatcaataaaaaaattgagttgatgcaaaatgatattaaattgaaggatgtcaaaaaatatttgagttgatcagagagaacattattgattttgaagactttttttcctttagtgcagcttcaatctttctacgatgtattggactggctgcaagcagaggaacgaaaataaagattagaggtggttttggtatgtttaggctgggccaaaatttggaagagtttttacatgggcttttcatgggccagagcctaagctggcccagaacaccactacataagctcgggaaacccagctagggtttcgatctccgcctctccgacctcccgaatcctcccaactccgccgccgccgccgcgaagcgcaagccgacatgggcgtgtacaccttcgtgtgccggagctccggcgacgagtggacggccaagcagctcaagggcgagctggaggcctccgccgccaccccctacgagctgcagcgccgcctcgtcgccgccgcgtccgccgccgactcggccgccggagtccagtcctccttctccatggtctcgcccagctccgccgtcttccaggtctgcctgctccccctcccttcccatcgcgccctgctctctgttccccccccccccaatcatctcttcgcgttcctgcttccgatctaactgtatgcttgcgcttgtctagttcttggcttcttgctcgttatatatgctatagaagaaatatctcttgcgattcatgtgctagctggatctgaatagcacatttgttccagatatgcgatattttgcattgattggtaggtaggttgatgtttcatgttcaatatatgtttggtgatattctgtccttgttatgtagccgttcaaatgcatctcgttgcagtttgcagtcaacagagtgatgatacacatatttttttagtctttgttgctttgtagtgtaattacaatgctagtttaatccagaggttcaccttctgatcatgtggtcaacattgccatcagcatcatttgttcgtgtgtatttttatttgggcaagattgtgccttatagctgcgtctagctgttttgctgtttatacaggtggatatggttcttggttagatcccagaaaatatctgtgggctttgacacaaagctcaccttagtaagagagaaaattgtttgactaatatgaataagctgaagcgactaaattgtctagccagataattgaaattggcatctgtagatttctgtataattcttagcatgactgtatgtggctctgtgatcttatatcagattcttatcagttcttttgctgtttatcggtaatttttgtcacaaagtaaccaatgtatatgtgaagtcaattctagcttgttggtagcatagcatgccattatctgtgtattgttgatgactagtgtatcaaccaaagctatactcggcattcataagtcataccattttatgtagtgctgaccacaattctcatacaggtgatcattggtgccgttggtggtggtgccgcgattggtggaggtgctgctgctggtgccgcctccggtggagctgctgccgaggcccccaaggccgaggagaagaaggaagaagagaaggaggaaagcgaggacgacctcggattctccctcttcgattagatatcacttcgcttgtatcccacaaatttgtcatggagttcttgcagtagttttgttgttctatgcatatgaaccagaggcttgtgaacctgtgaaatcttcttaagagaaattgtgttctggaatgctggctgtatctgcgttacttccgttcgacttcatatttctgttatgttgtattttgcatcaacagaaagttataatcagttacatgcaa

SEQ ID NO: 75832 - DNA, 36550 bp, Oryza sativa
cagactttggtttagccagggcatttggaattcctgtccgcacgtttactcacgaggtactatagatttgtgttcaacattttgttttcttcataaagtacattttttttcgtcataaagttcatttttcatttaccttttctatacactagcacattaactcacaatggatgtctatgggaagtatttttcaggttgtaaccttgtggtatagagctccagagatccttcttggatcaaggcagtattctacaccagttgatatgtggtcagttggttgtatctttgcagaaatggtgaaccagaaaccactgttccctggtgattctgagattgatgaattatttaagatattcaggttctattattgtactgagattacctttttttgttctgttaattgtgtttttgccaactctatgatttatgtgttgtgttctggttacttttgaagggtactaggaactccaaatgaacaaagttggccaggagttagctcattacctgactacaagtctgctttccccaagtggcaagcacaggtatgacaaaacagcataaagattttattaggcgggtgaactgcatccatatactgtgccactaatattccttgactgaaatcttcatcccaggatcttgcaactattgtccctactcttgaccctgctggtttggaccttctctctgtaagtcgaacaccactcacctttgttcattagcatgtcataatataccccaaaaaaaaagtatcccatccttgtctcgtttcactgtcagaaaatgcttcggtacgagccaaacaaaaggatcacagctagacaggctcttgagcatgaatacttcaaggaccttgagatggtacaatgaccctgctatggctttacattggattggcatatgtatgggctgggctcctcatttcattccttctgtgaacgctgtgcccttcgtttgggcatttttgtcattcagctggatatttcaaatcttgtgtgtttgatatgtattcaggaacgctaaatagatcaccgtcttggtctctatttgttcagagtaaatatcttccaatgctgcctttcagtttccattgaacctattcagatccaaatagcccttcgttgctgttacacacacctttctggtgttccactgggactggggtcaactgggggacacgcatcattggtgctcagcaagatcctttctcgtcttgttgcatgcgttcgacatcatcagaccagagtgccacaacgactgatcatgaacatgcactgacaaaggattccactaccaaacggaaaagaaaaataaagagcttccaaaagccgaaacgtgcggagcaaaatctgtagcagatgcgaaggattccacgagaatgagaataacaaattttgcactggttggcccctctattccatgcttgatgtgtgagtgatgtggccataaattagacggcagctaatgagattattatgcggtcacgccacgccacgccatgccatactcgaatcgaaccacaacttgaggtttccagctgcataccataccatgcctgatggcagcatgggaaggagtcgtcgtcgccgcctagtgatggaagtcgtttcacgtcggttaaagtggtgcactctgaaagggcaggagtagcgagtcggctactggggtgggtgagtggagtgagccagcagcagccgcgggggcaccgaaaggggcttgtcatggacagggaaacgccacttggaccgtcattgggtccactgctgcactgcgcaattgtaggcgcctagccggccaccatttcaggctctcagctcgtcacaagttctcaacgaaccctatgaaaacttcgtttcgaggctgcacgtttgcaatgtgagtaaataaaatcatttattgaagattacaattgtatttgcaaattcagttagctagagggtaaatctttttcagttacagtatctttcctaggaaattcataccgaattttgaatcatcatgttctgaatttgtactatcatacactacaaaattgattcagccactaattgtttaggctatccaagatttctgctaattatttcacagaaaatgcttgccatctctgcacggcaatagagggcgggtatctcgtccatccctcttggtcccgcactctctcgcgtggagcttatcttccaacggatacttgaacaaagctaatcgccttgtcagacacccgcatccccaccatccaaccccaactcattcccgctatataaaccctccacccagcgcagcggcaacaaggcaacaactcgcactcgtcaaagcagagcgaactctagtgaacaagcaagaggccgagacgccaacgcaagcttagcacagtcatggcgagcagcaggcggcagcagcacaagggttcgtggtcgtggacgtcgcgggtggcggcggcggcggacgcggcgtcgtggtgcctggcgctgtcgctggtggcgctgctgctggtgtgctcgctcgggcccggtggcgccgccggcggcgagcagcggggtggtgtggcggcggtgttgcgcggcgcggcgctgtcggcgcgggcgtgcgaggagatctacgtggtggcggagggggagacgctgcacagcatcagcgacaagtgcggcgacccgtacatcctggagcagaacccgcacgtccacgaccccgacgacgtcttccccggcctcgtcatcaagatcacgccgtccaagcccaggtagattaccacaaatcacatcgacacgggatatggactccatcgccactcgagggatgaactggtcaacgtgtatgaaacacacaagtgttcgtccgagagcatcgcgcaggcctggaatggatcgatgcatcaaaacgcgcgatctggattcgatcgatgtatctctgcaaatgtaactggcaaggaacatcagttctgatatgtgaatatacacgcgatcctagtgcaattctatgagtagcttcctctgttgttttggtccaaactccaaaggaaactcttgtttccttcggcatctgtttctcgcatgacaaggcggcggtgaccgcggagagagggacacgcagcggatggggtggtggcacgtaagaccaacggctacgtacgtcgtccttagccgtttcgttagcttgtccttacatgtgctgtgctacagttgagttgatctgatctgaggttgggtgtaccggagcagtacacgtgctgtcgtatgcaggctcttgcctgtatctaaacaggtgaaaccaatggaaggaagattccagctactccctttgtaccgttggagagaggctccagtgacagtggagacccggccccttcagttgccacttgccagacgagggccccgcgtcctcgacccaaacgtgcccgtaggagtaaccggcggtgcggtttgtcaaatttcatccggatttaatttttcaaaatgaagagaaaattcagaatataatcctgtaagtagtacttaaattgtaatactatttggtgaagaattcttttgtacaaaagagaaagttaacatagccaaactggtaatgacttaaaatgacaaaagaataaatgggattcttaattcaattgttgaatgcaaaaaaaacatagcaaaggtcatgccgaattttcctatattacatcaataggtcagttctacatgttctaaatgtctcctatatatattcttataattttcgccctaaattttctacgtactgcttttttttttttaaaaaaaaaataaaccaaactgctctggaccataaggtaaacgttccaaaacagtgaaaccaccgccggcttaaaaatattgaattccaattttttgaacgctaatttcacggggttatttgcgctgtattcatgataccatgggaagctagtgacagaaggccctattcagtggatgcacatcctctacagtactgctgctgcaatagcagtggctgacatgtggacccggacccccacattagcgtctgctactgcatcagcagtacggcagacaatccctactgtgattccgttaatctctctaacaagagaattaagggggatttagaacgaattaattccacatctattgtagcgtggagatattccaatcaatccctctaaactaacaaacagccaaacggtatggtaacctggccggtacgcgtgcaaccaaggcgatttcaagccacacgctagctgcgttcataacaggataagatagctcaaggtcaggcgaacagaaatagagagaacataactacctgaacctccctttcatgtaagctcagtcttcagaacaaaatcatggctactttatgccactctgctcataccagaacattcggaaagattggcaggagaaatgcagcaaaggtcctctgctcaacgcagatgccgccatctcagagcacaatcaaggtactgtgggttatgacattatgaatgttcttctctaatagcactgcaacttcctctgaaggcaaaatctggtggtatattgaaaaggttgttatcattggggcgacaaaagagattggaagaacggcaatagcggcagtaagtaaagcaaggggaatggagcttgcaggggccatagattctcagtgtataggcctagatgcaggagaggtattcaccattcactcaatgcgccatttcccttgtaattaggctgtctccctgctgcaatagctgcttgttctttgtctcttacagtttataaatgccggcattgttcttctagataagtggcatggaagaagccctggaaattccggtgctcaatgatctcacaatggttctgggctcaattgcacaagtattggcctcttcattgtactataaaatgcttatatccacttgtacagttgtactgttatacacttcacgggtttgctatttgaaacttatgttctttcagaccagagcaactggagtggtggttgattttagtgaaccttcaactgtttatgataatgtcaaacaggtaagcaatccacctacaagatggggaaaaaagtaagttacattgtaaagtgagattgtgaaataccggactatacaaagtacgcaccaatgtgatccattcaacgggaagcatcatggcaatataactgaatcttgtccaaagtataaccttattaatctagaaagttacattattatcgattcatgagtatatatgagccaaagaattatttgttttatatgagccaaagaattatttgcttcataaccaaataacagaaaaatgtaacagttcacatagaatgagctatccagtaccagtgaccaggaccacaggagtgcactctaattcaataagcacactgcccaacactgataaagaagtataatgccattcagattctgtacaatcctctgaaatctaattctgtacatggttcataaacaggcagcggcatttggtttaaacagtgtggtgtacgttccaaaaattgagttagatacagtaactgagctgtcagcattctgcgagaaggcaagcatggtaacactacatatcattattgcatttatcatatatgtaccgctttaacaacattggttattatcagggttgcatttatcatatatcttgtgctgatttcattatcagggttgcttggtcacaccaacattatcaattggctcagtgctcctacagcaagctgctatccaggcctcgttccactacaacaacgtcgagatagtggaatcaagacctaacccatcggtaataggcttttccatgtaactcttaattcaccatataaatatgccttctaaaaccaccagatacagaacatcatgtgcaataaacattgtatattctaacaatcaatcaaatgccaaaggaaaaggcacaacatcatctatcagcattagaagaactcttgtcaatacttagttacatactagacaagtgctcaggtgtgcaaaggctgatagactaatgtttgaaattgacaggatttgccatcgcaagatgcaatacagattgcaaataatataacagatcttggtcagatatacaacagggaagatatggactccgataatccagtaagtgtgagaaaaatattttgcattgctatttatctaatgatacagaaacgggcattgcaatctgttcagttcattctaaaacagtgaaagtacaaactggaatcagttttcacctctataacagcttacagctgcacaatattgtttcacaaaactaatggacaaatgttttggaaaaggcaaggggtcagatacttggagaagatggggtgcgtgtccacagtatggttctaccaggccttgcttccagtacatcgatccatttctcgggccctggagaggtattaataatatttttgcttgaaatgtcgctgaattgaccacctatttttaactattgaattgaccaatcaccaacatatccagatttacaccttaagacatgatgtgacaaatgttcaatgcctaatgccaggattaattctggcaatacggaaggtgatacgcttgaaggtaactggcgccaaactttctgttgtgcagatgatataatgcattttcactgaagaaaaattctatcttttgcagaacttgatttatggtctggagaagttcttgtaggattttattagaatgctggtaggaattttcatcccacatatcaagagaaatacaagctatggatattcatggtaaggataatgcaaaacagtaagaaagccagcaggtattacaagactatgggacaagaaagatgcgaagaatggctccaccaaacatgactgaatttttttatgcagatgttacccaagatacacaatcttgctgcaagttcaaggtggaaaccaaacacatgtcagcaatattcgggaaagcaaccatggtgataaccattgtcaccaaaattgagccaattaataaatgagtggttgaattgactcaaggcctcaagcatatgagttccatcacagaacataagggaactctagctgtaaggaactatgtttggtcctgggtgatgctgacgcaaaatgtttataacaatgcatggtgcgttgatagggaactgttttgatcccttgagatgaagtgatgtccccttgtttgtaaaacccatcaaaatagttatgagtaacctttaaaccaatttgcgccattcatacagcatacatataccactccacgaaatcttaggtctaaactcaactcgcgcattaagacatataaaaaagaagacaaattcagcgtatgaataatagtggtactattgttctttttcccctcaatgtataggtcgaatttaaacatgatttttggtggagagatagatgttactaaactctacattgttaaaaaaaaaaactagatgttacccgtatatcacatatgcacaaaggcaatcatcaacaaggtgacgcagtctctagtctgtacaggagagttgcttaccgtagccaaaatgtgatgactgatcaaccggggtcaccgtcttcactcttcagttcttcacgaagcaatcgcgaccgccaagaaaccgaaattctttaagatagaaaaccaaagaccgatggttcggtctaaaccatcggtctgattgtggcgaccgatctggcgtggaggtagccggtaggcagcggcgcggcggctggattgcagtgcagaaggcggcggcgcggcggagatgcgggagtaggacgaggtaccgcgcggggagccgcttgccgtcgcggtggactcacggaggacgccggagtggtcggagcgaaaaggcggcgctgattcctgctgctactagacgccgacgggcgacggcaagcacgaagggaagttagcggcggtggaggtcggactcctccgggaagcagtccacggagggttttgctggccgctgccgacgttgagctcgacgccatggctgcggcctttcgagccttcgaggaatagtagatttgggcccaataattgagtgatttggcccagtccaggaactagtaagtactctgcagagtacgcagaaaaatagtctccacgttggtgaactcgttgcttgatgggaacgcatgcaaaggctctgatcgacgctgatctcaaatatttcgaccaccattgcccgtattcctcggtgtccatctttgacatctgctgcaccctaattggtatctactcctcatctaatcgaatcgcaactcgtcatgtataaattaactccacacctcctcctttatcttcaaatctcaagattactctgccaaaatggcgcctggtcataggcacggctcagtgccaccagtggtgttactcctactagtagccactgtgcttggctccctctgccttagcctcaccgcttcacccgaaggtacatgagaaatcacgtacgtgttgctcatgtgttgtgttttttttatagaactttgacaatgtggtcgtgcgtgtgtcgtggcagcgcaaaaagggtacaattttcggttcgcgaggcacgcgcgggacgcgccgctggtgtcatattacaactacatcgtcgtcggcggcggcacggccgggtgcccgctggcggcgacgctgtcggagcggtcgcgcgtgctcctcctggagcgcggcggcctcccctacggcaaccgcaacgtgtccagcgagtaccacttcgccgacgcgctggccgacacgtcgccgaggtccccggcccagcggttcgtctccgaggacggcgtcgtgaacgcccgggcgcgcgtgctcggcggcggcagctgcctcaacgccggcttctacacccgcgccagcagcggctacgtgcgcgccgccggctgggacccccgcctcgtcaacgcgtcgtaccggtgggtggagcgcgagctggtgttccgccccgacgtgccgcggtggcagtgcgcgctgcgcgagggcctcctccaggccggcgtcacgccggacaacggctacacgctcgaacacgtccagggcaccaagatcggcggcaccatcttcgaccgcgccggccgccgccacaccgccgccgacttcctccggcgagcccacccgaggcggctcaccgtgttcctccgcgccaccgtgtcgcagatcctcttccgacgcaccggcacgtaatcgtcaacttgcatggtttgcgcaaccattttttagctctaaaactgacacgacaagtgtttgcagagggcacggcgacgccggtggcgtacggggtggtgttcacggacccggcgggcgtgcggcaccacgtgtacctgcgtggcggcgccaagagcgaggtgatcgtgacggcggggacgctggggagcccgcagctgctgatgctgagcggcgtcgggccgcgcggggagctggagaagcacggcatcctccccgtgctggaccagcccagggtcgggcagggcgtggcggacaaccccatgaactcggtgttcgtcccctccccggtgcccgtcgcgctctccctcgtccagatcgtcggcgtctcccgcttcggcaccttcatcgagggcgtcagcggctcgcagttcggcatcccgctccacggccgcgccgcctcccgccgcgcccgcagcttcggcatgttctcccccatggtacgttaggctagctagctgcatgcagcgtgcaaactaattaatggatgtttcattacgaggcagacggggcagctggggacggtgccgccgaaggagcggacgccggaggcgatgcggcgggcggcggaggcgatgcggcggctggacaggcgcgcgttccgcggcgggttcatcctggagaagatcctggggcccatgtcgacggggcacgtcgcgctccgatcagccgaccccgacgcgaacccggccgtgacgttcaactacttccgggacccgcgcgacgtggagcggtgcgtgcgcggcatcgagacgatcgagcgggtggtgcggtcgcgggccttcgcgcggttcacctacgccaacgtcaccgccatggaggccgccgtgcttggccgccgcgccggccacctccccgtcaacctgctgcctcgccgcgccaccgacacgcggccgctgcagcagtattgcagggagacggtgatgaccatctggcactaccacggcggctgccatgtcggcgccgtcgtggaccaggactaccgggtgctcggcgtacgtggcctccgcgtcgtcgacagctcaaccttcaagtactcgcccggcaccaacccgcaggccaccgtcatgatgctcggcaggtaatttaacccaagtgcatgccttcattttcagctaaattttgtttggtttggcgcttgcttggatgaaattcagtcgaacatgcattgcgcacacaggtatatggggctgaagattcagaaggagaggtggacgaggaacgacgagacacattagttagctcttctgatcacttctgcttgatcttattcacggtggcgtacgataatttcttcgtgtagttggtagctttgagagacccagatatttctttcttctttgatagagattgataatagtctgattgtggactaggatctgatcctgtgatccatatgtacttgcagtctagcttgcatgttttctgcattgtttgatagcgttatttagacatgaccacacatccaacattcaattagtattttggtggatatgtgtttgcaactctgcgtcaaatattttcgggattgcctatccatttgtcgggtaatttctagcaaaaaaatcacccaaattttttctacccttagatttacatccaacgagctaaaaaagaaaataacaaatatatatttacttacacggtatttttatcaaaattacagtgtacttacatatcatatcaactgaatttataaatgtaattttagctatataggactgtaattttatattttaaagaaaataacaaatacatatttacttacacaatattttttatcaaaattacagtgcacttacatgtcatatcgacggaatttacaaatgtaattttagttatataggactgtaattttatattttaattaaaataacaaatactcctttcgtattttaatgtgcgatgccgttgactttttgacaaacgtttgacctttcgtcttattcaaaaaaatttatgtagttataatttattttattatgacttgatttatcattaaatgttctttaagcatgacataagtatttttatatttgcataaaatttttgaataagacgagtgatcaaacgttggttaaaaagtcaacggcgtcatacattaaaatatggagggagtacatatttacttacacatcatttttattaaaattacagtgcacttacatgttatgtcaactaaatttacatatctaattttagttaaataggaccgtaattttagttagagaggagaacgtacgagaaatgaagagtgattccgggcggagtttgcgagagagagaagaaagaaacaggcaggcgtgcaaatagaaaatccgtaccgtgaaaaaaaaaaaggggtcggagcatcgaaccacgaccttatcaacatgtgcacaaatcttgttggcttggtgcacacatcgtgtggccgaaatatccgtgaaatcgctggaaacaaatcacccgacagatttctagcgaaatcgaatattttcaggtaggaatccatgtattgaactgtacatctataagcttcagaggtacacttgcccaggtgggcccattcatttatgcgacagcagcaacggcccatgggccttagaaatcacctaatctgcacaaaatgaaatgaaagagcactttggaccttttttttttaccaaagtttcactaggccttgtttaggtcccaaaatctttttttccaaaaacattacatcgaaactttggatgtatacatgcagcattaaatatagataaaaacaaaaactaattgcacaatttgcatgaaaatcgcgagacgaatcttttgagcctaattagtccatgattagccataagtgctatagtaacccacatgtgctaatgacggcttaattaggctcaaaagattcgtctcgcggtttccaggcgagttatgaaattagttttttttattcgtgtccgaaaaaacccctgtcgacatccagttaaacattcgatgtgacacccaaaattttcttttcacgaactaaacaaggcgtatatatcactattatccagtattttcactttggaatatatattttcatcttactaataaaatgctcattactttaccatggataaaatgtacgtgcttatttaaatatatgttattcacttaatttaaataaacattagactattatatgatataaaaaatgtcatgaactaatttataggataagcaaaattagtggtggtgagctagtggccaccaccactattgtattttatagtaaagtatagatcgtaatttggactacccaagctacttcttcggcacatcagcaaagctcaaacacattggcgaacttccctacgctgccaaatgccaatatgccatacctttgtcagagtagagattagatatggctaaaagaatagggctgggttagtttaaagtagaacaaaacaaaagctgattagtccaaagtaaatatattaaataaaaagtgatcaaaagtgaaactatagcgataattcaaactacaattcactggaaatgcaacgagtgtagaaaacacaaggaagctttgataagctccttgaacttctccgacggcgagtcggcaccgaataatcacaaatgtaggcgagtaaattatgggcttgtttggtttggagccaatttttatccaaccaaaatcttggtagtgccaaaacattggtaaattttggcactaccaaattaagtagtattcaacttaaactattgtgggtagaatttggtagcaaaccaaatatatacttgctactatttaagttaccaaaattttggtagggtaataaattagaaccaaaccaaacaggccctatacaactgctatacataagatcagacaaagctttcaatctcccatgattcgtcgtggtgtggatggatcaatgatcaatcgatcccgattcccaatctcaagctcccaacaagaactgaattgagttccggcgcgcgttcacgtcggcatacacgtatatactcgacccactcagtgtggcaactgccaaccaactccattgtatcgatctcctctcccatcccatggccctgcgcctcagcctgcagtttcctcctcgtagctttagcacaagcagacgagcaccacctactacctggcacctacccaccccgatccttaacactccttgtgaaaaatgctgctacagaccgcgaagaaaatagtactactagtactatgcatctccccttgtttgtcgtcattgattgtggtcaatcgtatgggtcgtgatatgcagtttgaaattagtactacctccgtcccaaaataagtgcagccataaatatccgtatttagcgctttgaccatccgtcttatttgaaaaatctatgaaaaatattaaaaaaattagttacacataaagtactattcatattttatcatctaataacaataaaaatactaatcataatcttttttcaaataagacgaacggtcaaacgttgaacatgaatagtgctaaaactgcacttattttgggacggagggagtactagaactgttgctgagaaggaggaggaaaggaagtactgtgagcgtgtggaaccccgcatgaatgaagatgctacaatctacaccacccgtgagggaaggcgaacatttgagacttgagagcagagcatagtgtgccgttgtcgtagcgagactccacgaaatcgtgaaatcgtcgattccaattccgcctttctaatcgaaatcaatttaatcgtttggcccacggctgataagaaactttttatgttggtgtttcgtaatctaaagactaatattaaaaactaaacgtgattaaataaacttcaaagtctaaaattttactactaggccgagtttagttctaaaatttttattcaaacttctaacttttccatcacatcaaaacttttctacacacacaaacttctaacttttccgtcacatcgttcaaatttcaaccaaacttgtaattttagcgtgaactaaatacacactagctacgacgcaactgaatcttagggcctgtttagcacagcttcagctccagctccaccccttctgtaggtggagctcagctcccatcggatggcccaataagccaaagaataagccaaattttgaattttcaaacttaattttgagattgatttcgagatattttcaacatagttttttttcaacattggcttttaagttacaaagaacacatatataaaagttttatctataaatttatttttattccctaataaaccgttttggtttattagaaaaaaagccaaccgatggggctttcacaaaataaactagagttatggagctgggtttagcagctacacaacttcactcctaacccaacttctaaagctaaatttagtaccaaacagacccatagctgcaagacgggggatccgattccagtatagaatcatgagacagaatacttgtactactaccactcaagggtctttaccgtgacgccatcagtctgttcatctgcagggtgcttgcttgcatggcagcatggagtcccagactcatcatccagctccggccggtcgacgcaggggaagatggcgccatagatccagattctgtccacgtgttaggatccgagggcaaccagcgaatcgaaggcgataccaccgagggatgtcagctgtcacctcagtaattaccaaataagaacaggtagactattagtcagctacaaatatattttaattttaatgagataaaagataagagaaaagcgcagcagaatacatatctgtagccagctgcagcatgaactccaaaacgtaatgtgtgtatgacaggtgggactatatattaatagtacagtaaataactatggtatgaattggctattagattgactatagacactaaagttaagaaaagaataaccacacacaaaaaaaaaacacaccgtgataaataaacggactgaaggaggaggcggcatgcacagtaggaggcgtatataaaaccgaccggtgcgagaggagaacccgcatcacatccacctcctcctcgctcgatccgctcctgtaggtactcgtactactccaattctttctctcgcctacgccttcctcccaatcttgttgtttcggcggcggcggcggcggcggcggtgagggagatggcggcggagaggaaggacgtgggcattctcgccatggacatctacttcccgcccacctgcgtgctccaggtcagccaccaatcgatctcatctcccgattcttccctactgatcaacctcgtcgatcgtatcatatttctcccactacaatccgtgtttttcttttacaaatttagtcccatgttttcaacttttcataacttgcaaacacgagtgcaatcaaaacaagatttggaggaagaggaatccttcaaatatttttagaagaaaacatgagcgtattgagaattgaacacattatctcgagttaaaaccacacacctcttatcactcaaacagagtgcaatcgcaatctagtcagatcttttgcctttggataaccctttccgttttctcgtttgttcgggagatcgagtaaaaaaacacacacaccctttgcgtgactttctctgcgtaactgtggtggaatcacggttggtgagaggtttactttactaccggtttccggtgaagattttccagctttccacccccttcttcgccagcatcgcagcggggagaaccagccacgtgcgcctgggccacctccgcgcattcggtgaactggagcagagagcaaagaagagttcagagttgcgattccaagtttactccatggctggactatccgtgaaaaaaaaaaagaaagaagcaactaaaaaataatttaccagtaaaacttttataactttggtctcagtggtttaaaagccaatgctaaaatatcaaatataaaccgcgatggaaaaaaatatatatcaaaatcaactttaaaattaagtcagcaaatatatgattgctgtagtgagtactaatcgtgctactcgttgtagcttacgttaccatttaggagtatagtacaggggagattaaagctgccgttttcagggaggcgtgattaattgctgaccgcttacgtgtggaatgtttgcacctgcttctgcttgagttgagagaaattaattaaaatgctgttccgcgggagaatttgctgtggaagatgccaattgaaacagcttggcacagaatcagtagggccttgactcgtttaagattgtgttgacaatcgatcaaatcactagaactagatggtgatggcttccaagacatggcggcttactatgcacatgtgtacattgaattgggtgctgataaaatggtttatgttcttctgccgacgaccgggatatgtcgggaccttttctttatggtagtagttctgtcagtgatataacttgtacagagtggttgtgtgttggcaatatctcaatgctgtacatcatgtcgatattaataatctttatttcgtgtttcacctagtattagactgcaaatgcatgtgatgtttgctacaggacgagctggagaatcatgatggcgtgagcaaagggaagtacaccattgggcttggacaggatagcatggccttttgcactgaagtggaagatgttatttccatgaggtatgcctgttcctatgtagaaaagcaccattggtgtggtagagttgtgtgtcctaccaggctcaaatcctattcctatgcattttcagagaacatgtgcaacatagtatttgtgattctgaagacaaatgtgaccctcaagtgtcctatccgtgccctataaagtcaaacagtgataaactatgctagatccttagccaaggattttatgttgaaattttaatttcaggaataaagacattaatctccattattcatttatcccttttttatgcatttaattgatcgagagtttaacgcagcttgacagtagtgaagtcactcctggaaaactataagattgatccaaaatgtattggacgtttggaagttggcagtgaaacagtaatagacaagagcaagtctataaaaacatggctgatgcaaatatttgaggtttggacctttcagcagaacataggagtacatattatggtttatgtgctttcataaggcttatgacaactttgtttaaatgcaggaatgcggtaatactgacattgaaggagttgactcctcaaatgcatgctacggtggaacagctgctttatttaattgtgttaattgggtcgagagcaactcatgggatggacgttatgggcttgttgtttgcacagacagcgcggtatgtacaactccagtgttaattgggaatacttttcctttcatgtactcaatttcgtactgtacagattaccagtgtacaactccatttcttttcctgggttactgatgatggctatatgagtacatgtattcatatatatcacgtccttgtttttctcattttttttcttagtttctgttattgaccaccaccacaaatccacaagtgtttttccttaagtactgaaggcaagcataatataggtttgctactatggttctcatgcttacattttgcatccaatattaattctatagctgacatttgtctctttaggtttacgctgaaggtccggctcgtccaaccggtggtgcagctgctattgcaatgttgattggaccaaatgctccagtttctttcgaaagcaagtatagaggatctcatatggcacatgtctatgacttttacaagcctgatcttgctagtgaatacccggtctgcctctggcccacacaattcttacacctcaaacccaagttcggattagcacatagagaactagcttgaaataaactggaattgatttatttatggcatctgcaatttgttcaggtggtcgatggaaagctatcacagacatgctatctcatggcattagattcctgctacaatgtcttctgcaaaaagtaagctgtattccatattgctttaacacattagtcaagctgagcctgttgattgaatcagaacccactggttttcatctttcaggtatgaaaagcttgagggaaagcaattttctattcatgatgcagactattttgtatttcactccccatacaacaaggtaccataaaaatctcatatcatgtaccttagtagcatcttggtggtatagtggattacagccacaattgtgcagacacttgatattcacacttatttaaggcatcttattcactgaaagaaatagggcatcttatttaaaaaacttttcaaataaatagaactcgaggttcccgacatgagtagtgagtagaatatatgcatatttagactgattcttgattgcatactgtcacatgacatggatatgctgatcttaccagtctgcacttcgatcttggttaggagtcgcatgctcgcataacttaccttgcccttttgatatgttgatgtaattttcagaacttatttttttcctttttcattgttttctgcagcttgtgcagaagagctttgcacgcctatactacaacgattttctgagaaaatgcaggttggtcggtcatgcttagcatattaggatataggaagacagttgactggagtaatattgttcagtttttagtagttaactagaactaactataacgattttttatgcctgttaattagcacggtggaagatggatcaagagaaaaactggagccttattcaggtttgtcatccgaggaaagctaccagagtagagaacttgaaaaggtgcgaatatttctgcttggtcataccatctggttctggacttttaataagctgcgtggttctgatactaactttcaatatgcaggcttctcagcaagttgcgaagcacctctatgattcaaaggttcaaccaattacattaatcccgaaacaagtcgggaatatgtacacagcgtctctatatgctgctttggcatcagtgatgcataacaaaaatgaaactctggtaaaaaaggaaaagaacacttagccttgtcttcattatattttcatgtgataagattaccacttctcaccctccccttttgacatgtccaggcaggccaaaggattgtcatgttctcatacggcagtggcttgacatcaacaatgttctctttcaagatcaatgaaggccagcatccattcatcctatcaaacattgcaggcatactggatgtctccaagaaactggagtccaggcatgtggtaagtgcagctgctgaccactgcttcatcttgttgactgaaaacctgaaactagtagcttgacatgaacggatgaacctgaattcctgatcaacaaatgctttgggccgcaggttgcgccggagaagttcgtggcggcgctgaagctgatggagcaccggtacggcgccaaggatttcacgacgagccaggacacgagcctgctcgctccaggcacctactacctcacccacgtcgactccatgtacaggaggttctacgccgtcaaaggtcaagccgtcaccgaagtgtccaatggccattgaaaaaattgtgttgtgatgtgtggttcattcaacctgaagctgcaataagccaacggcatagagggttcagggcgtgggtgtaccaagttttctgatgaaagcttgtaaagggtgctaggttagagctgttggattagttggttcgctattcgctagtaaggcttacttggtgaaatggtatctccacttcgttaatgttcttcagtggaacacacggtagcgagctgtaagaattcttaataatctgccgtcccgttcttttctctcccacaagagtaggatgaagattaagattttcgtggcacgcttttcaaactgctaaacagtgcgttttatgcgaaaactttttatatgaaagttgttctaaaatatcatattaatctatttttcaagtttgtaataattaaaactcaatcaatcatacgttaatatcacatcgttttgtgtaaaaaacttaatcttcatcttcaggagaaaaagaacacaccggatcatgtcatgttgattctaagctctatgtttccagtatatcgcctacagatccctttacaaaatattagaactaaaaaaaattggtgcgacgatataagcatttctgatgcattgattttgaaatcgagctatctattttatgtcaaatatttcagttgaccaccaacaaaaaaacattaatttgtacatggtgaaaaaaacataatcccatttgaaatgtttaagaataatgtgaaacacagtgaaatacatgttgaaacatttcgctatcacgcgtgcaacattaaattttaacaattaaaacacatgtttttctttcaccggaatgcaatcacataacatcttgttataaagatttacaacggttttgctatcatgcaacattaaaatttaacggttgaaacacatgatttcctttcattcgaatataatcacatgacatcttgttatgaagatttaattgtaacgaataaaacagtgtattccacgttacaaacctgccgtcgtattagtctctcccttttttccttgttttttttggtcttttctctcttcccttggcataagctggtctgggctggttgcgttgtgtaaacaaacactcttttcttctaatatattgatgtgcaatttttttgcgcgttcgcgaaaaaaaaagaatacaacgatgtactcgaattgtaaaccggattaataatttaagagaagaaaataatttaaagcttaacaatggaatatggttaatttacacggaagaagagaaaaggggtgggagagaaatactagcaacatgcatatgagaacgaagaatatgcggaggaagtagctagtgcgcccgtttattttttggctagatcggacactcgacctgaaccattctgaagagaaatctaaacaatttataattcgaaatttaaccatcgagagaatggtaagaaattccttaagaaaattactattgctgaacagcctagaatatttaaccatcgagtactactgacagaaatagccaaaatggccggcaagtctcagccctaatatgctgatctgtgccgtcgattgcttgatcgaacggtcaggatcatgactgcgttgatgaaaaggggatatgatacgccgccgtggcccgaggccgccgctgcacgcctgcacggtatccccattccataaccattccagcaacagctgtctccttctctctccgccgccggcgaaaccgcaacggcgcagaggagaaaatgtgggaagccgaggagatcgaggacgaggaaactctagaggcgcttctagaagcttcccgaagcgcccagggccgggccgcgctctccgacgccctcgccgacaccctccacctcctgccggcctccacccaccgcctcctgctcctccgcctccgcctcctccgcaacctcctcgccggcgacgacctcaaccagggcaccttcgtcctcctctccggccccgccgcggtcgtctcctccgccctctcctccccctccgactcccccgacgtcgcgcgcgcgggcctccaggcgctgggcaacgccgcgctcgccggggagcaccaccgcgccgccgtctgggatgcgctcttccctggctcgctgctggagctcgcgcgggtcagggagaagggagtcctcgacccactgtgcatggtgatcgacacctgctgctccggcgaaggcggccgcgggaggctcgaggagctctgccacgaggagttagggctgcccatacttgtggaaatcgtcactactgcctggcaaggtgcgtgcgccgcaattagttgatgccttttttttttattcagtaaattcatctggtagatgtcctgcaagctttacacaggtcacacttgctattgtatgatcgtgggagcacgaattgtttagctgtttgtttctgtgaaactaatgtaaatcaacatgagtaggatgtgtgtatgtacactgtaaatcacatcataaggagtaagtaagatgtgcattctgtagacttcagcaatagaaaagtttgcgaactgttagttgttcattagtatgacaggaagtggtaatgtgctggaaaagtttggggaagtaacttgttcattagtatggacaggaattggtaatgtaatatctgggcctttgggtccaattgggtatcagatgctctcctgctagtatgttgagtgtggatagaggaaacggaatttagtaacttaagagggtggtttgtgatatggcattgttgaaatttttagattgacattttggcagataatgcctgttcacctacttcatgtgtggaaatatatcgccactgtgttgttttaagtaaaaggagttcggaccacactatcacaggtttcatatgttacattgaagtaaaaaaatatatatcagtgattggagctgtgatcatgtatatcttcacatagttgcctgcatcatgtctaaagtgctggatctgtgtttcctcacatattgagggcaggatttcacgtaactataacttgagaaataatacagtcatattttttttctttattatgtaactttacttcatagggactccttaggctgttgttgaagttcacattttgctctcaggttgttttatttgtttacatttttaatttatggttactttgatatgagtctaatccgaggtataaaatgcagtggggcatgatgaagaatggttagaatggcttctcttcaaaatctgtgttgaggagcaaaagtttgaaacattgtttgtagctttatgctcacgcaatgatgctgagcacagtgatggtgatgaatgcaaaactgagtttaatgctaagcatgcatatcttttgggtaaattgtcaaaatgtttggctaaccgacctaaagaagtcagtgtatcgatcagttttgcacttgatattttcaatgcacagaagcatgctgctgagattgtggattttacttgccgagttaactctcctcttccaactggtcaccctgcaattgatgtacttggatattcattggtgctcttgaaggatatatgtgcttgggaatcccctccgtcagacacacaggctcctgttgactcactgatgcagactggtcttgtaaagcatcttctaacgtacttacgtgagctagaacccccaagtatgatcagaaaatctatggcaaggggacaaggagatcatcaaccagccttaggaactgcaaaagtctgcccatacattggttacaggagagatgtagtcgctgtgattgctaattgcttgcatagaagcaaaaaagtgcaggatgaggtgaggcacctggatgggattattttactcttgcagcagtgtgttgttgatgaagaaaacccatacttgagggagtggggtctttttgctgtgaagaacttgcttgaaggaaatgaggaaaaccagaaggaggtatctggacttaagatgcaagaagctgttataactccagagattgctgacataggtctaagagtggagatagacaaggaaacaggacatccgaaactggttaataactgatgatgtaagtatctcggaccagaagttaaacttaattacatgtatacatcaactgtatctgcattttcttgtcatcttgtaatcctatgatggtttttgatatatggttggtcccacatctagttttgtagtatttcaaatctcacttatagttctgttatttaaatttgtgcatatattatcttgtgattggcaactatgtgcttgattcataactgagatgtatgttcaaattttcatatgaagaaatttggcttgcatgcaaacattttagtatcttctggcttctaaagttgctgaaagactggtgtttgtgtaaccttggtatgtcaaatgttgcattgcgttgcctgacagcatattttgttgtgcagactttccattttgatccttcatgtttgaggtgaaaagaaaagggagatcagactcacgtaccgacgttcctctcattaacggaagcaaactaatattgccgctgccttctgcacccccgggaagataggtgttgctttttttcattaatgttagtcatgttaatattgatggcgagcatttgaaccaccgggattcagatactttcttggagaaatgaatgctaatggttttttacgttgcatcaaaacagtgatgtgatgagatgtttctagatccactcttatcataggcgtccgttttttaatcctcggcgtgtgctgttatttggtggctaatatgttgatcctggtattctttgatagcctttgggtatttagctttcactgtggctgtcagatttccactgtaatcgctttaagcaaagcatgattcccatgtttggctttcagccgtcctgtttcttatacgtcggcggagctgcagcatatcacagccaatgcagtaacagaagataaaacacaaatttgatgtcatcaccttccaagttcatgttggatcagttacatgctttagtacaaaggtttgtaaaatggaaaagttagccgttcgtctatagcatgctcaggtctatagtacttcaacacaagcatggagaattctccagctaagcaaatacaacatcagaacgaagcacatacttgatattctttttcacaacccgtgcttcatgcagcatgcatttggcaccatgaagatggagtagagccagtccttgcactggagcaacctacaacagaagtaacctcaggttaggggttaggaccagcttcgacggtaatggcagcattataaattgtgatgcagggtagactcatgccagcataataaaggtgatatcatcaaccccatatggatcaccaaacttcaagtgggcaatctcttttcgtcagagcaacgtagtttttcgacaagggtgtcattgatggaattgccaatggagtagatcttgctagtttttgtatagcataagaaattaaatatgtagagggagggtgaatttcgtcttatttattctttatgtatgatcctttcagtttcatgatcatatatgcatctcaacctctttctgacttagctagaaagaacatgtgtgcacattaatttcaaggttaacttccagatgaatgacagactaaacatacaatatatagcttgataccagacccaattttccatagaaccaaacaaaaaacatatgaaatggtctagcaaacagttgatcttataaaacatattgcaatttcagaatcagaaaatacctcagcgacaactcctccacgatgatcataaaaaacagtctcccctccaacaagagcttgccctgatgattcctttgcacttcctttgccagagaggtatattagcaaagtatacaatgttcttgaaccatctccaaggtcgacactctcatcaatatgcctaccgaatcgctgaccttcagtgtacctatgaggatgagcaacaagcagcaatcaagaacagtggcaatttgtccaacagtgtggtgctagtgcatcatctttgttcaacttttgatagcacacatacctgtagaacctgatatttggattcaagctggttgctactttgccagagatgctgatgtcctcaaatattttgtttatcccagattcccaaatggtctgagcaagcaaaggatctgtcacagatatccggtcattatctctataagcttcacccttcaggggtccgaggctgccctggtgcgtgaagccaatattctcagcaatgtcgacaaaggccttcgcctcagcggaagtgaagaagtttggcacctatttcagtttcaagtaaggcaattgtccataaataatagggaaacaattatcaactctgtaatgaaccctgttatgctttcttagtaaagctgggcgcactgcccctgatctaaaaacaattatcaactcagccaaaatattgctatgccaactgaacggtctcttagcattttctccttgtgcatcaaatagcatttcatcctagcatacgcttcatcactttgtattcaggaaatctatttgattactgcatttagaatcaaccgcacaacacaagtagagccaacccagatgattccctaacactcaaatcaaaattggcgctcctggtggttcgcggaaatcaagcatctagtctctaatcgccttctagaagcactaattcgagcagcagtatactagatgcagacatcagaattcagacatggttggggtcaaaaggggaaggtaggcttacggtgaggaggtgggtgcccttgaggcgattgacctggagatccttcttcggcttgaccggtggccacctcccgccgcctccgccgccggaagcgccgcccttcttccccttgttggccgccgaggatttgttccgacgctgctgctgcggcggcggcgcggcgtcccctcccgccgtctccatggctgcagccctcttccgcttcggtggcatcaagctgtgcagcgacttggctacgcggctggtaatcccctcatcaccgttggattcagaagattctcccttcctgacattgaatctggaccgtaggagttgattgctgggtcagatttgaccgcaatcttgacaaattgaaccttctataaaacttatttcaataataaaaccgcggcaaaaattattttgagagatagatcgcgacctagacatgaggtataatgtttttagcaccattatatttgacatgaacatattgaccgatgtgagtatgtgacataatttgttagatcaggattaatcgtgtcacgttagataatatatcagcgcaaatgttaataacattgagatgttatatcaacgaggatggcccctaggtcacgatctatttttaaatagcttttagcgtggtgtattgttgaaataagttttgaaaaagagctattttatcaaaatttcggcagatatgatccaggattccaatctggaagggggtgaagttgataatctaacacgtaggaagggctcttatgcaaatagaacttataaatcatgaccgttcaatcaggatcgaacggtgtacgaatcacgagttcgtgtcggcgagcgtccggcctcacgcgacgggagccggtggagctccggcgagcggcggaattgtatgcgggaggcatcgccggcggagaaccctaatccctcacagggttcgatcttcgcggcagcccgggagcggctggagaccgtgcgccgctgcctgagatcgccggcgagaagcggtgtataccctgccgctgctggagaccaagataagaaacaatctcgcggcgaaatctaagaaatctgtgttgatcccaacccaaaatttcacatcctccaaatcgtaacgaagaaaagagaaaaatctgcacatctacaacgaatgcaacgcgtccagggctgctttcacaagaatcccttctcaagaatcgcaaacgaaaacatctttatcctgtttcatatggtgaggttttcttggatgggcaggaacgtgccgcagatgttgccgccgaggtccgggaacgcggcgcatcccggcaggggcttcaccttgccgtcgcgggcgacgctgacggggtacttgacgaggtgccctctcatctcgctcacctcgctggaggcgaactgcctccagttctgctccccgatgtgccgaacctgcctcgtgcactccaggctctctgggcaactgaagctttcctccaccgctccaatgtgctctgcccacagtgacatcctgtacccgtagatcttcgagctcaccaaaaccaatccatcagcgcaactgtgaaatctgtggaattttgggtgatcaagggatcatttacctgtccacgaggagcagaaagcatgtttgcccatgtgtactggggctggtacgctcccatggcgatctcggtgtctctggttccttccatggatctctggttaatgttagccgatccaattatcacgtattcatcatccacgatcatccctttcgagtgcacatacaccatgaacctccggttcttcttagcttgatcctgaatgtacaggtcgcagcaagacaaatctgaactctgaatgtacggatggcatacaatttgagtatgctgcgagagaagcagaagtactgcagtctcacctggggattgttggctgaacttgatcctctgcaagtgctaggactgccgcctgcttcacgattgccaagacagaagaagttcaggtaatcctgtggctcatatgtgttatccagccctacttctttcaatgccttgtgaattacctcatacatcatttgcattgtttttttctacaatgacaacaacaatgacaacaaataagttacattgctatactgagagaagttagctctgtagaatgtagtagcagatagtacacagttgagcagactagaagacaatgctagagagacgctctaacctgccagtaaagtattctctgtgtaggagcaccagtaggattaccttcaggccacattggaattactatgtacgctgaaaacctctcattggcataaatcttgttggcaattttgagagctatttcaatcggtattaagttattagcacctgcagcagaacaaattttaagtcctgaaattaggggcaaccataagtacttgtcgtatttatttacgtcatgataagggtcaagaaattttgaattattctccaacataaagcagcaaattttaaatgaagttactattagagaacgcaattggaacgtgccataaaaggccagaatacattgagttgaacaacaagatttgaagcaaacaaagctcatgcttacctacatctttatgtgaatcccaattaaatgaagaaccaaggaaatactgattttcaatatagatgaagtgttgagctcctcggattgcattcacataagcggtttgtacgctcatatcaattagtacgtttttcccacaaacgagattctgtcaaccaaaggaaaagtctgtgtcaggtaaatacaaagaataaccaaacatagcataattgggtgaaatttatatcttagttaccttactggttgcttctcttggatttttgggaaaacccttgacagaatttgaatcaattgaccggaatatctgcttccaagttaatactgttcagtgctgtttggtcacatactttgtttatctgtagctgtgaaaacctttgaaggatcttacctgaacatcccatcgctctggatcattgtcacttgaatacacttcatcgtcaatgcttgcaatatcaggtatccttccaatccatagcaatgtgtcattatttgcctttgacaattttttaaccccgctgcgcttggatgcctttaaccagcgctcctcaaagtttgtcaagacatcatatgccgctgggccatcaatcttagaatgcaaatcatgccatggttctcttggcccttgggcatcaagtacctgcaaatacaagatgcgtcaattacaggaactattttcatgtgtataaaccacatacagtgatacaggcacatgaacaataggacaaagtaatctcaccgcaaagtttgggttataatagtcgtccttgtgcaatgtctggagagaccgaaaaagaggatgagtaggtgtatcatatcgtccaccgcataaatcaaggcctccaacaaaagcaactattttccttttatggttgccggcatcagcatccagaatcactgttttctgatgatgtgtaaaaatggttccggtctcctggttcaattttcaactgttaacatcattacatggtccacaagaacagctattttgactaaaaagatgttagctggtgacatgtgtctatatgaagcaaattatggcattcagaggagacaaagcttactgaagaaaacaaattgtaaataaacaacctgctgcttaacccagctgtgccttttcccagcagaacgcgggcagagcagtatctgaactgaagaatgcttgaaaaatctacgggtctcctcatcccgtgtgcccatgtaaccttcctatagagaaaactctgacaacaagtcaagctgtatttgcatgaatatattattcacaggttttcagagatcaatgtgtcactccatcaaccccaactaccattagacaaagcaatgaaatttggaccagaagccaaataagtggtgtgaccatcagtttgatacaagaaacaaatagccgaaaattaattttgtgattgcatgttgcattgtgcataccatctggataccaaggacgttccttgacgttggatcgtcccagacgaggagcagcaccctcaccccctcctgcgacttcctcttcagcagatcgcccagcgagacgccggcgccgccgtcccgcacaagctgaatggtgtggaacaccgaccacccggtgatatagatgagcctcctcgcctgcgatatcgcgtcgtagacatcgtgccagcattggccttgccggtagagcgcgccattgcccagcctgatctccggcagcgagccctccggcacatgcgcgtcctggtacagcgtcacccggccgccgcggcgcagcgggaagtaggtgttggggacgccggcgaagtccgggcccggggtgacgccgtggtggtacatggttagcctcgccacggggatgtactgcaccgacagccgcagcacggcgccgggggcgcacggcttgccggcggcgggatcgaggaccgggtagacgccctcgacgtgctccccggcctcgagctgctcggcggggacgacgacctcgccgatgagctcggcgccgaagacgtcgctgtccttgacgaggaagtggacggcgggcgcctcgtgcgcgacggggatgaggaagtgctgcgcccacacggggttctcgtcgtcgttgacgacgtaggtgcgcgcgacggtggcggacgcgagctgcacagtgacgtaggggtcgctggtcatggcgccgttggccgccttcttcttcttcttcgtcccgaggatgtcgacgacggtcttggagacgatgtccatgtttgggaggttccgcgcctcgtggatccatatgtcaaggctgccgtggagcatcgccgaccgccgcgacgccgacgacgagccccagacgccgtgcccgtgcggccacaccacatccatcccgctccaattcgacgatttcgcgtcaactgttcgtgctgttttaccttgatcgatcgatgatctcgttgcatgtgcctcgtgtacgtcgcatgtcctcctctcctcccggttgatcgctgcttcccctgaaatggaggggagaatgaatgggccgtgggcccatggacaaatgccgtctgatctgtatgtactctccagggcccacttgccgtattgcattgcaccgcgacaagtttgtaatgctgtgccagatcagccgtacgatcaggtgtaagctctgaatcgggacatcacttgcgcgtgcgcttgttgggctcaaaaaatgatacctggggcccacaatattgcgccacgtcagcggctcagggttggcccatataatcacatgggcctgactgccccgtgtgcttggaaaggacgctactcaaaaaatatccaacacaaacacagtgtgtaccccctggaccatatatatcgtcacattcaccgctggcatccgtgtgcatttgatttgattttcatctcttttggtcctctccctgacgccatgggggtgcctttttgcaggtcagtacggtcggtctgtgaatgcaccgctgttgctggctttgggcgcctgcgactcgatgcgagctcatgcctcaagtgtgaggagatcaacaagattctgggagacgcacacgcgcaccaacagtgtcagcgtatgtactcctcggctccaatgctctcaagtcttctcatcaggctttgatcgatcgatctgtatcctctctttctgctgctctctgatgatgtactgtgcagatgatgcgcatctcgtgagctgctactgctctttctgttccaaactctgtgctgagaagttcaatcaacgggcctgaatatatagccatttttggtgtattccgatcgactttttggaacgttttgctgatagggaggagggaatgccggaatggtaggtgcccagcatgaacgtggagggcttgagcgagatgcctggtcataacccggcggatcacgcgagcaaacaccaccaaaacttcggctccacctcctgtttaagcgtggctaaccttttggcaggctggcaggcagctgccaccagcaaaagagtgtacaaaatgagggaattagggatgttgtacctctcctgagaaaatgtgatgccttttcatgcagatccagttctgtttttatctgaaaccatcatgggttatattcatgcgcgccggaggaaagcacaactccaagcaaagttgcttgtactacgtactgtatttgatacctctcccttcttgttggtgatctcgttcctctctacgagcacataggagtagtagaagatagtgacagacaacccagctggttctttcctcccagatgctaaaatgttcgattagtacaaggcgatcgaaaggcacttttctctctagacgaaattagcggtccatgaaggtagcacatgcctcggtttttcgtttttaagtacaccatgtttaatgtttgctccctattagcagctttccaatctcaatgcagcaacagcatgagcaaggcttgtagtaacaaactttgaggtttacaaaccaggaagttaattagatcctacccaccaaagtgtggctagttaatatgctactactaccactacgaaactaaatctgaaacagtacatctttttctttagacctgaacaggcatttgttggtgccatggtgtacctagcaactgttcggtgtgtaggagtatttgttgttaaccgagaaacgagaacagcttcagaaaatgcagcaacacgcatgagacagtacaagtccacaaggtcggaacagtacagaattgctcatctcgctagctcagctcagctctcatgcgtgtacggtgtcgcagcgaatgaaagttacaggctggaaaaattgatgttgccgtctgaaagtgaatgtgggggtaggaacgccataaaaacgaccgagagttatgatccctgtgcgcgtatgacagaacgcgtcttcagtaatggcgaaacccgggctagctatgctattgctatgcatctctgtctctcgttattactcctgtgacgttttctggttggcatacggtccatacggatcgagcaaagcagcggctccataattttacagcagctgcagctggccatcatcagttcacggccttcaaactcgatcgagcaacccaaaggaaaaatctcaagcaaaaaaaggcggtggttttagtgctccatctccgatctccaaacgcgttggaattctcagtgcacatcttaaagcgtactccctccctccgtcaaaaaaaaaaagacaaatcgggaaaaaaagacaaaaagaaaaaaaatttatgtgtccaattttgactgtcggtcttatataaaaattttttataattcgtattttcattgttgttagatgataaaacatgattaatatttttgtatgtgacttgtctttttaatttttttcataattttttcaaataaaacggacagtcaaacgttgggcacggaaaccagggtttgtctttttttttagacggagggagtaggagtactagtccaattgattttatgatctgtaccagtactagattcaattaaacggaatgattgaaatgccggatcgatcgagtcatcttacagactaaaaatccattatttttccagtatttacacaactccgttgcagctgagcttgctgccgttacaacgatcggtagccctatacaacaaatcgatccgtaatacgcctacgtcgccatacgttacgtacaccggacacgtactctgagtgcattctactctcgtcgaacacgagcagagaagctgctgattttgctgctcaattcgatccactacacgacggccttcgctggcggtatcacgatcgggctcctcacgacgtgctcgtcggagacccacttgaggttcccctcgacgccggcgacggccggctgccctgcccaccgcacggtcaccgtgaagctctgcttctcgtacgccctggagaagcgcagcaatggcgggtgcacggtgaccgcgacgttcttgggcatgtccaccacggcggtgtacacggagttggccttcccgacgttggtcacgatgcggtggacggtgatcggctgggacagcagcttcaccaccagcgacgggtagttgagctccgcctcggtgatggccttgagcttggcgcaggagacgcggcggtgggttatctccttcacgccgtcgtcgccgatgccgaggccgcagaggtaggcgatgtagtcgttggtgtggaggtcgtagacgaggcccgggtcgacggcgcgggacgggttgacgtagccggcgcccatggtgtagaagctcgcgctgcggtactgctcgtccttgatcggcacgccgtcgtggtcggcgacgtcggacgacgtcatgatcgccgacttgatcgccgccggggaccatgtcgggtgaaggctcttgatgatggcggcgatgccgctcaggtgcggggtggacatcgacgtgccggactccatgaagaaggagaggctgacgccgtcggcgaactcggtgtgcatctcgccaggggcccacgcggcgaggatgttcatgccgggcccggtgatgtcaggcttcagaacgcccgggctggccttgttcggcccccgggacgagaagaacgcgacggacggcgccggcgacgaccccatcaccgtccccttgaatgtgacgctcgccgtcggcttgggagtggacttgatgtaggacaggatctttgacccggcggcgtagctcacatgcgacgccggcagcacgtgcgcgtcggcgaatgtggtgtatccttcgaccggcttgttcatcaggatcatgccggcgccgccgtacgcggacacggtctgtccctgctcgacgtgctcgacaatgctgcggctctcgcagagcaccaccttgccgctcacctcctcttcgaccagcgtgctgcagtctcgtgagtcggagtcgccgttcaggcccgggaacaccagcgggagctggcgcccggcggtgttgttccgcggctggtacagggactcgccgtcgaacacctggccgttgccgagcgtcaccgtggtgcgtatcgcccggtccatggtgccggccgcgaccgtgagcatccatggcgcgccgttgcccacggtggcggcgactgggccatcattgccagcggcggagctgacaaagatgccatgctccatggccttgaacgtggcgatggcgacgaggtcgtagttgaacggcgcaccgggggacgcgccgatggagaacgagagcacgtcgacgccgtccttgacggcggcgtccagcccggcgatgatgtccatgatggagcaccggctcctggtgcacaccttgtatatggccaggtgcgcgtgcggcgccatcccggacgccgtgccatgggcgttgccgcggacgtcggcattctcgacgaagttgcccgcggccgtgctcgccgtatgcgtgccgtgccccgcgtcgtccaccggcggcgccgtcgcattgaccgcggcgctgccgaaggcgcgcgcgccgatgatcttgttgttgcatccgccgccggagatggccttgaactcgcaggtgcccttccacttcttgggcggcggcggcatcccggcgtcgccgaacgacgggtggctgggcaaaataccggtgtccaggagcccaatcaccacgccccggccgaacccggagcggctccagaacccatcattgccgaggtgaagcccaaggaaccccggcgaatgggtggtcgccaacggcaagaactcctcggggtacagtctgatgcacccctccttcttcctcatcgcctcagcctcgtcgtcggtgagctgcgcggcgaacccggacagcacgtggctgtacgagtaaatgatcctcgggccatcatcccccgccgcctccggcgtggcctccggcaagaacgagcggtgccacagctcgaccgagtcggcgacgccgccgtcctccctcgggtcgagatgaaccacgtagttcttcctctcccgcgcgcaggagacaacggccagcatcgctgaggaaacaaccatggacactactacggcgaggaggattcgttgagtcctcatgatgtacactggttggatgctggctcagtggctctcacttgcgacttgtgagtaaaaactggagctgatatgatttgaacaatggggtgcagga

SEQ ID NO: 75833 - DNA, 3159 bp, Oryza sativa
ttggctcaatcggctaaccccatccgactcgaactctgccgatcttagccgtagtcgattcggattccaaccgatccttactctgtttccgggacgatttctcgatttcttcttcatctccgatccctgaattaccaaatttggtcgttaacacatgccccccaagtccagaatattggataatgtttcagatttgccatatgtcgattccgagagaaatccgctcttgccgttttttgactgttattccagcgctttaaatactaaccattacccccgagaaatctcacaccatcttcttccgttttcaccgccgaagtaaactctgtcttctctttcctcggcgatttctctgacgcacaaggcgatcctcagacgacttcgtctccggctagatcgtcgcccgcggcgatgtcgtcctccgccagcccttctgccgcaccgtcggtcgagtacgatgaggtaagttctcatcggctagatctctcttcttcacaacagatcgattttccaactcctcatcttgttttcctcttctcggttcttctggatttgtagcatctctccaacctagttgcaattcccagcctgtcacatgaaaattactacttccttggcccagtcggcaacattgatcctaccgagttcatcattggcgaaaccaataggattccctttagattggccaacccagatctaggtcactggaagaacacctttaaatcttggccatctattgagaaaaccccacccaagaggagctggattacatggtacaagcgcgtgtcggccagcaaaaaagttcactgggacgatagccaattcagccaaagatgaactcatgatgtccgccgccacctatttctggtccaagaccatcaatgcctttttgttcaaccaagggccgatgactccaactctaattgacatcaccatgatcactggattagatgtaacctcatcgactaaccctatgagcatgaacaccaaaaatcaatttgatttcaagaccaaaagcataggcggttggtctggctatgtggcagcatatatgggtcaaggatcggttactcctcgagaacatgtggcctttttgctcatgtggctagaaaagttccttttctgtggatccagttgtggccctacaaccaattggcagtttacagccgaggctctggaatcaaaaagagaatttcccttaggcaagatcctcctcggctacttataccaaatgctgaacaatgcatcggccaaaatagctgttggctcagtagttggagcaggctgctgcagacttggctaaacctgatggtcatgaaagttgtcaatccgccatctgtaatagaagccgaattcccaagtctagagccgattatagaagatgatggagaagagcgcactcatcgcagatgcatgtcatatgaagaatatgcatgcacaccagccgatattggagcaaattatcggctgaactgctcaaggactgggttctgcagttctatgagggctttcagaagatgctcgagtttggtttccttatgaagattgggcaaaccttgagctcccatcggactttagatttgaagacataaatcatgaaagataccaaaagtccagggaaattttctcagctgcaatcagcccatgcatccttcctgtcggtatccatcagggaagaaacatccaagtttcttatgaattctatcatccaatgagctcagccagacaacttggaatgggtcaactcctaatcggcttattctttgccgataagatccagtgccgaggggaaatttcatcaactttgatgatggatcggcagctcaatctccaaggacctcctctgggtagcattgaaaatatagagctggcaaagttcaggagcaaaaccattgacagatggtggggtgaatggaaactgcatctattccataaatcagcttccatgtacaggatagacctctttctagttgttatccctcaggtatgccttgatttaactaactctgtttgaataattgcttagccgattcataacttgactaattttcttttggacctgcagacgacagaattctcccctcctcaccagagcaatagtggtagggacatagagtatgctccaggccttattccaaatggaggtgggccatctccccctgtcatcggctatcatgcccctaggacttcaactcttctccaagggctcatcagagaaccagccgatgccggcaagaagggaaaaaccagatcatcggctgtagatacttcggccccagctccaaaaaagaaaaccaagccaaagaagaccaaggaaaccgatgacttgcctgccctagatccatccattaagcaagctctggatgaagtagagatcggagaggatgttgatcaagctgcagacaaggtgagtgatacagagaaaacaccatcagcttcacccaagcaaactcctccaactccttctgccacagttcatttttccagggtaaacaactctccttgatccctttcgtaatcagttcactttatagccaataactcagagattttatagttgcagaagaaaaaaattgctgtgaagaagaaatctgcagcaacaattctcaaaccggctccaccagtaagatatccttaattcttccattagttgatctcagcagattttatctaacacttgtctcttttatagcctcctcctccttcttctcctgtacaacaatcattgagtgactgtcacgtcctgataaattcatcccgaaattaaaaaaaatcattttctaaaaggaataatagaattaattaaaattcgaaaagaaattggcaaacactgaaatacgtacaagaaaaatccaaatgtgacccggagaatttttgttaaattctccttggtcaaaaaggagccctcaaattttacttgaattttcagagtaccggaaataattattaagcaacaaaaacaattatcaaagtttactaaaaagaaaagctaaaaataaatccccctcctccctttgggccaagtttggcccaaagtcctcccctctccctctcggcccgcggccgaagtcctcctctcctccctctttttctctccctctccctccccctcccctctctctctcgggctgttcctccctcccctcccggcctgcccgg

SEQ ID NO: 75834 - DNA, 2777 bp, Oryza sativa
gtcctcgtccccgtgcagccactgccggctgtcctcgtcgcctcctcgccggtcccggtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgtgttagtgtgcccgctcggtagccacgtggtttccacgtgtgcaacccgtgtggtgtctagtggagtccgtttgtcggccactcgcctcggttgacacacgggatccgcttccgtcgacccggggaccgtctctgtgtactcggtctaccgcggttctttaggttgacatctggggtccgcatgtcaacggcgcagccctcctgtcttttccaggctagcgcttatacatgttttatagttgcaaagcttaattataataatccgcaaatctccatataacagcattaaacttcggatgatcatatcttggtcatacgagctccgaatcgacccgttcaagtctcttaatgtttgttataacctaaagaaccctgtgctttgtttttatgtattgttattgcttctttataggcttgtagctttgcttgtgtgcttcgcgtagctttcgtcgttccggaggttccagaagcgtggttcgcggtcgtcgccgaaggttcggaaggccgttctctctgagcaaggcaagtcacgtcatccttgaacatattgaatcccagtttataaaattatgttgctttaaattactgcattaccgctttatttaaattcccgcgttatcactattttatttagccatgcctatttacctttgttaagacattattattgctattgttattattaccttgttcaccctaggataaacaaaaccccaactagtgggtactctattcatggttccactagtatgaatttaggtagatgcttcgctgattaattaggcaacattaggtggttttataactttagactttgggaatattcatatcacctggacactatggaattgttggattatggtggaattggacatacacctctcttcctctttcaaagcccctaaaacctgtttttcggtggggtttgggtgcatgccagttgtgggaagtagcactccggccaatataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctgggacaaatgaaggctacacgagctgcggtccggtagtcgagatgtcatggcacagggctggtgtcctgctgctagggggctcaatcctgcctacctgtcccggaggttccggccgtaggtggggttgggtcggtactcttgttaatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgtgccctcggttatgggcaagccgagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggtaggttcgtgagggttcacggccttgattaataatactgtgtagctctaggatcgtctttataaaatggctttgggcaactaagtgacttttaaatgctgctttctgcaaaacttaacccctatattattaccccttgtacccccttgcattaatcatgcatctgccggtgtggcttgctgagtactgtggttgtactcattcttgctcaatctttcccctcttcagtaagagaagctttggagaagatgtcttaggtgaagtcctggcttataccccagttgagcgcctgtgaagatggagccataggcccgctagtccgctgctgtttattttttattgccaggcctgaagcgcctttgtaatagtgtaaatattatcgatataataaagatgtgtcttttatatcatgtttgtgtggtgtaccccggcttttcctgggacggggattaatacactagcgttcgggaaaaggcaattctcccggtcgcgacagtgaccaaactccatcggctgcagagagccatcatattgaagaagaagaacaaccagctgctcctgctataccagtaagtttccctttgacacaagaatttagatcggctatatctatttagctctaactccctttaaataattactgtaggtcttagccgatcttttctctttcgacattagagattatcttgatgagacagaaggggataccacaagcaaagctttagcccca

SEQ ID NO: 75835 - DNA, 1033 bp, Oryza sativa
atggccaagttatggccatttgaagtttatatgctctttgaatgaaaatttgcgaatttcttcatttggattttattttaaaaagggtttattgcgtcagccgagggagaggggcgcgcggaccgggtccacgggagtggggcccacacgcagcctcacggtccacggtggaccgggtgcacccgggctcacaccggccggcgccgtgggccccacacgtcagccgcacccgagggcgcgggcggctgacggccgggccccacgcggcagccactcggcatgctcgagggctgccatgccggtgcggtcggcgggaggcggcgcgcccatgccccgatggtcgccgccggtgaccaccggcgcggcggagcggcggccgagagagggaagggaagggggaaaggaggcgacggtccacggctcaccccggggcaatggcggcgacgggggaggcggctggagcggagggaggcggtggcgcggctcgggtcgacggggacgacggcgctccggcgggaggcgaccgaaacggagaggtggacgaggtcggcgaggatgcggcgaagccgaaggaggcggtgccaaggtgggaggcggtccggggcgacgacggtggcggaccggagctcggcggcgacggcggagcagagagcgacgtcgcgagctcgaatccggcgaggaggaagggcggcgagaggcggaaacggacggaggaggtgcggggagggtttaaataaggttggaagggggagagagcggccggaggggagggaaaccggcgcgggaggtacggccgcgattaatggcgccggcgagatttgccggggcaaatccgcccgtttgaatgcgagagagagagggaaaaaaggggggaaagggagaggggatcacggggagtatttccccccactttattgcacgcggggacggcgggatgcggcggatttggcagcggcggcggcgcttggagcgggcggagcggcgggagcgacgggaggacggggatgacgggtgggccccacccgtcagcgag

SEQ ID NO: 75836 - DNA, 5112 bp, Oryza sativa
catataagcagcagcatcgacaacaccagggggcatcgaaagatcatttggacttggcagagcagaacctcccggcggcggaggcgacttgggtggccggtgggcaccctcgtcgatctctctcccctacctctcctccgatctccagccttccctctcccctcggttctagaagtttccagcacttgtattccatagcttcttcttctcttgtccccaaaacagttgttgcttctatggtggatgcttgttgttgagttggaagtagtgggttcctaacaatgtataacagagaatgtttctttagaacactcacttctatatatgtatagatcttttaaaatttccaattatgatatttccaaagagaatgaccatatatgcaatgtaatagaaaaaaaaaatgtttctgcagcctaccaagtaatgcaaatagacatggcgagcttgtgcactgtggagaagtgcagccctgtatgtccacgtcatcaccctaactggtgctggcgagcactgccttggcctggccctcatgtctgcgccactgtgggtgccagtgcaccagcgattgccaccatggagaagtgcttctccaacggctttggcctgcctgggcgcgcatgcgccagccgagctgcacgcctctataggcggtgcccctcgggacctcgttgccgacctcgtcgctctcctgatgccaaccgttgccgccgtcaccggccacacgttcgcaatcgcgcatgacgcggtggacatgagcgccatgttggtatttcttagtaacactactggaaatataattcccagcaatagcattagaaataatcctggtatattatggttacaaatatgatccgcaaacgcacggatataccattgtagcatttcacccgggagtattcgaaggtatcgtatttattttatcccaaggaaatatatgataagagagtactatgctaatagtttatgtattacatgtatacatcaaggtctatgcaggggtaagttaaggataagggtagagtgacacagctaaggattccgctaacccctccttatcttcaatatgactaagtggaaatagaatagaaatgtctcactcttgtacttcaagtatacaacatcctagtctattctaactagtataatctatgtagtataactgttgacgtaaaacactatgcctgggagatctgcttaactccagtgcaggtccaaaactcgccttcggatatgctagcgtgccagttgatttgatcctgcaatcaacaagaaacagagacaaagaaaccgtggttaaatccataaacgatagccgatcggctaggtgccgatgacatatcatctatctttgagtcgatgtcatttatgcatcgatcggcgagcgttaataagtaggaaagaactaaatctactcgatcggctgtagatattaacaatatataatccttatatcgatatatacttaaatcaagtgattgggatatatcggttgccatgccgagacagtataaatcacttagatcgaaatatatattaacaataagactatatacgttcatagcatagccgatcaaatagatctagcatgtatcggctaatactccgataccactctatattaagatatgaaagcaagtagcatatactaaacaaaagcataatatacttaaaagcaacaagatcttaacataaaggcagatttaacatatcaatcaagcatatagaatagatgtagttaaaccaggtaagatcggctgaaaccccgatactaccctaatcggcaaccaatgagcaggctagagatagagattctaatcacgactcataagatcaaactcaactgatgcagctataagtatgaaaagaaagacaatatctagacaatctttttgaagcaaatgacagcaggagatctgttggatatattagaaggattagaaatcagttatagaggggagtaagagacagtccaactacagcagttgctatttcaaagatttacaggaaaggtgatcaacaacttgagaagtgcaaaccctcagttttgggggtagtacttaagaagatctatattttcttttactaagaaagctacttgggtggcagttaatagttgttgatggaaaattcttcgattgcgttctagccacacctgccaccaagttatgaggagcgcccctatcattttctttcttctccctctatgccctgaattcgctaatatttcccaccagtcagagatgtgttgatattgtgactgatttggaacctgtgtaaggcctaaccaactgcagatctggttccaaactgaatttgtgaagctgcactcttttgctaaatgatttgtgtcttcaaaagcatcagtgcaaagactgcaaatccagtcacatggccaatgccgaattagaagattatctgatgtgagaattttctggtgtaagattagccagccaagaaaacgctgctttggctctgcttcagctatccaaaggggttggaaatttgtgctgataatggtaccttggaactgtgcttcataggcgctttttgctgtataaattccattctgagtccatttccagatgatgctgtccgaggttttggcttgcagattgatctcttgcaatagactgccgaggtgaaccaattcattgatttcgcttattgtggtgattggtctttagcgaaataatccagtgattaccctccatctcaaaatgtatacaattagcttttctttttgctaatctgaaaattgccggcgctatgtctttgggtgcacatcctgataaccaattatcttgccaaaaacaacacttctttccatttcccagggagatttttgtgcttgccctaaataattttttgtcgatctcatcacatggggtttccatgttaaaccagggcttactttcatctttccattcaaaccaaagccagcgtaatctcaaggccattgcgaatttttccaaattcagaattcctagacctcccaaagatttgggtctacaaactgcattccagtttacaaggcaactgcccccatttactttttcaggatcatccccttccagagaaaagctcttctaaggcggtcaattcttttgtaaagccatttattttgatgaagaactgtttaatggaatattggtgtcgaggacaaagtgttttttaccagaatttctcttcctgcagaactgaagaagcgccctttccatccagggattcttgaacccactttatctaccagcggttgaagatcaattttgcgcagctttcttgtgtgaataggaatgcccaagtacttgcaggggaaggttgaaacctttccaggaaagatggagagacaatcttccaaatcaacttcattgcagcttatgggatagatttcagttttgtccatatttgtgtgtaaatcactaacatctgcaaaggcagagagaattcgacgaaggactaacatttcttctcgctttggcttcaagaaaagagcaacatcatctgcatagagggaacatctgaaacgtctttgtctttgtagggtggagaggaagccatgagcttctgctttctcaaataatttgtataaaggttccattgcgagaataaaaagcataggggagagcggatctccctgtcggagccctcttgcatgatcaatttctgattctggggtggcatttaaaaggaccatcgaagaggaggtgccgaacagattggagatccaattacaccacttttggctgaaaccaaaattttgtagaacttcaagcaggtatgcccaattaacagtgtcaaaggccttagaaatgtcaacttttaggaaaagagtaggcttttttgctctatgaaaagatttgatcatgttttgaacgaataggatattgtcatggattgctcttttcctaataaaagcactctgactttgggagacaagatatcctaatttcggtgcaagtctgtttgcaaggagtttggcaatgatctttgcagagctgtgcattaagcttataggtcggaaatcttcagctttggaagcatcagtctttttaggaatgaggcatatgtgcgcacagttcaaatcatgaagtctgtagtaacccatgtctccaaagaaagaaacagcttgcatgagatccgttttgataatgctccaggcctgcttgaaaaaagccccaatataaccttctggtccaggggccttttctgagggtaagtctgagatagcctccttaagttcttcttcaaagaattcttcatcaaggtcggagagatctactgtcggcaggtccagagatgaccagttcagacttttctccctaataacaaaggaacctagcttttgagtgaagtatctgttgagtttttcttctttttggctttttgtaactgcgacactactaggggtgtgaaggagaagaatgtgattctttctttttcgcccatttgctttaatctggaagaattttgaattgacatcaccaagctttaaccaagtgattctagctctctgtctcagacgagttctctcaatggctgcaagtcccagaattctggatttaagagatttccgaagggactgttctgcatctgacaaagttctttcctcttgggctacatcaagctgataaactacctcgttggcaatgatcaactgcaatcttatgtctccaatttttgtagctttccatcttctcaaatctctagcaagtctttttagttttagatgaagtcttacaaaaggattggaggtctgtataggcctattccatgaatcttcagttatttgaaggaaatccgggaatttgagccaatacgactcaaacctgaaggaattgttttgctctctttctacacagccggttatgaaaaggggggcatgatctgagcaagaggtggagagagcagacatttgggcagagtcaaaaaggatatccgattccaggcaacagaaggctcgatcaattttcgtttgcgttgggttagaacactcctgcgaccaagtcaatttctttcctgagaggggcagctcttttattcccaacctgtccagggtcgatttgaaacgctgcatcatacctctgttgagcctgttgttgttcttgtctg

SEQ ID NO: 75837 - DNA, 811 bp, Oryza sativa
atatatatatatatatatatatatatatatatatatatatatatatatatatatatatatatatatatatatggagagagagagagagaatcacgtgaacagtgccatgcattcgcatgcgcgaccattcgagaagggcgcagctgcgcgccaggctgtggaggcggcggggccgcacgcacaccgagcggaaggagccggctggcgcgatcggcggaagcaagcggggccgtgcgggggcggcaaaccgcggtcgccgcagaggtggtgacgaagccgcatacggcaggcggaaccactcgcggctgcacgtggccggcggatcctcgcctgtccgcggtggtggcgaggcgcatggggcctcggaggcggagctgcgaagccgcatgcggctacatgctgcggcgtggatcgcacgagggtggggaaacacttttaatcacctaggtggacatccacctatttgttgcttgtcaactaaatgggtataaaaaaaatttaaaaaatttgacaagatagattcatatacaatatatcaccccacaaacatgcaaatttaaattcaacttctacaagttgtaacaaaaataacaaatcaaaagtttgatttgttactttttttacaacttataaaagttgaattttaagttacatgtttatgtagtgatatattatatattaatctatcttgtaatttttttaaaaaaaaattcatgatcatttagttaacatacactaaatgagtggacatccactcgagtgattagaatctacgtcccacgagggtggtcatgccgcggacccatatgta

SEQ ID NO: 75838 - DNA, 87532 bp, Oryza sativa
  unsure (1)..(87532): unsure at all n locations
gacagaataagcacaaggcataatatcattgagggaggcacgagctttggaactcgttccaaagcgacactggcttgaaatctgaagaagagaagaaaaaaagagtcgcgagattttttagaatatttcagagaactttgcctttcctcccaaacctgacatatattcctccaacaaacacttttcctgccttctgcaccacttctctcagccggtcaatcactaagcaaacacttcgtttttgcagagaaatcagtcactaaacactcttgatactaaacacttgataagcctgcatttacataatctcttgtctcccacgctttgcagtgacagtgtctctgagtgtttagtaggcgttgcaatcgagcgtgagtttcgaaagggaaaaaaaatgacaccttgcatgcgtgattctgaatttccgaccattgttctgttgttggacaattggtattgtaatttgtaaagaaacatgaagaaacgggaacgctgaaatgtgaacttcaccaaaagacactcgctgccattcgtgtccgttctgatgcaaaaaggctagacacgagcatcattcgccagctcatttccctgcatcttgagaatactcgtctctctttttctagcataattagtacttacctgtaacaagattccaaggattaatccacggatgatgtggcagaacaggtgtactggatcaatcctacgccctttcctcacaaaccgggggccccctttcacccccatttcaagcaataaaatgagggggaaaggcaagggttctacactacactgccactgcaacaccctcttctcctcttcctcccccaaaaaaaagcctataaaaaagtataaaaccattgcaccatcgagcaaggcagtagcagtgatcgaggagaataaaagcagaagtagtagcagaagcaagaaaacactttgagcatttttgttttgttctccttgcagttacagctgaagcagcaagcagaagattaaccctcttggctaagattcaggttaacctgcagcgagaggttagctcagctcagcttagcttagcttaagctttgctcgagcttgccgtgcactccactgtctcttttccggtggtataatttggtgcggcggtgagctgccggccatgtcgaccgtctcctccgcgctgtcgtcgttcctctactgctgcttctcccccaccggcggccaccggcacggccaccgcgccggcgcgtactactacagcagccacccgacgagcaccaacacctactactacgagggtggcctcgccggacgcaggatgggcaggagcaggccactgtcactgcaggtatttgttcttcttcagcttgctcgttcgttcttgctttgcttgctctgttcctcgcttcctctgtttagctatgctacgcatgcagaagacggacatattctttgttcagatgaatacgtatttgcaagctagcttgtttatgcgatattgcgattgcgactagtcgtgttcagattattctcctcagatttttgtccgccacttctgatgctgtctcctagcttaacgctaattaatttcctagcatatgctcgtagcgataatctgtgctgctgtgcacgttgctgtctagaacagcccgcgaaaccaagctcatgcatgcgtgcgaaaaagagagcgataaaaggttgaaggaaaaaaaaagggcaacttacataggacaagggaaacttttccctcggcttgccgcatgcgccggtgttggagacagtaaaaatgtactcgtaccagtagcaaaatactacagtaggtgtatgtatcattcatgcgtgcgattgattgaattgctgcatgcgagtacatacagtaaaatatgaacggttgtctcctctgttttcccccagacagtggagctcaaggttcggatgtgctgctcaggctgcgagagggtcgtgaagcatgctctcatgaagctcagaggtatagtttgcaaatctcaattatcataaaaagtttttgaatcttggcaactaagggtttagatcaatttgttgtgacaaatttttttggcaaaagttttggcggtaaaaaatttggcattgaagttttactaattggtgcatagatgcatggtaaagttttgtcattttactagcaaagagagagagagcacggctcccaacgtgcttttttgataaaatttgctactctagacttccaaatgacaaatgttaaattgccaatttttactactatggcttcgattcatattgataaaaagtgctccaaaacagtataacttttgtcattttggagcaactaaacatggcttaatttggtgaaatttgcatgcatgtaggggttgattcggtggaggtggagttggagatggagaaggtgacggtgacggggtacgtggagaggcagcgggtgctgaaggaggtgaggcgggcggggaagaaggcggagttctggccaaacccagacctgccgctctacttcacgtcggccaaggactacttccacgacgaggagtccttccgccccagctacaactactaccgccacggctacaacggcgacaagcacggccacctcccggagccccaccgcggcgccgaccccgtcagcaacctcttcaacgacgacgacgtcaacgcctgctccatcatgtaaaaaaattcccatgcccgcctcgcattgcacgcgtactactactactactagtagcagtgagatcgatcgagtgtgtgtgatcatcattgtgtgttctctcttgtgctcggcgccgtggtgacaggtcaggtagtgtgctgtgtgtccatggagtagtagtagtagcagatgctaaagtcagtcagtcagtgtggcaatatcgaatgagtagtggcgccctttacgggttacacaatggaaagccaggctctgtgtacgtacgtactctctgtcgatctgcaaattgtcaatgggcccgaaactaaagccaattgatcgaatatcgttttttaaaagtagtatttttttgtttctaatataccaacatcgtattgatgtctctattaaatactactagttaaattcataaatatggataaatactggttagtaggctgtgtttagttccaaagtttggatctaaacttcagtccttttctatcacatcaacctgtcatacatacacaacttttcagtcacatcatctctaatttcaaccaaaatacaaactttgcgctgaactaaacacaaccaaagtttgaaattggagatatgtgactgaaaagttgtgtctgtatgacagattgatgtgatggaaaatgactgaagtttggatccaaactttggatctaaacacagccgtagttaaattcataaatatggataattctgagaatcgggtttccatggacaattcatgtgatgatgttcctccgtgtgagtatagcaacgaatgggatgccagccagggtatcttcttgtgctcgtagctatagctagcagcagctaggtttggtcgttggtgattgtggttatgccagtttaaatattctccactgctggctgcatctgcacgatgatttgatggatagtactactccagccaccacagagagaaaaagcctgggaataggacgggagcatgatggtgttcgtggagcctgcggaacatacaccaggccaccagctgccaaaactcagccgccaacaatagtgaccctaaaattaaaaggcttactactagcttcgagctcttcagttcaaaattgaggaccgattttagttacaaactttttatttgaacttctaactttttcatcacatcaaaacttttctacacacacttctaacttttctattacatcattccaatttcaaccaaactttcaattttagtgtgaactaatcacaccctgagttcactcttccaactttatcagatatataggcactcgattcagaaattccactctcaaaaatcataacacacacgaacgtttgagcataagaattcaatctatctttgaggtttcaaactaaaatcaggtggtttttgtggtgttcatgtataagctcatctcctcacgttctactccaattcacgtgtgtataggctgtaaattaaaaaactaaaatttcggcccatatgtttacatgggccgtgacgacgcctcgagtagcatattggcctgaagccctgaacacggatgagaaaaaaaccggaaaaaacttggccgatctcctcctcaccgcacggcaaaggctcctttcccctttcccgcaaggctcccacgctgacgaaatcgacgccgatttcccgaaatccccaatccccaatccagaatccactcgcttttcgataaaatttctgttgattgcgtcgaaaccttcgcaatcctctcgcacgcatcacgccttgcgcgccgcatctcgtagccctgaattttgatttgattctgctgcctccggcgcgcccctgattggcgaggaggtggtggtggttgtggtgggtgcggccatggcggcttcgacggcggcggcggtggcaccggactggtggaacgacgtgaacaactcgccgatgtggcaggaccgctccttccacgccctcgccacgctatacggcgccgtctcgttcgtcgcgctggtaagccctagccctacgggacacgttagaatcgatttaggttttgaaaaacatgggctaataataggggaggatattgggtcgtgtagccgagcagtttggaagtttcgtctttaattgtctcgatcgagggcttagatttgatttaagctgatgttttgtgcgggaactttgtagcttaccgtatgcttgaattgtatagtgatggagacatgggcatcagtctcatttgagtcgtttgcacttttgggagaatttttgcaggtccaattgatcagaatcgaatgtagagtacctgagtacggatggacgacacagaaggtgttccatttcatgaactttattgtgaatggaggtgagcatacttttgcactttgccactgcttcattgatacatgctagctttttcggaacttcagtttatgattttggactggtttgtttcagtgcggtcaatcgtgtttgtgctccgacgagatgtgcaacttgtgcagcctgaggtttgtggggggaacagtttatgtttctctgacttgtttctgcaatttttttcgaaggtgcaaagtaggaatgatgcgtaaccatatggcattgtaggtatttcaacatgtgctcattgattttccggggcttgcattcttcacaacctatgctctgttagtgctcttctgggctgagatttactatcaggttagttttacttggatatattttggttttgtcccatgggtgtttttgttctcattggttcatgatggcatttgttaggcacgggcaatgtctactgatgggctcagaccagctttttatacaatcaatggagtggtctatgcaatccaggtgactttgccatccacatttcttactgttgatataattgcttctctctacaaactcatacatgaaactcattatcatgacaattggaaaacttgttactggacggatcatccattgataatgtaaagtgattggatgagtcccaattgaattgttatgtttgatagtatgctatcagaaaaaaggttaaacagagaaaataaagcaaacactatcataaaaccctcgaaataagttagttagcgtagcatgattccaactgactaaatcttgactgcataatgtacaattactcatcattgcacaaatagtttattttattgtggagacaatgatggctgttagcttgtggggactccctggatgtacactttctgttgtgctacattttggtgggcatggatgtcaaattaacctaccacttgccattcagagcatttttcagtgtggacatgttcacaaatttctaccgtattgagagcatatttcaatacatagaattacacaaagttttgctacctttcctttttgaagtacttttggaatgatctgatctttgcatgattttcagataatactttggatggcgttgtggtggaaaccagttcgagcaatggtcatcttgtctaagatgttctttgcaggtaaatcttgtgtaatttgccttgtcttgcagttagtatggattttttattttgaatgagagcttgtggaaatcatagctggagatagatgggaaaactatctgatcataagttaaaaaaattctcgcgtacgtttagttcctcacatcccctaaatattaatgaacatgaaggaaatacattgagtcatgataaaccaggcgtagtgcaattttgagttttcttgttatacatgataatttatcatttattctactaatacaaagttatttgccagcgacatctttatttgctgcccttggatttcttctctatggagggaggtaagctgtccttggttttcttatttttgttgttttgggtgtttgtcttttgaattatggacaagaaattagtatgcttctgaagttatttcccacatgttatgtccatgagcttttgtatattggattatttggaaattggaagtaggcatgcctgggtgggtgtgcagttattgggtactggttgcggtgattcttttcatagcatgttacttagtgtaattttgtggttatctttgtaggctatttctgatgttacagcgttttccagttgaatcaaaaggaaggcgtaaaaagttgaatgaggtactatcttttatcattggcttctattccagaattaatactttagataatttgcatttctaacacatctactttttcataggttggatatgtgacaaccatatgcttttctggcttcttgatcagatgcgtaatggtacgtcctatgtcaatattatgttagggaggtcttcagactttaattactccacttaattagagcatcttacagatgtgcttaaatgcgtttgataaagaagccgatcttgatgttctgaaccatccaatcctaaacttcttctactacttggtatgtcttcctgttcacttgctttgtactcaaccttgtagttttatacattgtttttgtttatctcgtggcatttatatcttgatctcctctaatgtcattgttgtttaatgttagaggctctgtgttggtcattttaatttgccatgttcgaatgttcacatcgaggaaatcatttcttacataattttaactggtgtcaaacaagggataatgctagaatgtgatatagacttgtggaagatatgtttcttttgcttgtttttaccctgattggaacatggggcacatggtgggtatgctgatatcctaattaagtgattgtgtttacaaaaagagctgaactgaaattctgttgggaatgtgactcaaggaaaaatggttttgctacattgtataaaacaagagaggaaactagtgaaagctatttatttggcagaacacagaaattgtatgtgcttatctgtgcataagcattccaaactatagcatattgattttgccgaatgagtttacaaaatgcttttgctgttggagtatattcagattgtatgaagtaattgagactcaagacagtcactgccatatttatttgcttttgtaagaatggtcattaaaaaatggcttgccaagaataaactgcaaaagcaatttctttgtcgtgttattttgaatatgtctagaccaataattgtacttactgagtgcttgttgatagcgttcattttctctttggcagttggttgagattgtaccttcagctttggtgctgttcatattaaggaaactaccacctaaacgggggatcacacagtaccatccaatccattagatcagtccagggatccccaatgtgcccttgcaaattgttccttcaaactggtgagtacagaaatgtaaatcttaaccacggatttctttgtaggtaggttgcttggttttcatgtgaaaaaagctcaacaaaaattctgggatatatatagtttgtaaaaagtctaacatcccgtcatcccaaattcctgcaattgctgtactgcgacccaggagtattctgcaactacaggttttcttctgtaaactgaaggacaaatatgctttgattatttgtttgattatttgtaataatgtcagctttggtttattgttcctggtaaaaagccccttgcacgcttcctcctgactccccagtggtacacattgttcattactacctttttttagcctggacaatactgggcaatgttgtgttccttggcagagtattttcccttttacaccttcctgttcactggattgcttatacaagctctgatgggcctggatgtgtagtagacattgggcctcgttaacatctgtaaacttgagcaactgatattccaaagttgatcatagtgcgggaagtctagcaatgaactgttgagaagagaagatagatccatgttttgctatcaaacattgcaattataggttttgccacccaaaaggtatttacatacataatttgctgagttttatgtattacttttagtttcctttgttttcaatctggagatcattttcaaattgatcattagctgaaactggtagaaacaggacagatgtgctgagcccttgacattcaagaaatttatcaaattttcatcacccagttgtcaaatatgtttgggtgggtatgagatataggcaccagattgattccaatgaaccaaagccagtttggtcgaatccctaataattgtctgatcaaagaaagagagaaaaagagaacacatcgaaggtgacgaatcatgagtgaaaccgccgttaagcaaatcatattacgaacagtggcagatgatcatataataaggagtagcaaattctagagttgcaaccttcgagcgacaaataggcctaaggaggttggagaaaattacgaacctccaggtacaagttaccagtgttattagtcctctgtccgtcccaaaatataagagattttggacggatgtgacactatatccaaaatctagtgtcttacccgtccgaaatcccttagattttgggatgaagggaatacgtggaaggaacaaatgagtatatgaaagaaaatgaaagcacgcacctgtcaatcaggtcgacagcttgtatataccgggagcatcaaattcagaaccacacgaacaggttgtccaattgacagcagaggaatggagacttggagagggtataaacaaagctcatcttcatcttaggccttaggagtgcatttttagaggcttctattctgactggtagctgtgtgttcctgttgggaatatctcaatccaactgcgattcaactcccaatctaactgccatttcccgtttctgttgggagtagtagcgttaatgacgttggaccagccctgctggactgtttatgaactattgtacgtctgaattagtaattccaactctgctttacttgtccggacaaactctgacgaaattcttgtaaagatcttgtgaaatttgaacattccatatttccattctacatctactactgctacatgcaacacaggattctggtccaagacagtaaaatgcttggatgctctctcggatgccggcagggggaagggatcggcaggacgggcccaacaggaaggactcgtgtgcagacaccggacagagtgagagattgctgtgctttgggcagcagatgtgtcagtgtttatccatccattcctcggctaccttttgacagcaagaaatggatctccatagaaaccgcatggccccagcgaattcagcatccacggattctttgcttggatttgatgttcttcttcttcttgtgctatgctctctccttcaggccatccatcatgctcaagtctgaatactgaatccatggctttggctgatgctgtcatccatatagtgtgtgtgtgtgtgtgtgtgtgtgtgtgttttaatgcatgattcttttattgaagtgcattttctgatgagtagttaccgtggatgattgacttctaagcaagtgcggagttggtaagttgtaccacagacagacaacacgtatctcatgtacagtacagttcagcagggtaacgtagtacccttgctaaccagggtcgacagggactcgcagtagttgtaaatgggacatatacactgatagtggtactgttcattcattgattaacggctacacctacacctttcctttcagaaacattattgtggtcatgttattaattatagagaaaattgcaaaaaccaccccgaaagtcacttgaattttgacattccaccctataagtcattttgttgtaaatacccacctgctactaagttttgtttcaaaaaccaccccaatgcgcacgtgtttaaccgaatcaattcgttattgctgatgtaggattaccacaggctaagctagccaagtcaatcttgtctaagtgcttgcattagacttattttccatatttgattgattttttttttgcatatagcaaaactcagtgcaacaatgtttaggctctcgtcaacaattttatatgtggaatctcacaaaaaatgtatcacgaatactctagaagtatttagttttggcaaaggccatattgatggctcacattttataaaaatatgttgattcggttaagcatatgtttaccggggtggtttttgcaacaaaattgagtaggtgggtggatatttgcaacaaaataatttatggggtggaatgtcaaacttcaaatgacttatggggtgatttttgcaattttcccttaattatatgccaaagtagcaaattactccctctgttctaaaaaaactctttttagatgccatagcaacggtcacttaacacattattcaggtaatgttttttccccaactgtttttactgaactgattagtgctaacaaaacgagcggtaactcgccggtgatatatttttcctggctgaagtatgatgctttaccactgaattacatttggggaaaatggcctagcttagagtagcttagcaaacatccacacacaaaggtgaaaacctacaaagacaaccctgcacgcttatattttggaaagtagtatgtagtggtagttggaagatcaccatccagaaatgcgttgagctcccaacttgggacctatgcgtttgcaggaattagtggactatggaggtagttggtgccggccggccttacacttctttttttttttttgaacgaatgccggccttacactcctgaatttgctactccctttaaatttcgaattcagacggcatggattttgattataaattaccactagctcgtagcagatggttcttggccaccttatccatgataagcttattactgcatttttgtgccttctggttggattcaatctgaaatgtggctagagtagtttattactcctatgttgcttgatcattaaaaaaagtactcggttaacattgggatcatctctaaactaaattccattgtccgtaatttacgtagtaggctagtagttgtagctgaattcattgattagctctcatatctgttcctgtttatctgatgtacacagttcattgccatttgtaaacatcaatactttgcctagaaaacacaccacaactacacttcttctaatcgggacaactaagcaaagccaccctttttggtcaaagtcatgtattgcctatcattaggtgattgcataattacatgaacctaacccactgattatcctatgatgttagccatggaaggagaacactgaccaggaatgcgaaacaacagtactagatatcagcaagttgagcatttagcattcttatctgtgcttcccactaagaaacaattaggcatctttgtcggagcaatttatgcttgattagctgcccatgcagatccttgttgtcatttgtcaggtagtagtagaacacgtccacctgtttctaaaggaggacagaattttttcttaaaaaaaattgctgacattgaaatgcttttgctaccagaaaccaagaaggcaagaataatgttccctgagctaatgtttgcacgcccaaaaattaatcatacacctttggaaaagggcgtgccaaagagcatgaaccaaagagcaggcataagtttttgtttaaagaagatacggaacatgaacaatatatggaaaatggtgtaataaaaatacgttgcataacatttacgggaggaattgagagggtgaaaatggcatttcctttttacgctaggaagacagtctcaaagaagtttgcaaccgacgaaagtgcaaacaaataccattcccttgttctaaaatacatcattcatccaaaaatctaatctaaggtatatttaattttttagttttttaaataagataggtatatttatagtttatatgtaccgaattaaattgttaactaaaacataagaagtcattttaatacttattggttgcatgcatgtaagtaccctctccgtcccactgaacaaggcacgcacacattttaagattcattataaaattaagatttatttgataaatatttcattataaattaagatttatttgataaatatttcattggattgatatttgaatttactttcatataattgtgattttgttactataaacatcgtagtatttaagaatttcaaagttaaaagttagttttaaaaattgttacaactttgactgcacctcaagcttagtcagtggaacgaaaggagtagtttcttgatttgtcatatggtagatgagtttttttttcttggtcttgatgataaaagaaatatatcttaaacttttaaatggagagagtatatttatttctgaagactttgatagagaataaaaaacaaagataaaagaactatattactctttattaattgtcccgattgatgatagtcggatggaggttgtctagatacgaaacaatccttttaaaataaaatttaaatactagaaatagttatatttaagtgatcaaagggtggtaacttatatcacagggggaaacttgagaaatcaaaaatagaaggaatattagagatatacaaacaatatgtctctaacttaagcattgagttatactccatttatctcagtataaatatggcctaaagataagatatacgaacaacggagtattctcgtagttctgaaatatgtgcacggatagagttgtaaacgaaaaacccgagcattgtattgcaacaagagcctggacgctgaagcatgtgcctgcctactggctagggctgcacgttgatgtgagcccctagggttctccggtcacgtctcatcactatatgacacaaatattttcgtcctacccaagttttctttcacatattaatggactaataattaattagcacgtcactcagattcagagattcagattgccctccacacgtgcatctcctgtcacagtgtcacacaactcgtaaagtctgttggattaagtagcagtaatttgttagagctgcagcaataattcagtttgtctacaattatttgttggagctgtagcagtcactcaggcctgtttactcgaactaaaaagtaaagctgggtttagttccaaactttttttaattttttttaattttttcataacatcaaaatttttctgcacacaaattttcaacctttccatcacatcgtttcaattttaattaaacttttaattttagcatgaaaacacaccctaacctgaagaagtttggagagcacgtttgtctgtctcgcttgcttgctgcaatggcaaagttgtacggctcgagatattgctacattcaggcctgttttctcgcttccaacgtcgaggcatgcgtgacaacttcgactcctaccttcaggcacgctcttactacctctgtagtatttttttaaaaaaagaatcaacttatattcgtagttagaggttgactttttaatagagagtacgtccaaaatattgattacctaaaaatatcaattattgaaaatgaaataagattcaaacagggtcaagtaacataggaaacatatgaatggcaatagagcacctttatggtgctttctacggtatgatagtccagatttgttagaagagtttctgacaaccgcagtttctcccaaatccagaagctcctctaaacaattcaacattttgtctagatttttttaaaaaaatgtagttataaaattttagaaataaactagaaacgaaaagctataaagcctaacttttctatatttttaaaagctaactataaattaattgtttctcacaaacatatcctccatcagagtattagtattatcgcagtagaagtgatatcattttctgctattagcaaaatattttttactagtagttgatgtggtagtatgatattagattagaaaaaaaacggcttaaattagttcttttacccattagaacattgtaaaacacttcacggcagaattggtatatatatggtgagcatattgctatcgataaaaatgcctcataaaaaatgcttgtgtaatttgctccaaatccaagcacattgcaacaaaaaaaaaactattatcctattatagactaaataatagtctttcacgaaacaaggaagaaaggatccaaccaaatcagcactaaggctgtgttcgcattcaccttttcccatcccctttccctcgttttccgcgtgcacgtttttcaaactgctaaacggtgtattttttgtaaaaagtttctatacaaaagttgcttaaaaaaatcaaattaatccctttttgaaaaaaaatagctaatacttaattaattacgtgttaatggactgctccgttttccgtgcgcagaagttgggttcccatctcccccatccgaactcagcctaagggaagccttaattaatcagcttaatgagccccactaccactaaccacactataatacggtacaaatagatcatatatacactagcatagcacgaaatcgcaaagtccactaacatcccactcccccttccaagcttcttgtctcctctcctctccccaactcccacgccatctcgccaccaccaaccgattcaggccgcgcacgccattaatggagtacgagcgcatccacggccccccgctccaacgtcaggtggcctcctccccgcgattcccgtgtgaatttgctctttcttcccggatttttcgactttcttcttcttcttggtttgctcttcttctttcttggcggtctgcacccattcggagtccgagctcatctccgagtccatggcgcctctcgccttcgatggctggaactgaaatactaggcattagcgccacttatcttgcttcgatttggtaaattttgctcgattccttcatcgtggagttgtgctgttcttcgtactggaggtgtgtcctttttaatgattgctaatattcttggaaagcaggcacgcctgccattgctgaactcgatgttttctcatcgattggtcgggatattgccgttgatagattcccctgcagtgctccttttcgtctcttccattctcctctcaaattcgccttgacattttggtcggcactgtacttttgtggtggtggccactggccaacaatgttcaggcctggaacgatcgcctgtgtggctaattcggcgcgcattttgctgaaaagtttgcgggcttttatcctgtttgctgctctaccgggtcactgctctgccagttttgtctcaatttctgtgatgctttctgtgccatagctttcaaatgttggctttggtaaggaggggattgagataggttgggttatctgagtgcacacttcactaaaaagtttggatccttttgtccattctgctgtgattccgtcggaatttggcaattttcgcagttaattttgcctcatttactgatttgattcaccacagctttccccaatttctttcagcttccactaaaatctttccttctttcctcttcctgctccagtcgggtggattctccccagctaagctacgagcaatgcttctcggactagagaaaaatcagcacaacggggaggacacatcgcctgaggccaacgattccggcgagctggacgaccagagtaagtccactaccccagaaatggtgttgcacagctcaatcattctcatttacggattcaccaaatcgctaattgcgtcaacagggagcatggagtgctccacctccaccgaaatgtcgagcaacagtggccacagatcaagaaaccgagctcaggacgacgacagcttcgactccgagagcagctcgtcgggcccgccgacggtgaagaggccggcggcggtgaccgccttgctgccaccgttctctaggccgacgccgtcgaagtgggatgatgcagagaagtggatttctagccccacggcgaaccgcggtggccgtgtggggagtgcagctggggctgcgccgaagaaatcggcgctggcatttcctgaacatgtaagccggcctccagccgttgctaaggtggttgctgaggtccccatcaacactggaaccttggtgaagaattcagttggtaagcaagaaacttcaccatgccttttttaatttcctttttgtgctcttgaatatcttaattgataaggattgtggatttgtggtgtaatcaagaagttttagatgatgttctagtgacctgtgagagccacatctgtggtttggtgtgactagaatttcagcctatctttgtctgcaagttaagaggttgaattagcatttctcctgattgtttgtgatgtagtctgttactgttaggttgaaccaagtattgttcggagactcgtagtgttaggtaggcaaatttgaagtggagtagagtgaattgagaagacacgtaacattgtgagtagccggtgcaaaaagggtctgaaattgatgtttagctgtttttcatgacaggaggaatattataattcatatacaaatttgttaaatataaaatcagaaagcaaacaaatccatctgttttcattagataaacctgcttataagtctatgtgccttatgtatcgcccatttaaatgaacagttccggtatgttgggtgaatgcctattccagggatagtttatctttcacttactagttgctataattcaaaatctctctggcttatacttcttagatgacagcaaataaattttgtttcctctatgcttctaccttttgtaaaattcagtatgccactgacggaaatgtcctgttctattttgtttgcagctctcgcacagcctatttcatttaatcctgcacaaagtgcttcgatagttgatgaaccagctcctgcagttaggtctgtttcgatgagagacatgggcacagaaatgactcctattgccagccaggagccctctcggactgggactcctattatagcttctagtccaacctcctctcggacaccaacaccacaacgtaatgcagaaatcagtattggtgaatttggtccaaataagatggaaatgtctgaggaggaactacaaatgaatacaagaaaggaaatcatggatcttggccaacggctgggaaagacaactatagctgcatgggctagcaaggaagagaaatctacaacaagtttcgcaaatgtcataaccgacaaggctgtagaaatcgacagagaggctcgtgctgcagattgggaggaggcagagaaagcaaaatatcttgcaaggtgtgtgctcattcttggctatctactaacagatactagtgagcttgtaatgtgataattctcaaatcaggattaagtagggaaaacatgcaagcttgcattgattaatattaagatttaagaacaactagggtagcccatctcgtagaaatataacgcatggcaaggaaatcaaaacttcatattgctaggcttatctgaagaatttgcacatttccctgacagcatgtttatctttcttttttctcctaccctgcaattctaggtttcagagggaagaggtaaagattcaagcttgggaaaaccaccagaaagcaaaaattgaagctgaaatgaagaggatggaggtagaccatcgatctccctttgattattttgatgatgataccatgtatactcttcaaccaggccaatatatgcagtttcctagtttttatcactggataaaatagcttcagtaacttgtcaaaatcattaaactttctctgcaaaagggctaggagtacatcattagcaccaaaagtgtcttattctgcattggaatgggactgtttatgagtttatctcatgacacatctatccaagtccaagacacagaattgaacagaaacccaagaagcttcaggcaatttcaatttctgacaatcacctacctctgactgaattgcaggcaaagatagagatcaagagagctcgcgagcaggacaggctttcgagcaagttggcagctgcaaggcacaaggcagaggcgaggagggaggccgctgagtccaggaagaaccaagaagcagcaagaactgaagagcaggcggctcagatccggaaaaccgggcacataccttcctcaatctcctgctggtgctggtgcctgtgattcttcactctgccatgatcatctgttatttgggtagaagaaaaatacttgctccttgcacgaccatgtaaaatattcgctactggttggttcatcgttcagtgatcaatgccaatgagtcgccatttttgtcctctcgatttcactgatagaatcagggcgtatctacctgcataactactccctccgtcaaaaaaaaaaaagacaaaccctggtttccgtgcttaacgtttgatcgtccgtcttatttaaaaaaatatgaaaaaattaaaaagataagtcacgcctaaaatattaatcatgttttatgatctaacaacaatgaaaatacgaattataaaaaaatttcatataagacggacagtcaaagttggacacggaaacccagggtttgcctttttttgagacggagagagtatatattattactcgtagcgacgacgaggaattaaatctcgctgttattcagagtgcagcgcgatcaagcctggtttcgattggggagggggaaattttaggctgtgtttagttccacgctaaagttgaaagtttgaagaatttggaatgatgtgacggaaaagttgaaagtttgtttgtataggaaaattcgatgtgacggaaaagttgaaagtttgaagaaaaaaaattaaaatctaaacagggccagggcctgactgttttagaagaaagctgccacttttaccttgtaaacccacgtacacaagccatatatggcccggatggacggatgcgaaaaaagccatatatggagatgatataaaaggctaaaaattgtttcctgtagtgctctccgtgcctctttcaaatctacagattgccactcgtccagtcatcctctccgcgcgctataaaaggctaggaaatcgcagcgcccgccatcaaccgatcgatctcctctcccccgtctaatcgatctgttcaagcggattccgacgagacgatcaatggaggcgccatcggcgtcggcgtcggcggaggagaggcagcggatcgagcgggtggcgcggttcgtggcgcgtgaccgggacggcgacatggcggaggcgctgctgctccggctgttgaagatcacccgcaacgcccgccgctggggattcctcgaccgcgaccaccccctccacccgtattacctccagcagaaggtctccgagcagtgccgcatcctccgcccccgccccgccgccgccgccgccggtgatcgctgaccagatcacgtccatgggactcttcttcttcttctacgcccacgcggacaccaccacttgtgctcagattttttattatttaatttatatatttttttaggatctttgtcaacattaatgaccccatgagatttcctcttgagattatacgagaatcagcggctgttcatcatcagccagatcaaagctaattaattaattgctcgtaatgcggcagatttgaggcatgttcttgccgtgtactcgcatgtgacaactatctgaatccctgaaattgcaagggcaaactgacacccaaatgggcctaatctcgtcggcccaggtatcaaaaccaagccgggccgtcccaagcaaattgggtctcaatcctcccgaatgggcctggggacatgtggtatcttgaattgggcctcaccttgtcagcccacgtgaataatttcagcgattgggtcgacgcgtgccactgcgagagaaacgtgttacctcgggttctctcgagaaatttcattatttgatatccaattcgtaggcctttcagggcaagccactcaatacacactcctttcagattttgtcactgagatagcaaattcctttattccgtgccactccgtcgccgatccgtccgtccgtccccaacgccagcttttccgtcgtcttccccacctcgtcacgctcgtcaccggcgccggcgtgggccaaactcttggagagttggaggggctcgagctcggactccggcacggatgggaggaaccagtcgtctctaatcttgcgaagcagcagcaactgattgtgcatagatatagcttgtgtgttaattgcagctcgctaatttcttccctagtttcttcgttctctcccatcaattagttgcgtaatgtgatttctttcttcttcgttctgacttctgaggagcacgcttggtagtttatcaatgaaaacagtagattcctctgtcagttttctcaatgcatttgtttgggaagattaacaattttttgctgattatggcatggaagagattagctctgcagttctgcctggtgctgaggtcgcacgtctgcgggattagatatggccttcgttcccgatgtggcccgggttcgcgaaggtggccgctcgccggctacgtcgaggtggaagacgctggaaatttcttctccgagttgcccaacgattctgcggtgtggagggcggccgcgacgtctgcggctggccccgcctcgtgcgtctcggctcgcccgtttcgatcggctgctgctttgcgagattacaagacgactggttcctgacatccacaccggaatctgagctcgagcccctctagagcgcagcccacgccggcgccggtgacgagcgtgacgaggtggagaagacgacggaaaagctggcgttggggacggacggacggatcggcgacggagtggcacggaataaaggaattcgctatctcagtgacaaaatctgaaaggaatgtgtattgagtggcttgccctgaaaggcctgcgaattggatgtcaaataatgaaatttctcggttctctctctctcccactctcgccgtcgctctccgccattctccaccgcccacccacaccggaggtcgcccaccaccggggcctcacctcctcctcctccccctcgtcatcaagcagagggggtgatcggggtcgccgcggtaagcttccctatgcttcgatctcgccagctccaatccctccctcgatttctccgattcgattccgtatctatggccttgtactgtttggttgtaatcacaattttggtgccgctcgggggtgcgcggatgcatgtgaaacggagaaaaattaggtctcctgtgcgcgattagggtgagatgtcgcgatccccatgcgattggcggacgtagatatgggtgtggtcttggtagggttaaaggtatcattatcacgtaatcacggtttagacagagacagaggagataaagcatgaaagaggcagtcatatcgtgatgggccattatattagtgagtaaaagagactgtctttttctatggagggttttgtttagtatctagtgggtccccatcaccccaaactccacaggttttgattctgatggcgttgaagattctgtgttctgtagttctcactaatccagttgtgtcgggctcctgtttcgttttccatttccgtgtgtgtaaattgttaaaagtttctgcttccattttggtttctcatacagatggatcctttggaatctgaaggtggctcacagaaatccaacaataagcccaaatgtactctctttttgtccccgtgccattttttaattggcctcgaatacatgttgtattgctttagggatttttatattgtttcatggggttgatgatttattttgtatgcagattctaagtttacgcaacaggagcttccagcatgcaagccactactaactcctggaattgtaacttgcccatcaccaattttactatcttcaaatatgcatattatactacctattagatttatgagttccttttatgcgattgtacgtgaaaatacataggtggttgctaccttcttgctgattggtatcatatttgtcccaattgggctcgcgtctctatctgcatcgcaagaggtaaatgcaaatttgcgtggccagattgttgttgtcttttgtcatttttatggtgcatttgtttattctattactcgggtacattgtagatcgtcgaactggtggatcgatatgacacaaattgtgtgtccacgcttgacaaggttgggttcattcagaacaccgatactgacaagacatgcacaagaacactgactgtgagtatcgaatggaaatgtcaatataccttgcctaccacttatcatgttggcccttaccatctcttagaaatatgcattcaattgtttttgctaaagaaaaaaaaagatccatgatggattatctttttgttgtatgtgttaggtgcctaaacatatgaagagcccaatccagatatattaccagatcggcgacttctatcaaaaccatcgacggtaattcgtgcatgacattcctcattttgttttttttaaaaaaatacttccttttttattccagtttgggatttataagaaatatgaaattaccggtttgacaccttttgatttgatccctaaatttattgtattcttactggacatcatttgatttgaattatgtgtactttgagagcatcctgtctgcatgacttatgttgatataatctgaccaattgttgacttcttatgtatataggtatgtgaaaagtcgaagtgataaacaattgcggtataagaatgctgtgcacttgacaaaggattgtgatcctgaaggtaatactgttgatggtgctccaattattccatgtggccttattgcttggagcttgttcaatgatacatatacaatttcggtgaacaagaaggccattgaagtgaataaaaaggatatagcttggaagagtgacaagaccgataaatttggcagtgatatttacccaagtaattttcagaagggcagtctaataggcggtgctaaactaaatgagagcatacctgtatgtgtttttcccctatgtacgacatggcatattttgttacctttatttcatacattttcgtctcattgacattttgttttttctgtctctcctgtcataaatagttaagtgagcaagaagacctcattgtttggatgagaaccgctgccctcccaactttcagaaagctttatggcagaatcgagacagatattatggcaaatgatcaattaacagtggttatacagaataactataacacatatagttttggagggtctaaagcgttggtcctttcaactacttcttggattggaggcaaaaacaacttcattggtgttgcatatctgactatcggaggcctatgcattttccttgcagtgggcttcgtagttcttctctacatggttaaaccaaggtacgccatgttattgctgccttgctggtataatgtgctcgctactatttcatatgcacacatgcatgttttgaggattacctccctcgcacatgatcccttcatggggagcctgctattctgttatttccatgtatttttacctgattatgtatgacgcgcttcatcattgtgctaattttggtacgaagatgcgatatagaactatttatttccatcgttgctttagggcaaccacaatgtgcatgaaaactaaacttaaggaataaagtagtaatttttgttgtacctttatacattgggagatgagctagggagagaatagtgctatgggcaaccttaagcttaaggctataccataagaattaaaaaaatatatcatggctttacaacatgcatgcacactttcaatcttgagtaaatatgtgttttttctcagtgggtcccaccttaaggtcaagaagctaccatatactccctccatctacttttgatagtcatatttcatcttggcacaatgaccaaggataagtaattctacgtatcatccatttaaacatgctactagttattcctcgtaaacaagtgattcattaatatttacatttctcgatgcctatgtagccaatcttgtgtggaagaatggagagtcacgcattaaatccaataaaatcattaagaggataggtggttggattgaaatatgcctatcaaaaataaatttttcagattttgaaatatacctatcaaaagtagatggagggagtacattgtagcatgtactataggtaaaaaaacataagaatgtgggtctcatcttatggctcaattgatcttcaacattgaggatgtcctaagtaggaaacctgagctctagggaccagcgtaatgcaatgttcagcattgacatggttgatattgccgaacataccatgtatatttttttgaagaaatttgaacttcgaactgttgcactaagaaaatcatgcttgattcctttcaggactcttggagacccctcgtacttgtcatggaatagagatactccagaccgtccaaactaatagattggaatctcttttctgatatataaatttaataaaggatcatttcaatgggtaaaatgtgaaattcctttacctgaatctatggatgatgttatgattcctatctaacgtgtttgtgatagcccgataggtccataggcatgagaatacatgagacagtgtactctgttgactccaattttacttgacaagaacaggagttgttcaacttatttctgactataaattaacccagagttcaactatagtactcattatttcagtgctcttttcacagtttcctgtctgtatcacacaaagataacccaaatactgtaaccaacagtaactgaaattacaacagttagtacctcaatcttatactatatttaggagattattcaagaagatattgaaatatcatatattgagaacaattctttcattgtcaaatgatgagatagatacatagtattccttagacatcattgtcctttgtcaccatgattctttctcaaatatgcaatctagtctgctttgtttaaaacttcaaatcactttatcggcaacctgtaatggtctcagtggttaattgccatagttttgtgggtacagtagctgtaaggtcctctgtcttcatattcatctaaggtcatcactggcagggcaagattgttggctccatgggtgttgatatgcttctactacacatttcggggacaacttcagtgaccccttcatcctgagtaatcattgttttactgataagtaaccttgttctggagagtgagtgaattagtttaaattaagaaaaaaaatagttagcctgggcattagcagcaataccttcattagattcctgaagtaaattgttgtgtaattccccgttggaaagaaaatttctattagatcagcaagaaccaactggggctgggagatagctccatcgaaccaatcttttttttaaaaaaaaaaagaaaagcaaaagcaaaactccattagacctttacataggttgaaaaacatggcactggagtttgagcatggttttgtaaaaacacaaaaacaaaactatatcaagagacctagtgtagagcatagagaaaagaattaccaagtttcttcgaatatcctattcttttatcaaatctccatatgctacggttggctacaaaactaaaacaagagtcacggtccacattaatgctctccaagaatgtggatagtttgtactctgcaggatctgaagcatatgtctgatctatgaccacatcaactgtctgaaaaatacataaaccaaagcttaatgttagatgcttaacaagtgagggtcatttaaaacttttgtgaagtactaaaacctttggtgtttcatagaaatgtccaattttgcccttgtctagtattagcattctgacattattttaactaagtaacagttctccagctctccaaaaagaaacgatggatctttagtgcatcatgagaaatagtgagacagatgattactctgacagttatgtattatcgatactcacacaaagaatagcatggaagttatccatatcctctggatcagaattgttgaatctcttattagtaatagttgcatcaacaacctctgctcctgcatctgtgacatactgcttatggcataaataccaaatgcgcatgagttgtctccatttcatttgtttagttgacagttttatgttcaaagtgctgcaataaacaaatgacattacctgtacaatccaaccatcactaacaaatgtccacataccctacagtggtagaaggaacatattgacaacaaagtatggtgcattccaaaagttacttatatggaccagaaagtgatgattttatttagtaaactgcttacctgtgtgaattcaatccatgccactataggtttgaatcttgtgctaagattcgcagctgctttgcttaagcataagtagtttgcctttatctgcatcgacatgctagataaatgagatcaattgtctataggtacttgattggacattgcaaactaaagtggtcttaaactagtttctttgtgctaatgaaactacagttactttttttttcgccgggacggcgaagaatgccgaccgatgtatattaagtaaaaggggaaaactgtacaaatgcagtgcgtcagagcaccgcctttacaacaaaaagcaaattacaaactacagttactttaaagtggtactatagtaaatgcattatgagcgcataaatgacaaagttcttgcatggtcatatcaatgcaaataaagttaaatttgctggtcttaactgcgtcataaactgtgttagccctatcttctgaatttgtgaaagctcccaagtacttgatccactcagccctctggacatagacgtttgaaacacaatattagtgtgtttgaatgctgtaatatttcaaatggagcattaaaaaaaataatcattgtttacttgcaatggtgtcccctcttcagagggtacataagctgcgaaattgcagccttcatctgtagtgctcaagaaatgtgcactaaattgtgtgagcatctgtgcatcggtcttgttaaaaagctggacatttccacttgcatatgattggagcacacactgggaggcaatttgatcagatgttatccccttcaagttttgtaatactccaagtagctgcatagagtgtcaaaaagtgctgcagggatcaattaatatgagagtcagaggcataaaacatttgcttctacagatgatatgtttttcctgttcagtttcagctgttgcttttgcttcattatctacgattgtacagattccgcattgaacagtacttaatttgtcccgcattgctcacctcgaagaatgacactgcagatgaaacaggaaagaacagtaatctgatcagtttcctatattgtgtacaaaaaagaaaaagcaactctaagtacttgctatgaaacaaattgaagatttgaacgaaaaatatcgaattgaagtttcgtatgtgctgctttcagtgtgtcagtttgcattatgtaactgttgcaagctatggcgccactccgaacagagaccgtttgaattgaaatgcagtctttgctagatcatactttgtacacatattaatatcgaatggttaacataacaactatataacagtggattaaacttcagtgcaagcataaatgcatacataatccagggtgtgcttgatttctacctggagaagccgtggtgtcgacggagtaattggcaagagggataacgaacgacttaatcctccccgtgcaatacttggtcttggtggccatcttggatgtgttctacgcagctcaccaaatcccaaaaaatcagcagaggtttatgtgccattttttgtgcaagagcaatgcgtactgtacctacctgcattagaaggtagctcttgccgttccagttgttcttgacgactttgaagctctggccgtagtatatctggaacctggtggcgtcctccaccttggacaccggcccggccaccaccggcggcgccgcggccttcggcttccccgccggcgacgagctcttcgcgccagccgccaccgcaatgtgcgtccacggcaggagcaactgccacagcaccaccgcctgcaggcagctactacacttataacccatcaccgatctcttcttactcggatgagcctgaaaacttctgaagtagctagtataagatagtaacaagactagctcgagttgggcattgctgtttcttttcttttcttccgttttggcattattgtcgggcattgtggttgtagtagtagtctagtctgaatgtctgatagggagcccgtgagcgagggaggccgtacgtgacagacaggtgtggtggtgttactcggaagaagagctggagagtggcggcctctttttgtcacggcgcggaatcggtaggattctcgtgaaaataatggaggatccatccattatttttttttgaacggaaaaaacagcacagatgtgccttttcattgaatagagcaggagaaaatacaacccctaagggtaaagaaagagaactatggtatacactatacaaagtgcgggactagatcgcgcaatcttttagctcccgctagagcccaaagactagcctcgtccttgattcttgataggaggaagcctgttgccatctctttgtggtcgaatatccgtctgttcctctccttccaaatttcccagacgactagcataatgagggatcgaaggcccttttttgggacgccaggtgtatttgctaaactctcccactaatgttggactgaccgtgcttcctcccactcattaggctccaattgctgataacccgtccaagaagcaactaggctccagattctcttcgtgtatctgcacttgccgactaggtgtattcctgtctcaggttcagaacggcagagagggcaatgcccattattttgccagcctcttgttgcaaggcggtcagatgtccaaactctattttggatgatgagccaagcatggaatttgcattttcccggcgcccagactttccaaatcagggagtttagatttgagtttggcgcccctaagcactgcgcatgataggccgaggaggctgtgtagtgcccattagctgtgaatttccaggcaatctggtttggctcttcactgtttagatgcacattccgaaccgtttcccacaggcagaccagttgctcgacaaggctgattgtgataggcgtggccgcatcgaaggtcagatcattcacccaggcgtcaccctcttttccttggcgcagggactttcctctatttttggagatagcatagacaagtggcatgaggtcttttggtctttgcccatcaatccatgcggcgtcccagaagcgtgccgtattcccatctccgacggctacctttgtcgcggcggcgaaaaggtccttgtttaaaccgtcacaaggcgtctccagtcccgcccacggcttggtaggatccttccattcatgccaaagccaccgcaatctcaaggccctagtgaacttgtccagatttaggactcccaagcccccctggctggtcggcaaacacgtctttgtccaattgactttacattttcccccggtgatatcactcgtgcctgcccagaggaatcgtcgtcgctgcttgtccagttgctccaaagactcctttgtcaccttcaaggcagtcaggaggtaaattggctgcgctgagagcacagatttgacgagcgtggtcctcccggcagcttccatgttcttacccctccagcttgcaaccctccctgatatcttgtcgaagactggttgtaaatctgttttccgcatccttcccagaactagggggaggcccaagtattttaggggaaaatttgccctcattgctgggatgccctggaggacctcagtcaggtctatgttgtcacatctgatggccgctacttgtgatttttggaggttggtgacaagtccagtggctgtgccgaaacgatgtaggatgtccgcgaaagccgtgacatcgcctcgggtgggattaatgaagatgacagcatcatccgcgtacatcgagatccgcagtcgagtcgttcttccccgaagttttgagattacgcctagctctgttgccttggagagaatacgctgtagagggtctatcgccaagatgaagagaagcggcgagagggggtccccttgccggagtcctcttccatgcttgattcgttgccccggcgagccattgaggaggacttgggaggtggaagtggatagcagagcccctagccaatccacccaccttgtcgggaagcccctttgctgcagcaaggccaggaggtagtcccaacgcaccgagtcgaaagccttcgttatgtcgagcttgaaaagcaactttgcccgtctcaggcggtgataacttctggccatgttccacacaaaaaggaagttgtcatggatacttctcccttttatgaaagcactttggttgaccgagatcaaggcatgcatgtggggcctgagacgcaatgcaagcaactttgagaagatcttggcaatgctatggatcaggctaattggcctgtagtctgaaacactctcggccccatccttttttgggattaggacaatgttcgctgagttgattaggttgaggtgcgcacacctaagattgaagatggagttgaacactagtagaatgtcctccttgatgatttcccaacaagctttaaagaaagccccagtgaagccatctggtcctggtgctttatcggctggcatttccttaattgctctatgcacttcctcctcggagaacggtttccccagagtggctagatcgaccggcatgatgtccagtgcttcccaattcagttcatttggcctcggccccgaccggcccatgaagctcgcaaaatggtcatggattgttgattccttttccccatgcgttaccgcccagccattatcctttcgcagtctctggatagtgttttttcttttacgcacattgatcttgaggtggaagaatttcgtgttcgcatcgccttcccggatgtgggttaccctggaggcctgttttttccttgctcgttcgatggaagcgagtccgaggatttttcgcttgagggcggctctcagccacatttcctgaggtgatagatctctgtgctcttgagcaacatcgagcctttggatgacgtcgagcgccatgtggaactgcagcttggcctccgtgcagatgccttttgcccaatctctaagaccgaccgcagtgcgctggagcttttggttgagccggtgcataggctcggtgtgcgacgatgactggctctagagagccttgactttgtccttgaaccccggtatccttgtccagaaattttcaaacttgaatctcctcggactgcgtgggcaatgcgggttggagaggaccagcgggcaatggtcagaaggtccagtaggtaaggcatgaaggacatggtgggggaaagcaaggtcccattcctcattgcaaaagcatcgatcaagtttgacgagggtggcccttcgacgctcgttgctctaggtaaacttcctattctgcaggggaatctcatggagctcacatctgtcaatgactgatcggaaacgtctcatgcgtgctaggttgatattgctattatttttgtcttgtgctcggtagatcatgttgaagtctccaaggattagccacccttccccggagctgggccttagtcttctgatatgccggaggaaagcgtccttgagatggtgcctagtgggcccgtagacggcagtgagtaggaacgtggttcctgtgactatgggcgtcacttgtgcggagactgagaagcggccgattcgaacctcttggacatccaaaactccactgttccaaaggaggaggattcctcctctcgtgcctcttgccggtttaaaagcgaatttatcgagcttgtagcctcctaggaaacgagcgagtccgtcgtctatgttctggagctttgtctcttggaagcaggctaaggtgcactttgtgtccagcataagctcgtggaccgtgttgcagcgcgcaggtgaatttaatcctcgtacattccaagaaatgacatctagactttgtgccatttatcaacaaaagttctctgggggcatgtacctgccttcattcgatttggtagtgaaggtgccggcacaaaatggtttggtggcccaaggtgaaacggcggcccaacaaatgggcggctctgcccagcttggctagacagcccgataagggatggcggcccaacaaaagggggacgacggcttgggaagcgacggcctttgggcagcccaacgcgcagctgtgcgcgcttagcgtggcccaggattggatgcgtgtgcgcgctgacgcgtgggcccgtgtgcgtgagagctgttggcgctcggccactgacgcgtgggctagggaggctgacagctgctgtcatgggggctctgacgctgacgtgtgggccggggcgcgttccgcgaccccaaggggaggccgagccgttcccgggcgcctgtaaggtgttcggccacggtccacgacgcggcttggtggacgagtctgtccggaacggcgacgagggtggcggcgacgagggtggtggcgaccatgcatagcagaggcaaacacagcaatccacgcagtgaagagagggaataccaggttcttgccgacatcggctacaaaagcacaagtagtctttcaacgttgttgggcaggctgcacgcaggccgccggcgatccaactggaggaggctgctcgcaggccgccggcactccattcacaaagcgaagaacaacgatacatggagcagagatgactcccgagacaaatttcgcagtagcgaagacgcattaggcagcgacgctctgctctgcttcatcggccgcgtcggcgatcccttcgccattgttgcgttactgggcagaaaaggttgtggagagtacttgtcgtcgtccccaggtgtcataggctcatggctcgtaaagacgatatatgcgtgtcgtcgcgtggactccgggtcggggagagcgcgcgggggcgggccaggtttcccaaaccgtcaggaccgggtttaccgtaccccgacggtaggtaaccgtgaaaagccgtgcaaattttatcaaaaatttaatttttttaaatttatttaaatttaaagatgttaccatagtatttatattaccgtgcccccacgataagcccgtaaccgcggtaaccgcacggttactggcggtaaagtaaactctggggcgggagccgccaccaccaccgcccccaaattcaccccccaatggtggctcgcgttgctccgatctgcttgccaccataccatggtcggcctgcggcgatggcttagctctgccttctcggacggggttaagcgccacagctctgcgtccatctccatggcggcgaagtggtggaaacgctgcaccctgaacagaagttaagaggatccacttcctaggagagatgagtctggtacagtttacagttgtattgctgataggataggttttcttaactttgtgcagtagcatttggaagaagagctgccagctttgctagcttaaggttcatcgccggctcgccgcaccatgtaaggcagcgtgtgtggtgtgcgaatcgtgaaaaccaaacaaatcgatcagccgcactagcactagaacatctgcaccgcttgctgcagacgagtacatctagctaagatcaaacatgctacagtcaatgtgagtctagctttgaccaagagggcatctctcattcagtagaccgccaaatacaatgccaaccattatcacgacattcagagctcaaattggccgccaccgtgaatgaaacaaatacaattaatattgaacattatgtgtgtttacatgtatatatatgtatacatctgtatttgcacttacaaattaacgatagtattttgatacaacagggttagacttagaatggacgacgaacaaataataattaattgacatacattctccagttatacaccagttaataacagagacacgaagacagttaattaatgttaaccttctcttcatgcactagctaggctcgcgctactgaggttatagcagattatataacagtagtgtcattaattgacagtcatggaaaagaccttttagtgatcgcactcagctggagtgctgatggccaacgcggaggttagaaacgtccatttcccactcaaaaacatgctggaaatgcccttccctttggagagcggaagccacaatttgttgctcccttcacgaccccatcccggcttcatcacttctttcgccttcttcttgaccagctcttgctcagtagggcagccattgatttgcttcggtgctaaaaggagtgacacaatctgcagcagctcattcactgtggtttctttgctgcccaacctttggtatgaatgtgatggcctcatcatcaagaacttgtcccttatgagtgccttgaacttgctaaaaatggaaaccctaccactaactttggtcgtaacggggaaatggaacttctcggtcgccttactgacggcggttgctgccgggttcgagtggaagctgaccttcttcgatggctcaatgcggtggaagaatgtcttcgccgcagcgacccttgaaacgaatagcctgtggttgacgtcaaccttctcgtacagatcgaaagatgcattagggttgacgtcgtcgaaaccagcagcaaagtcgtcaggttgagattgcgagaagatcggggcagtgtcgatgccgcctacgtcagtgggatcggtcatgcgatgaccggcttctcctgcaatctagctctgagttagtgcatgcaagaactgtatctgtatacagtctgtatcgaatatggaatactgctaattacttctgtggagcccatgtaaaacagccaaaattaaatattacatacctgaattatctgcagtgacttttatagggtactgcgcgatgatgtcttctgttggattgctttcatctccttctacaacaatctgcttgagacaaatgaagcatgaaagtaatcagtctcatgagatgtagtatatatataatgatgggaatatacttgtataggtatgatgcaaacaattacctccccaaggtcattgttcaccaacttgactcctctaaggttctccacccgcttcttctcgtccttgaacacctccatgtcagcgatctcgacctgtagccttgcggattcgtggtggttagaagtgccaacgccgcccatctcaactagagaggacagttcattgacgtagctagcactgcttgtgctagctcctaaccacatttcagggtagctactggtggagccattaattagctcctgagaggcagtcgcaactgacaggaattcttggagaatgtcaacttcgttggggttactgcgaagtatgccaatcttcgtgtcaaggctgacgtcctgtgggaaatcctccacctccaagggaggcaaggtgagcctgtgctgcagcctcgcacattccagtgcaacatccacctgcatatgaatatcattgcaccggtaagaactcattgcctgaatatacatgtcatctgtaccagtaagtaaccttcatttttgactatatatgtatatgtaccttggatggaaggcatgagaagttggcagaaactgggttcgtcaagaatggattggtggcgttgaaggcatcttcactcagaaactgcatccatttgccatcctcgtgaggtgcactcatctgcattccaaacccaccgtgcatggagtccattggcgtctctgttgggaaagagaagctgctgctctcaaagtcatcacctcttccatcacacgacacgtccaacgttggggagcgatcgatactgctcgtcatccattgaggttgctcgacatggtggtgcaccacaccataatgctctatgatctttggcccgggcgctgtcttcttgaacacccggcataaagcatatgcatcctacatatagacacacaaatgcaaagaggttgcatatcagaggccgcgtccatgtcaagcagctagtaacatattttactctaggtttataatttcagaaaagaagggctaaatataacatatatggtttatccatatattatggttgtagatttaaaaatgcaacaagattaatagtaacacacctgtaagccagtgtcagtctcgcattccctctcatcgaggcggtactcgtgcatgacccaatcggtgcgagaaccatgtggagctcgaccacggtagtacacaagagtcttcttcataccaactgcacgcctctgtgagttcacttttcgatctttcccagttgccttccagtatccggcttttgttgcacggttcgtccttgatccatttgggtacttgcggtctctagggctgaagaagtaccattcgagatctttactcggaagaaaggatttttctgaatattgaacgatcagttagggggtgtcatacaaacaaaaagtcatacataatcatgcatgcagcataaacattgaagtacttgtctactatcatgattggatctaatgacagagttaagatatggctatttaacatgatagcccaccatagctgaaagaaaattagaccaaggtcactttatatctcttggaggctgtgcggacttttgttcatcttcttgacctatatgttcatcacaagttcctttcttagtttcttgctttattttgtcaccccaagaaaaaaggctcatctttattttctctttttattcgatatttttacagcactcgcttcgtagaatgttgaatgctacatggtgtttttgtagtaaactgtcaagcttgaaagcaaacagcaagtggataaagagagaatatatcttttcctcaaatctctctgtgattgtgacatggtccaaaatatataaactttaactttgatgttactgatataaaggatttattttccatttcaagtatctcagtgcatggacgtatataatgtcacctttacacttggcagaaatttgacgtttctttttgaaggtaaatttcttttgacaaaaggatcaagatctatcaatatccctcctttcggtgtgcataagatgtttgaaagtaaagcaaatttcacagtatgattaatcttgttttcacacaaagctatgacagtgaaacatcgcttttgacaatgcttgattttttatatataaagagaaaaaaaatcaaatatgctttgatataactagcaattcaaatgtaccaaaatttacgaattaatcatggaaaccttttcttttgtgacataaatgacataaaagctacttatgtgaaataaaagaaaaactaaaacaacagatagagctacacatttatagccaggattaattagtgattattattacatacatttcaactacaaatagctagatgaagtgctcatcaagaagggaacatgtggttattctttcctcaagtagtgtaggcactggtgtttcttgggagggcataatagtataagaattgaataagattgcttagtgtctacataacacggcatccaataaacatactggacctatatatgtgctttccttggagaacaataaaggtgcatgcttgcctatagttaattgttaacctgaattttaacatgcatataaacttaaaacttgtccttatagcatttatacaaaagtctcatacaaattatatatcatgaaactgctattcctacccttaaaacaaaaagaaagaaactgttactcctatatagcaagagaatgatatataagaacgccaattggtgatagctgcatgggcctagggttggattgaaatatatatatcctagcatgggctacagcattctaacttctaccaccaacaagcaacataaaaactaggaatagatatctttagaacaagcaaactaagaacataccaggcagatcccaaggctcacacttgtaaagatcaacctctggaatgatttcgagttctatctgtcttccgttgatcttccgcttaaggtagtagatgattagttcttcatcggtggggtggaacctgaaacctggaggcaaactcacgggcgccatatgcttcctctagccttcctctcaaaactccaacagcaagagatgcttagagctaggcaggcagctggcaagccggctatccaaagctaaaatgtggacagccaccgaacttgtttgaatagctatatgaatgaattataatcagctacaatgtacaaaaacctgcaacatacaataacacatagatgagttaacaagaatgtcatgcaagtaagacaaaatgaagaggatcgaggaggaagagaggagaccttgatgctattggctaatggcacatgagagaggaagaacaagagagggagggaaaggggctgcgggagggagtgtgctttatagcaagttttccgagagtattttatgtatatgtttggattcttgccaactttctcaagaagctactactcctccatgtacagctctctcgctctctatgtctctctctctcaccttgggtgcttttgctttctgttgtcttgtgtcagttagctttagcggtgaatagagaaatatcccaatcttctctccttgtctttggctgccaataaagtgaggccctgtagctccagagatggagagatgccattggttgctttgtggggccaccatggctgtgcctagtcagctctcgttggaaagagtgaggggcccaaggttggtactcgattcgcgcgcttttttgcccctggcagcctcccccccttccctttgacggtttacgtcacgttcacacacgcgcccccatgtagattttgccgggggccctgcctcgatgcgtgtgccctgcatgattagcagctaatccatgtactatagtactaatactttgtcaaggagctgattaactgtctctcaactgagaagcacaatgctgagctcaagtttacctgtacattcttccgttctgggtgtttaagagtggatgccatgctcggtaaccgatgtgatggatgcagcctgctggccgacagtaagctactaagctggtcacctgtggagatactatcaagagaaaagttagtgttgaatatattttgattgatttctgtatattgtgcaaacttcaggttagtactctgaacgaatgtgcatgcatgcatgcatgcatgcatgcatgcagtggaagtcaagatataattggtgaatgctcataaaactacttcaaggagctggcttacgatttaaaatagtacataaacaacatatattatgaaaaatgcaacagccataacactagaatgcaatagccatgaccctaaaaaaatgcaacagccatgagatcaaggaatcaaatgacacttgcattgttcagttttcacagtttggcaagcatccatccaaggtgacaaatttggcaagcccatttgccagaaacaaaggaccctaataagagcaggtacaatagcgggctataaaccagctataaacatattttaaagagataaaggaagagagggaagagcagcgggctacagatctgtagccagctgcagcacggactccaagacgtaacgagtgtatgacaggtgagaccgggtattaatagtatagtaagcaattattgtatgaattggctattacattggctctagatgatttggagctagtacttggctatactattaaacttgctctaaagattgtgctcacaactgtccacactgaaaggattgaaaaaggcttctgttggatctagtgagcaaccagaaatccaaggtgaaaataggacccactaataccaaaatgatttcgttcacatttgacccacagttatctcattttactatggttttcagtaaatataatatatccacaaaccaccgtccttttactgaagtcagcaagagcctgctaaaagagccattttatcctacaaacatgggcatatcagaataaaagagatcactgattaggatgcgtttgaactatggttagggacaacacaattggttggtccatgatcgaattatactctccaattcattctagctaggtatgcaatgaaccaatgatggtgacgatctctcagcagctatcaaaaagaaaaggtggttatccaacaaatgtactgtgatagccaggctttcgacacgttcctctgctaagcctacatggcaagtgcaagagctgggtcccgggcgcttttgaggccctccaacttgcggctgctgatgcatagcttgtgggccacttttcctttttatcaatccatccgccccagctttaggttcctttccccttttcgagtttatgcttctccccaccacacatagcgagtatctccaaaaccatcccatcggaagctattctacgtatctagctccctcctgcctcaagcgtatcatgtacaagtacattagtaaatacgaataatggcacaactttaactgagtctatgatttgtggcaacgatatgatacgaaaaaggaacaaggtgtccaatgtaatgtaacatgaatggtaaaacaagtcggtcgatccgacagcttagagtgaccaggaaggacacacatgacgcaatctatttaaaatataaaagtgcagtgatttagtatttacttaatattatgaaatggtgaagtacgatcaaccagcttgattagtaaaggaggcacaaatctccacaacttcacatggcttttaaggaataagagcagataaagggagaatttagcccacctggacccagcaaatcagctaatgtatcttaacaatgatgacagattgccagagacaaattacgttctgatcaaactaatgattaggggcttaaggtctttactagagcctgttctatgatagctacatctaaactgtttgcctttgtatgataacacacaacctatctttatttttgtcttattcttaaacaccaagcctacaattggatgacatatagtcttaaacatcgtaatgtaatttgaggaataagcgtaactggctatagaacttcaactttcgatatatttcccctgaggactacacaattcagttcaccgttcagatagctagcttgccagcagtaccagttttgatgaaaaataactgacccgcaatagattaactgtgccaaagaataattcttagaacattgaagggggtgttgggatcagaccttgagtgcccacattgtcatccacggatagatcagtggcctctgccagaggcaagcaaagtacttcaacctggatacggaaatagttagaattaagatatgctgagatatattccattcaaaagcatttcacaaaagttatttaatcacaaaggttgcagagctgaatgcagtgtcggttctgattataggtgaagaggaatcaaaagaaaagaaaacagaacagtgtagccgaaaggataggccacccttagcctcccaacttttgaaagcccaaaaagtaagcccttgttcaagtatagtaccttccacaagaatcttcttgtacccagacaaggaaagaaatctgaatacctgaagaaatattatgatgataatataaccagggcagaaaactttatctgtttccattgtagacagttcctgctgttcaatccataagacataaagttcgtatttctcctgtagcagtccaaaactccaaattcagttcccaccagtgtcattttctcgactgatgattaaaatccataagacgataagtaccctgtaaagtaaagtagtttagacaactcgcaaagaatttgcttatgtcatgtccagtcactacgtgaggctttcacatggtttattatctctgatttgctggccatagtgagtgcaagaatcagtaatagcacttttatagcagcactaacagtaggaaccaacactcagaagtcagaaggtgtggctcacttactacactaaatctaataagccaagtttgaggactcactctgacagcattgctcagaggtaatctgaattaagaactcatgttctgatttaaccttgctgctgcctgctggaccattatcttcctggcagcccatccactctgtaccataatttattgtatcttccttaatagatgacaaaaaaaagatcaaattctgatattctaaattcagaattggaccattatcttggctctatatcattgcagctaggagcctagaacactagctcgatccgatgtatgtcaaggaaaatcttacatagcattggagagccaaaagacacagcataaattgtcattaacttcaatcagtttccagttcagactactgcagttctgcttgccagcttcatatctggtggtagaaactgcaaaagtaagagaagacaggaaatttaccatttacagcattgtacagtatactttgaagctaagttatgcaaacatcataacaaatacatatacagggagggaataaacttggtcggttggtccgttctcattgtatgtcttgtttagcacaattaaacagaataacttggaacacagagatgcaggtttttggagcttgcagcaggtaaacgcaagcacaaaaatggaggaaaacatgtcaaaatgcaatcttcaacaggaaaaaagcaattatagaactgaggtcgctatcgaaccaaaagttagaataattgtctttgttcattggatactgcaggcttctaagctataataaaggaacctgcacatgtttagcatgcttccttttctcttgacaatttgagaaagcaagatatcttgtgagcttctgaaatttgaatatgatacagttcaaggtgaaacgaacaatgtgctaccagagcactctgtctattagttttatcattgtgaaacctcttgaaaaaagcatcatgataagttgataaccggcatcatcatagtatatatatagctaaaatgaaaagggggaaaattggtagtggtgaaaaggaaccgtcattttcagttctgaggcaaagaaataaacccaccttgttaaataggatagagcattaaaacaagaagaatggactcatattgcggttaaggaaataaaccaataaatcaaatatcaaagtaaatgacatgttaaattaagttcctaaatagagtgaacagttcaaaaagtttacactgatagtctgttacatttctaatttcagaattttcttgtgtttaataactgtcagaaactcagaattcattaattttttttaaaaaaaaaactacaatccactgaattgaattttaaacaatacttatgttcaagtactagaatttagaatttctgtatgagaagccatcagcagggctttcacatgtgttttggccatgatttcgtgatcctagaagcacaaattgaacttaatcaacaaacacattgattttagatgtactcagaagattctactaaaaccttatataagaagatatacagccccaagcgattactataaacaactcctacttgcatgcttattatggtaatgttcaatctctgctattatccaaacacataagttaagagggcttatatttgcccacattacccttagcacttccggttttctttccagactaacataagaaaaaaagttcaacttaacacaagaacgatgaaacaattgtggtaggctggcagcctgcagctaagtctgcaatataactccgcaagtccgtaactaccctgtgaacaagcagatttcttcaaaatgcatgcaacttacgttataaacccaggttttctgaatattatatttacgctttcaaacataaagagtgacttcgcctcaagttatatgtagagttataaagtttaaaaggctagattatgaaccagtccacaatgttcttttgtttttccatataccagtcatgttctcggttaaaattatatgtgatgtgtaatgatgtttatatcctacattatggatacttcatagctttctcatgactgctaacatacattcaaactataatagattaaacaactgatattttcctatcatacccttgcatggcaatacaagtctccccctttaagatccagttgtgcaagtacaagtttatgcatcaaaataacaattaaacatttaaactgtctaaaatgatcatagttagcttatgtacacacattttttctctctctcaaagataagtcactttcatggaaatttccatagccaggagaatttatcttatgcaaggaccacccacaactcttagcgcactgattggtacttctttattatgttgatacattacagtgaggcctgacgctgactaaacactacacgaaaaactgtggctatacagacatggaactaaattgtaattgataacaatggcagctctcgttcatgtatatgaggtgcacagcaattttcaactggcttcaaccatgcagtgagataacagtacacatctaaaacaagttatatgccatcaaagtaagcagatgcaccagaaaaacttggtccccatatttgattggcatatgttagctcgcacaaaccaattgtacaaactggaaattatcatggatttagcagaaggaaaaattggaaagcggacgtgttcaaaaactgtcacagcagccaccactcaccagtcatgccgacccaccaaccagtggaaagctgtgagatattctgcaaaagatagaagtgcgcggtatgttatcagtgcgccttccttctgtttgtgataccttacaagtataatgtatcacatattcgcattacatacttcatgctgaatcagacatccagatatggataaatttggttcaggacagttatcaaaatggtgatatgtggcaaagcacagctgtgagcaagagttaaataaggttaccttttttagttaaccttctaaatagacaagtacaactacaaatccttaatattatagacatggcttgaaatccacattcttcgtaaagacaatgcaaatggtccctaaattttgcagctaaagattgaataggtcacttacaacaagttacagttaatttgaatcgacatcaagcatcagtgcaacacacacttaattcagagaacgtctctgcataaccaaatcaaaaaggcaatgggcagttgttttcttgaaatactatccgacatcccattttctcatttcgcccatatgcaacaatgtcggagatgctaaagtgccacaacctcatgccaaataacccatacagtacttcatatttcagagctaatttcgtgcccaactgagaatcaaatacctgcaagctgcattgacagccccaaattaaagaaagaaagaggtgatgggtgtagcagcatacctgttccagtacgcaaccgtcattgttgttcgatcggcggcacaatatgcctcctgcaccccacctccggtaacagcgagagcattcggattggggccgcgaggcatgaggggagttcactcgctgaggagaccagcgcggctggcccgagatgagactcggaagccaaagcgaccgatctactatcctcctgggagtggcaatggaggccggagaggagtggggatgcaaaggggagggagacgagcggccacgctgagccagcccgaacacagtcgcgccggcatacgaggaggcgaagagaaatccggcgccacccacaatcgcccggcggcgcgagagcgccgagcagcaggaggccacgtgcccttgcagcgagggttccgtttcgcggcgtcaaggcgcagtctctgcctgtgcggcgggtcccttggagatgggcaaacgaggggagagaatgggggtggaacaccggagcggcggcggcgcagccggcggtggtcgccggtgggggtgatcgctgcctctgtcgccgccgcgacggggaggtggcaaaattcggcaacgaggctgtgggcttggactcccagttgggctttcggcccagataccaacgagtcccgaagagcccaatttggatttttcccacccacccgttgaactttttttggaggaaaaccgccagttcgaatctcgaattttgaaagccaatagaccactcagctgatacatcgttcaaattacgagcattcacatggagcgcgaaattgcgcagtttgcaacgaaattttcaagatagccgcctctcaaattcaaaaatggatcagcgcatacaacatttcaaagcgaccaatggatcattttttggaagacagcaagtcggatgtactaatcaagagagaaaatgattcatttaatccaaccatccattcactttgcacaagcagaaacaacgaagtagtacaatttccgcaacgaaaccctaagcaacgctaacggcatcagatctggatcgagcacagggggccgggaactcagccgccgaagccgtagagggtgcggccctggcgcttgagcgcgtagacgacgtccatggcggtgacggtcttgcggcgggcgtgctccgtgtaggtgacggcgtcgcggatgacgttctcgaggaagatcttgagcacgccgcgggtctcctcgtagatcagcccggagatgcgcttcacgccgcccctcctcgccagccgccggatcgccggcttggtgatgccctggatgttgtcgcgcagcaccttcctgtgccgcttcgcgccgcccttgccaagacccttgcctcccttgccgcggcccgacatggctgacgatgcgtaagagctcgaggtggaagacgaagacgatctggaggatttggggattttgcttgtgagatgcggaggagatgggcggggtatttatagcggtgggaggaggcgtttgggcgcggaggtgaaaatggagcgatccgtgggaggtgggggtttcgcgcgatggatcggaaatggacgggtatgattgggtacggcttgggaggacggatcggtgacgtggcggggaggaggggttcgatccgtgtggttcgtaaatggagagaagtgattggttagacgtgagaaggccggatagatgacgtggcgtcatcggatttgtgaagaccgggctcaaaacttgggctggaattcgtgatttctcctttggacttgggcttttagctgtgggcttgcatctactcttgctttggttgggtacttgttctactctttgtaaatacttgtgcaccttttcacttcttttctatcagtatatgaggcaaatttcttgccttcatttcaaaaaaaaaaaaactacacttgatcacagattcacacttctagttagtgatggaaaacgaaaactgtgtcaaaaaactgtgaaatgtttgttatgaccatccatggattgccatctgaagatatggtcagtagatgattcaagcatttgccaaaacgcataacatattttgaagagaactatccaaagttctctacttctcatgtacacataagagacaacagctatgtacacagacagcaaattggtatatcaaagagtgcatagtctagtgatgtattctacacctctcagagaaagtacgaaattgtactcatattcagctttgtattgcaaacaagtacctagtctatcaaagtatttgcatatacagataccagatattacccatcttcagtacatagaagaactactgaaactgatgatacagtccaagtaagaactgggaatgctatacccacaagaaaaataaaacgagaatactactgaagttaatctcaataggtaatttggtatgagtgtttggcttctcaagtacttgcatactcaagtacttactccactcatcttcagttgtccagcggatacatgatgtgcctatcaaagaatttgcatatagaagtaccagattctatctaacttctgaaggttttggctgtgtacatccgaaatagatgtagaggccatgttctttccattatctaaaaaaaaatatcttctgtagcttttggcacgatccaaaagaacaatacgggtgtgtttgtttgctcgtatccatctagcctggctcatctctcccatcctggcttagtttgatctggttgaggggatacatatgtagctgtttggttgttatagattggaggtatggatacctcctttctttgagggtaagattaccgtctataactaatggatgaaattttctatcatctcaaagctgatcgttttacagtatatgatatcgatttttaacaaatgcgaaatatgcataggattgtattagtcagtgtatcactgtatataaaatcaagtcattggatttcttacactgacgaataaaatagtatatgaaccacatcgggtgctacagtattgcatcaactttgttatgttcaattaattcatccaagtggtgagaaaaaacagcaaataaataaaaggaaaaagaaggcaggtgactgtggcctcgtcgccgagacagccaactacgccgcggtggcagggcgtagatccggcaatagcgggatcctgacgattttcgccgccatcagtacgtccggatccggcaaccagaagcctgaggccaccagatcgagctcctgggctctggatctgacggaagaagggagaggaagagggcccgatgcagcagctatagacgaaggcggtggcgatggtggcggtgacagcggcgactaggaggaagatccgggcgtcagcagtgacaaccctctctcgtcgtcacatctggattcggatgaagaagagcaagtggcatctttggtaggagccggattcgacttcgacggcttcaagcggggctggatttggcggcggcggcggcttcgaggggaggggctctagcggttctggttgaggaagcttcgatggctttgtcgaatatggcacgatgatggagatgacggcgacggtgcggcgatggagacgggaggcaccgagcgacaaatgagatgggaaggtgagcagaagctggaacccctctcgcctcctgcacctgcgcgtccccgagcttgcacccacgcgtcccccgcctgcacgcgctcagcccggatgaggagcgaagctcagatcgaccgtttctctcggacctggctcggaagcccgatttgcacgcgtggagccaggctcgggtggccgtgcaggcaaccaaacaccaaaggcctgcacccgtggatgcgagccaggtgcgatgcagagaaccaaacacaccctaagtcaatccagtggtatgaatgtctggctttgcctggcgatggtgattttcatatcaccatttgttcctgatcatgtctgccctcttctctataacagccaggtgactgatttacggcaagacctcttgacatctacatcacagaacatctcagggagaggacatcaagacaagattcattgtgctgattctgcatgtacagtgagcttctgaaaaatcaacttcaattcagcatccagatcgcccttgccaatcttgtgcaaatctttgataactctagtgtaagcagaatggtcaggcaagagtgcctccttgtgaattatttttcgagcagaaatttcgcctgtgaatgtgatttcctaccacattacacttcaacacagattcactattctaatcagtgatggaaaaggaaaacagtgtcacacaaatgttcacctgtccttaaccatctacaggctgaatgtaatggcagtatggaacacaagtaattttcctatcaaagaatttgcatattcaagtacttgttccactcatcttcatttgtactgcaatcctgtagataagtaatgtccctatcaaagaatttgcacatagaagtaccaaattctgtctaccttcagtaggaaaaaactaccgaaactggagttaaaatccaaggaagcaatgtggcaatccagtggtacgattgtttggctttgcctagtgactgtctttttttttctgcaggaaatcacatggtcctctctctacatgacaacagcttgcaccatttgtgcatgattcatgtctgctctcctctttatcagccaggtgactctgatttacatcaagtccttctgacatccacatcatagagagaggacagaaatgacgcaagacaagactcatcacttgctccaagactacttgaaatttcatcccgctgattctgcatgtacactgagcttctgcaaaatcaagttcaattcagcagccagatctcccttgccaatcttgtgcaaatctttgatcactctaatgtaagcagaatggtcaggcaagagtgcctccttctccatcaattcatacagaattcttcctgcatcaacgatcatccctgccttacacagtagcttggctagcaggctgtagttcctgttcactgagcgcctgtccctggtgctcatagcactgacatatctgcaagcatcatctattcttccagcgtataagtaccccttgatgaaggctgtgtgaatcgtaatcctcggtgtcaatttctccaagaacatctgatcaagaatccgcatggctgaatccatcctccccgctttgcacgcatggtatgctagaatctcgtaggtcagcgagttcgggatgtcgttgtgttcagacctctccatggcctcaacaagctcacaagcttctgcaaccctgccgttcttcagcaggcacccgaggaggtagttccaggagttagaattcgggccgaagcccgacctcctcatttcgtcgaacacctcgcgggcgccatggaagtccccagttttgcacttcacggcgatgagggcgttgtagtaacgtgcccccctcgccgtctcctggatcacagacatcgccgcgtcgaactcaccgatcgaagctagcgccttgacgagcgagaacacgccggacgcacggcaagggcccccgacttcatccagcgtcgctagaatcgctatcgccgtatccctggcgctgccctgggacgtgttcaagaaggcgaacgcccgttcggtcaggggaacccgccgcgtagacatgctctccatggcgcgggacatggcccgatagtccgcgaggctgccggcattctcgacgagcaggttgtgggcgtgggcgctcggggagaagcccctgcggagcgcgagccagtcgaagaagcgggccgcggggaggccgcggtcggtgagcgcgcggagggtggccgacacgatggggtgggagagggcggggtcgaggcggtcaaggtcggcctcgaggctcctgccgccggccgcgacgaggcgaacgatcgcatctgagaccgcggcggcggcgggggcggcggcggaggcaacgctgctggtgcggggattggcgggtttggaggagaaggttgcgcggggagaggcgaggcggaggcggaggaagacggcggcggcgcggtggagcggcgggaggcggaacatagagaaggagagtggagagtggacacgaacgcagctctaccgccgcgcacgagaaatagcgaaggtcacgcgcatgagctgagccctctcgcatgtcagtgtcacaaaggtgtgtactccctccgttaaaaaaaaactaaaattcaatttgacacattttacttactactatatgattatagggtcaaaacctcgccttagttacgtgattaaattttttttgcaaggtatgatcaaattgtggtaaattttgctacaggacattgttattctatggttttagtcgtaggacactgcccaaactcacttttagagaaaaacacggtaattagatattttccgtagtttggcacactatgcttatataacagccatgcgaaaatagcttcgctaggaatttgggaatttcgcttcgcccgtagagtagtaagaacaggaaacagtcgcaaggtcaacgttttacatgcaatccgaaaaaaagaacattttggagccataggtaatttgaacttcgaaaaaatcattctctaagttaataaaatggttgttcattctacgtatcaaaatattaacgatcaaaagaaatacatcaacaaaatctaataggataatataatcagttgtattagcaaacatgaaaagctaactccacaactaaagctacaaaacaacagtagcaatcacaattagaagcactaagatcaatacaacaatgtggccaacaggatacatccacgactccccgtccatgaaatatatacatcctactgctaagagagaacaacagtgattgtaaagctccacgatctgaatggagatgcttagatggatgggagcagctacagtcatactcccgcatttggattgttgccagcaagaatgagagagatctccaaacctctgctgaaagcctggttaaatagaagtcgggtctggaaggtggatatgaaaggaaaccaggaaaagatggctatcgggacaaaaatgatcattcctgtgccagcatcgtacaggcgagctagagagcgcactgttttccatagacctagtttcttcacaataggtttccacgccacagcgatctgtattatatataaaaaaaagcatgggcacgaatattaatgatagaaaacaaatacaaaaaggaacatgaagtactactccatcccaaaaagaatccaaccggattgggtttttttttgggacggagggggtaggtgttaggtgcttcaaacaaagaaaatagtacaaaatttaaacttaaaataccacttgtataaagagaagtaaaaaggacaattggcattgggtaaataactactccctccggttaacagtatagaaaaatataggaagctcgactttatttttactgtcttcgaggcgagtttataaaatctaaaatatgagattatgcgtagtttccaagacaaatctatactaccaattttatgttttcaaaccaagcacttcacgatttattgatactcaaagcttccaaagtttatctggaaaacatcaaacgctagggatttgaccagagaaagcagctttaatagtgcaaggagtaaggccaaaagaaatttgggaggttgagtacttctgtgaaatactttaggagaatagtgaacttcatgaaacatattatctgctacgcaggaacaattttcaaaactgagttcacttttgcaccatcctgtctcagatggacattgatgtttctatagaaactcaccgaaagaactccccagccagttggcacaaatgctaagatggcagcaaacacatctttgacactaaggcttgtaaacacaactgccacaaccaagcccgccaaaaccatcagtagcgcaatgcttttgataagtcggaggaacaactggaaatgcaccatcgccttgggattcaaaccgaatacctgcagattaatacaataaagaaaacaagttaatatccagatatgtgatattactcagatacctcatacagtaataaggaattcacataccagtaagaggacaaaaaggccaccaagcacagcccatgatatccaatatatctacaaatcaaattaaatgttccattatattgtctccattaactagaccaataagtgaagatcaaaatatataatcaaatagtatgttaccaaatttctgattacaaaaatatatcagttctttgtgttcaatatcagagtattaatagcacattcaaataaaaaaaatactttcagaaagtaaaaaaaaaaaaactgaaacatatttggtcaacgaatttcatgccaacaagcaaatcaaatggatgctgaaaacataccaatagtgctttacttgattcgcttgcatccatatggtaaacaactccatactggaagatgaaaaatcttaaactcagtacagtttccagtatcctcccaccaacattgtgaatatgtgcctgaaaaagaaatgttctgatattaactatcattcaatgacttcaagcttggtaaaagcatccattttggagctcatcattactttcgtcaattcagtcatatgctaagagtagaaatagaagccaatataagtgccagtaactgcagaagaggaatcaacgaaaagaataacaaaagtggcctcaagaccttacaacaaatgtgacagtagattctcatgatactgtcaagctgcaataagattactccctccgtccacgaatataagcatttctaagctgtttagtagatattaaggttgaggagaaaagactttggtggccctccttaaatgagggatggatggagatgggaggatggttgggggtaagatgggaataaatttgagtgagaggtgatttatgtgacaagtagcactctggaatgcttacatttgtggacatatgaactagtgaaaagaactagtttttccattgtatggaacaaaatattagacacaattaaaaatgctaatcatatacaggcaaaattcagttaccagttcttcatcccaccaggcttcccaactttcttctcccttaaccccaataccacctcggtaaaacagccaattcgtccagtctctgaaatcctcaacgaccctgagagaggtattttaatcctgataattcgaatttcaaatataattacgcagagtaacacatgcatagaatgcttagcagcttacttctgccattcaaatccagatggattgaatatgtatggagcaaaaagccaagaaactgccataaaccagctacttatggaaagcaaaatgtagccaactgctccaccattgttaaaaccatacgctaaaaagatcactaacaaaagagcaacctccaacctgtgaaaaacaaaagcaatcatcacagactgtagttgcacacaattttgagagcaaaatcaggtgataacaaaccctttcacaaaatggctcctggaataaagacggtagttttcagcaaatttgatatgtcgtaccacaaaacccctaccggttgctctatactggtaatccagaagaaacacatcagatcaatacagagtaaaaatcagaagtagataagcatcacttaaaaacaaaggaccctacctttgcaccaccatgtagtattgtgcggccaaaatagtgggtccttgtacccagggagaaagtaaaaaatacagagcaaagttggaactgcatcgtgatgaagctgacaaaagcctgtgtcacacattcaaatgtaaaaatgcatttctccaggcaaaatatattagacaataaaaaacaacataggcaaataaagctaacaaatgcagaaaaatctatacgagattagaaaggtaagctccactcaacaacaaccaactttattacaacagccaataggtgaagactctttatgttgcagtgaagcacattgaattcaaaaacacaagattgaataaatgaagactttgttgataccagaagaaaaatgacttgagttatatcaaatactgtgttgcattaagaagatgttgaaaacatttcttaggaaaataattccatggaagataattgaccatgagtgctcagatggaacagcttaggttatttgttggcaagataaaaggaataccgtcaagacaccaaattccaggatgaaacccagaatcataggaatagcagtaaatacaccaatctggaaaagaaactgtgtgttcagagctgcattcaaggctgtgttctgcaatatatccaccctattctgaattgattctccaactccagacaaagcctacgaaacaaatatagaaggaatatgtcaactagtacaatataatatcctggtcagatatggcagaaaaaaaatgtcacaaactgaacccaagaaactggaacgtaaggtaacgaaagtgcaaaatcgtgaaagggtagaacataaaaggaacacactgagtgaacatttataacaggattttctagaaggtactagcaagaaagttaacgtgcgttataacatctattagctttacaggtgcaaaagtagaatatagaaggcacacagcatgcaagcgttgcaccacccaataaaacagtgcttatgcctccagcacattttacttaaaaaatatattgtcttgcgtggttaggaatgtttccaacttaatatacaaaagataaaataaagaacatagcagacatagaacaatgcaagcaagatgcgttaattaccaaaaaaaaatcttaataacaaacttcatacaattgacagcatagagcaatctgagtgaagtcattacaaaaggtggacaataagcaagtaaagtgacatgttattatagagagatgttaatatcaaagaaagtagaactgattttctgccttaccagataggttttcccatagagaaatatgtacacggtccaaacagttagctgcaaaagagcaaacaacttaagatcagaatttattttagaataatagaatcatgattgcagattcagggggatagcacctacaacaagatcaatatgtagcatcaataatctatttttgtacaaatttaattttatgcatgtacttaataatataataaaaatggtaccgttcaaaatcctatgcatatattaattgttttaggtcaagctgctgtattgtgggcaatctgaagtcaaggaataatgcatgttttaattcatatgttctaaatcacccaattgagctgattagattcatatgtttttagatttcctcctggtcaatactgaagatgtcgcaagaaagggcagaaaagctacgttggggcatcatgctactaatcaaggtagcagatgaggtctaattatcaagatttggatggagaccaggggctagatggctggaatgatggatggagcccgaaggcagagaggtaaaaattagaaattactgaaagatgctgctgtttgtctgcctgggaagtagttgctgggcttattgttcctttggttgtctagttgaatttcaaatcttttttagctgggttggccgaagaacaggccaacctaatagattaagattgtgggagaaaatttaaagaggacaaacagtaagctgtcgagagagaaattacaaggcagtgcccaggtcagcaccagcacccccacagcctcaagcagcaagattagtcattttctaaagtgaaaagacctgcttctctccagactaaaatatcatctgcgatctcagccacaggttgattcgctgttttgtacttcaggttgaagatatgtgcatttctttctttccaaattaaccaatagatcatcaggcacaaggtatcgaaggccttgagatatttagttgcccaggataatcatgtgatcaaccaccagtcccccagaattacttctggtttgctttcagatcgtcccaggttgtgtttgtagcaactttattgagttttcttagtcttgttggcatcaatagttgtgacagggatcggatggcatcacaattgtgacaagctgctggcattttggttttgtttttcctcttgagctgtaacctgatggccgttaccagttctactgaaatggagatcagacctctctatttcaaaagaaaaaaaaaagagaatctactgacttcaattttgcattatactccattttttatatgatgtttagcatcattgaactaatcaacaccattacgccatataaaaaatggaggtagccaaacttttaaaagttcaactaaagacattctaaagtgacatctattcgtgaatgagggaataacaagcaaggaaaatctaattaccatggtgcagaagtagaacccaatagttgtcacatagaaggacaacatcctgaaaaagtcaaaaagctgtccaagtctgtatatatcccggctgagcacttgctcaccatttcctccagcaacttttccttcgaacagtgcaatctgattaagaccaacgtctcttccctttccaacctacagaattatgtttggaacatcaatataatgctcgcaagacagcaagagtgttggcaacagttatataatgctagagtagatggtgcagcgaacaagtttgtttcacattggtagcaggagagcctgtgaaacaatatcagcatagaactcctggtgtacatacagaatagaaggttgcaggtaataaaacattttgaaccaggtgaacaaggcttttcccaccaattctctccctaatcaccagcaacaattagttcgggaaaaaaatcaccacgaacaataattagtatttgtggtaacgccacgaacaattttggatagcaaatcaacagtgcgatgttggaatcgccaacaaatcaagggcaaatcgatgtagtcttgagtttactgagaatattaactcccaaatgtaagaaaccccagaatttgtccaattacagagaactctggcattgtgaattttcctcagatactgatagcgatagctagctgtcaccaaatggaagataatacttcttcacattactggatgacctcagatcaagagttttaactatctcattttacatgaacatcaatgatgtatgacatacttcttccaaaggtaaatgagtcaattcacttttgctattaaatcaatcctctgttatgttacttttaaataccaaaacatcctccccccccccaaaaaaaaaaaaaaagtaaacagattatgagaccaattgacaaataggcgataacaaatggaatttcctttttaagatttttctggcctaccattcagagattaaggtattcttgactgataagctagatgttagcgcagaaaattcaaaacacgaatgaagaaaattcagacctgaatatattcatgatgagttatgttccctaagcgcagagttgagttgaaccctggagttcatagatgcatcagtaaaaagatacaataccatgaatgtaactaaattacagctaactgttgtggtctgcaatttgtaaatggtaggcagaaacaggaagattattgagcatatatggacaaagtgatatggttataaccaaacaaaaatatgcattgacagaacctgagagagagaccccctacaactaaaacaatataagaatatgcacagcattaacaacacagagaactacaggtaaaaatatgatagtttacaatgcgcaagcagcttatactcattttttagtctctaggttaccaaatagcctcatttacagaaacacacgctgagcattagaataatactacatcgaattcactagcgagaagagaggtataaagtcatttttgccctactaactagcacacaggctgtccacacagcaaatgccaatttcacagaatgtaatgggctattattaataatgcaacctgaaatagactaaacatgcaacaaccagaattgagaaaaagacagaataataaggccactagccctacctgcataaatatcctcactgatattgatgacacgggaggccttacttattccacccctcgttatatgaaaaattctatcaaaaacatctggatggccataatgcattcttactctgcaaaagaattccaaatgttgacagtatgtaacttgaaatgactcatgaaatagaaaatatatattatgtaaaagcacttacttcagtggattggccagaacacgctgtcccaatgtgacaaaactagtttcctgattggacataaacgaggccagcgaagaaacactacaaaagagagattgtaagtttgaactgagatgactactgaagtaaagccacaacaaaacgactgaacaaaaatctagtgaaacaacaccttcccgtgaacacgtgttctctaacaccaagaattgaaggcttgtgcttgccatgattctgatagaattcctcaagcaggtttctcattttgagtgcctcctcaaaatagttatccttcaataggacaaccaaaagaaaaactcaaaactgatggaacaaagaagtcaggagctatttcagaaacaaaaatggtatcttggcaatagtaagaagaggtgcggtataggagctatttcaataacattttttcccataactatagcctttttagaaataaaaaaaatatgcgcataataaaaacttcaaaaaatgtgaaaaacattgtattgatatatattgagtcaccttagatctgtaccattcaataaaagaggctaaacatatagtaagggattacaaagaaatgagctgagcaagtgcttttatttaaatattggggaaaaccaaggaaggtccatcaaataaatataatatacataatatttgctcctatatgtataaggaccaaacttcgtacgagagctcgtcaataatcaaaatataaagacaacagcatacctgattcatatcaatggtttgcactgcatttccacgggtgaatattatggcatgattttggttttctggcttcccctcacccagcttaaaattgccaggcaatttaatggaataaatttcctgcagccaagttatttggtgcatagaagaattaatacgttactcaaataaccaaacatgatataaactactttagctgatgatatttacttaacaagggaaagaatggtatactactataggagagcataaataaacaattttatggatatcaagtgtcaagttggatacaatgaaaacagtatgaaaaacaatgcacagaaggcattaaaactaacttaagcagcagaatacattgttagcagtaagagtgtacaaaggcaaaataacgtctgaaacctaataaaacaattaatagtgttaatggagaaggttctttcaatagataagataagggtaaacaacaattaggcggagaaaacaaacttaaaattaatttatactgaccttgtcctttccatgaatgtcagctttaacaagctttgagtaatactcggtgctaggctttccattcttaacgctctcaacaatatcaacgtaagcaactctgagtgcttcatttctgagaaagataataataaaacaaatcttatacgcactgtagtactatgaaacacgcacaaaataaaaggagagcaaagagctccccagattctacaaagtggaggaaagtttcatttagcatgaaagcaagtaaagagtgcaaatatgtctaacatataaagtgaagagtacctttgcattagtagagctatgtctgcagcttctggtttcctctctgccttctgtaccccatatatttggcaagtaaccacatatgtaaatttcaaatcagcctgagcacgtgcctcaggagacagctcaaaatgtatatcagccagaccaagaccagttgtagcaactgcagattcaatatctagcaaaggaaaacaacacagcaggttatttattacttcataaacaacattaatgtttcttacagggcagtagtagaaataccttcagattgcaacttctccaaataactttgcagcataagggctttcctatagtacatcatcccacgaactgcaggattaacatagttcaaaaacagtgacattttgaagaacttgtagaaccaaaaggttttctttcatcagataaaagaacagtaaatgaatgtatcttcaaatcaccacaattaatatttttaaaaagtatataatggacacaattttcacggtttaacaagtgtgaacctttggggtggcaaatcatcaaaaaatcatgctagtaagaaataaataccatggaaacgaaacactagcaaaatagtatatggcatgaccatataggtttcgaaagataacaaaccagttcgtgctaaggtctgtccacggtaagaagcccacagacgtagttccatcatgtcattagggctactaaaaagttcggagtcagttgtgttttcatccctgttaatgcgagcaaggaagttcttccattcatctgtttacataagccaacttcattagactgtgcaaccataataaggaagaggtaattacattgcattgcatccttcaagcacaaatcacagatagcagcaggcacttgcactaacttttaggcattggcagtagatgccacaatttttccttctagagcaaactgtaggaaagccatcttacaagagaaatccaaacaatgctttcaatagtaacagtggagggagagtgaacaaacctggataaatcttctgtagataaaatagtgtacttataccatcttcatttctcttctggagttcatctttactataaagaacagtctcggagtagtatggagtaaatacgctgcaaaacgaagtggtgcatatcataggcacagaaaacaggagcaactgaaccaagaaaaatagacacacaaaaaggaatgctcggcaaataatagaaattttaacatcaagattcacgagatttagtcatctcaacatggctttgaacaaaaaaataatttgtatatagaataatatcaggaattcatatctatatggcgttccttcctaaatttcatcagcaaaaaattttagcagagttgcacgatgagcccccatatcgccataccggcacaccgtgccactaccacatgcatcatcatgccctacctccaaaaacatcgcttatgaccttaggcaccctatagtgtgccataccacccacctctttgaccacaactacccttcaaagtcatactcagtctcagaatatgttggtggacgctaaaatcgcatacgcaccaacgttgccacaggatgagacaaaaaggcgccaagggcatcaagttggtaaggtgggcaaggtcagactaggcgtcaaggcaacgaaggttgcccatgatggccagcagactcaagaatgcaaggtctgaagcgacttgtggtcaactttgaacacattactaaccaggtttatcattattctttgattccagcaattaaacacatgagtgagtactagtctaagaaaaagaaaataaattaaggggaggctggttataggctgtttctacagactatcggcacatttctgtaggatgagacactgaacagaagcaactctgaactgatagaacaagcagaaaactgtagagaagtctcacctgaaagaaagcatttctgaaacaggtcttgcaacaggcatttgcatgaacagagagtttgtaaagaactccaatctccgtctagcttccaggtttttaggaacatttgcagctgactccttgatggtcagaagagagtacaatcgtttgatcaagtccttctaaattccatgaaaccaacacagattaaattaatggttataaagattcacaagcagataatgtaagaacattaaaatttaacaagaaaaaccagtgttaagacaaaataccaatccagagtcagttggccacttgagattattgaagagacggccttcagctcttgcttgcttaatctgttcccattcatcaatattgccactagaattcataaacaaaagaattaggaatgaaatattataaacagaacacagctttgaaatattataaacagaacattagaacaggataaattgtaaaaaaaaacagacctcatatcaacagacagcacttcatgatgaacaacttcatatagatcttgaatagcattaattgcccctttcctcagatcagcagactcggtttctttctaaaaagcagcatcttaacattaacaaatactagaggagcctggataaaattttcaagcctaaaaaggcataaaacagaaaataacttttacaaacttctaaaatatttaagattcatatcatcccctacagtacttccaaaaagactgggtcccctgagctttaaaccaggtatctaaccttcacaattctagaagtcagtatcaatatattataacctttaaggctcaatttcatagtggtttaaccatctggaaatagatttgtgcgtatgtggatattaccataagtcctgatgattcattaaaatgtacaaagaaaaatcgtcaatgatggagggaacttcagagatgcaatgcaagagatgtggtttggttgctttacatgagatcgtgagttggtgtgcgatggtgtttgtttggatcatcaggaatgtaggaaacactagttaacgtaagaagatatctatttagtattaaataattaataaaatttaatacccttgttttccaacttaatataaaataataacccttactgtgcactaagcatgtcatatattgtcttaacctggcatctcactgtactggccccagaaaaaggaaatttatctgtgatttttctgggctaggccatgtgggaaactattcaccatgtggatccccaaaccaggcaatcaaacccacaggggtatatcccgtaggtattcaatcacgcatgcccttagtaactataacaaacttttttataaatatgtatctctgaagtacaggactttggtccagcccagccgcagacaaaaataattcaaggttcagaacaaaaaaggcatgctagtgttgataactcatgtctatacgatgaaccacaaaaaaacttcaaggttattagagttccagcagacaacaaataaacaacataaatatatcatatttcacactggaaggctggcaaacagtataaaaatggcagatggaagcctcaagttttttaacattatactcactccagcctccatttttcttctatgttttagaatctttacagtcaacctttttatatttcaaccttgctaggtcatacaagaactttattacgatttgtagctatagggggggtagtaattaccaaaattcctgctacagcaactaacttggcaatgacattgggcaatctgctgaaatgaagatcactctgaatgttcctcttggaaatgctttctcggataccaacataaatcctctccaccctaaaaaaaataaaatcatcaccaacacatccctcccacggataaaaaaacatctgttgaactagatgaaaagaagtaaggaacaggatgaacataaataaaatcccttaccagagacgtccttctttatctagtatagatgtcagaatataataaatgctgtgatagcactctacaacagcatattgcatgtattcatcctttgatatccttagccatagttcctcttgtgagtctttacaatcaattgcaatatctttggctaagaaaacctgcaatgaaaatggaagtggtcgccaaagtgacaaaacgaacataagatgcggaaatcatcaaatcatgcagggagagctttttaaaagctaaaataagttttgacttttgaccttgctagcaagcaaaaagagaggccactgcacaattggaagagatccattattcttaggcatcaagagtaaatccagttcactgtaaggatgaaagatcagaaaaaactcatatctaattaagacgtttgaaagaacagtaacatagtattccaagaaactttacttacgtgttattaatataatcctcttccctcatattcctcacaatttcgttccaaaagggagcaaatttagatgcatcaaacttgtttaattctggatgctgttaaattgtgaataccagtgtcaacttattggaagtaaagataaagaactggaagaaagcatgctatatctataatttatgaacaacaaaagatctctctagcttgtctaaactctaaacacgcatagcagtcaagatgaaaacactcaggaacagctcaactgatctgagctcaaatcaatacaaagatatttcattcaacaaatcatggctacatagcacatgcatacaagcaggacaaccgaaaacaaaatatttataaaaaaaaactgtatcagataacctgcaaatactaaaatgctaaaaaaatgccattaagggaggatgtgacttaaggcaaaagcagcagatgactggtaatcgagggggttaggacgagagtaatcatgaaacaacattcagaggaaaaagacagttatgtggaaatacacaacattcaggaatgcctatctacttaagtgaatcttttaatggaaatacacaaatggaaccacaatgccatacttcttattacctagtataaaattagcggagtagtactctagttctgttttttaaaataaaaaactaggggggaaatactccacaaatgtagaaattcaagcaaaatggaacaattactttaaccgcatatccgtttacaaatactaggagctataagaaaattgggcatgctcatcacgaaagtgctttcatcatagaaatccctccgaattcgtttttcgaactttcttatattgtcggatggcagttagccaaagctggtttgaaagtacaagttttttactaaaggacaatatcatataaataaagcaacttaagagcgttattgaaagataacaaataatgtcccacagctccaccaacagaaaagatagaataagtaaacaagcaaaatacaggtaacaagataatagtacctgactcgatgatagcagctgcttcctgtataacagattagaaccactttagtgtataccactcaagtataaatcaaaaacaataaaaacatcaaagaccttttcggtacagcaacatggagtttatccatgaatgcttcagggaacttctcaaagaatctgtgaactgcttcaacagacctaatctgaaaatggcatacaaccaccagataagaaaaattgacaaaaaaaaaaaaagcaaaataacaatcgaagtactagctatacacagatgaagagccaaggaaaatggtctagaaaaaaacatgcattttacataaatgggcttaacaaaattggtacaattactttcatatgtgcatgttaatagtacaaaattattttcaagtgcctttccacaaataatgcattttcataggtagaaacatcctgaacatttcaatatgctggagaatttgggatttggtaaacaagcaaagatttcctcgcataaacaataacaattttacacacaagagagaatcacattgcaatagctcaaaagttaaaagtcaagaagctaaacctctcccaggcgatcgcgtgcaccaaggagaaacccacatatagcagacatcacggtgtaaaatacatggatatccaaaaggtaaatctgcataaatgaaatttctctttagagatgcatttttcctatgttcactgcaaattcagcagcttcctgtagcacaaataagcgtaagaaatacgagtaagtgtgggataagcaaagcggatgaaatgttaaacaactagaatgtgaacttgcccagtttgattttttacttctgattgtgttgaatagtgtatcggcaagttgtttcctatttatttgttagctacattagatttaactaagtataagtatctctctcatgttggatgttaaagaacaaaacttataaatatatttgccatcctttcaggttcagcacactggagttatgcgctgctttggcatgttgtcatttactccctctgtttcatatttgcacgacgttttgacttttttctagacaaacttctttagtgttgaccaagtttatagaaaaatctagcaatatctacaacatcatattagtttcattaaacgtaacattagatatattttgataatatgttcgttttgtgttagaaatgtttttatatttttctacaaacttagtcaaacttaaaaaaaatgactaggaaaaaagtcaaagcgacttataatatgaaatggagggagtagatattattactgctccagaattagattatttactcaatgcaaggacatgatgaccctgaactcactacagttgagagagaacaagataaggggatgggacatagtataaatgtataggacaaagttaggagcaaaaaaggttacttactgataccactggagcccataaagaaagaatagttagagcattatggttatctgtaagcattaagaaaagtttcaaatattagtacattaaagtgcatcattacacatgaaggaacctatggaaacaaggtagacaactagaagtagatttcatgctttgcccacaaacatctaggacagttgcaacttaaaagaacatactaagaaaattatttaaaacatgaatattagaaagagataagactcaaacaactattttcagctacacaagaatatggaatatttaggtatcaagttgtatgaggatgtgatattcttactcttcgaaacaaagtcatgccaagcatactctaagcgtttgaaattgattatttccattgttggtttaacaagaggttcgatctgcataagaaacactattttgaaatgcaagttgatctggaaaaaacagaggggaactagataaactaaaactttcctggagaaaataagtgaatgaaaattttgcgccaagaattgcaagccagaaagcaacatatctgcatggtaaataaagttagcactagtctgaattcaactttggaagaaaaaaatcacaacactgtgattcaaagtcccaaaggattacttgatgtagtcagaaggtctttcatgcatgcctctcccaacataattgttctccttcaatataaaccaaatgtcagaaaatattagcaaaagatattggattacaatgacttaacaaaagacagcttttagttagtcaaaatgcagcagcaagcaagacctgatgcatccactttccaaggcgtacaacagaccagcggtagcaataatcggtcaaaccgtggcagcaaggaacactcataagcaggccgataattattttggcgcccacgtatgcaccaattacaaagacatatatcttgaatgtagccgaatttgtcccatcttgaaatgctttgctgagaaacaatcaagcaaccaaaaattccaaattagtggtatacacataaaggagttaggtatcatcccctggaatttggtgcgccagcccctgaattctgaaatcaatgttggggacgtctagcaattcactagggcaaagaccccatgtattctttttcatagttgaacaaaaaaaaaagcttttcggaaatttttttggcaattatccctctggtctcagatatgaaaagaaaacatacatatataggtaacaaataaccaatgaagccgcggtgaaccaacagaatcgccaaagaactcgggtaattgcagatctacgagatgttgaataggcgccatacatcatcagaatgtccaatatgccttccacagaaaaaaaaaagggaaaaagaaacaagaaaaattagtcacttagaagagaaattgtgcagatgatcataatacagtaactaaataagaagttctgtgactgactctcaataaatttcatgatgacataggttggacccaggctgaggagtgtcaatactgtttttttgtcaaatttacgatccttaaaagcaatgatcattaatccctgaatgaacacaaaaacacttagtttaacattgagcaactaatcatccaaggaaatatcataccaaataagaataataaaaggttcaactctccttaaaaacatcagctttaagctaccatttgcagcatcttttcactataaaagttgtacatgaacgaaacaccagatggttgttgattaacatggtggttagtctcagtaaaatatatgccatgtaaaatgtgacatacaaaaaacattaagcacttgttcggacaaaagttaagattctgtcacatgtctccagaaaaactgaacacacgggaaggcaggtccccccttattatttcccattccaaaataaatagacaaaagacaaccctttattttgcatctagcacctcagttgctcaagaaaatgaaaacaactttcaggcacacggttaaatgtgagtatgtgatgccaaatgtcaagcaagatagtgagaccagttgtgaacaaaaatttatacctgaaacatcataactaaaaaaatccaaaggcgatgaaagctatggtaaagatgaagaaaagttctgtgctccacaaaagatgtctttccataatgatgattcctacccaccaagccctgcaaaagaaccatctgtttggtaaggggggaaagggttgtcttcaccacctcatcccacaaaagcacatgtagaaaaatgaaaattgggccatcccactaaaatcttgaatggatggatgatctaatctctcaatccaaatagcctatatatgcaagataattttaggtggttctgtagaacttccatggacaaaactacagtgcaatatccatgatactcatgttgtgtaattaatgcttcatatgtaattgagatcatcaacctagtaatttttttggggtcacttttctgcacctagtaagactttccccagtataccatattctcaataggtagtgcactcggttcctcaacacgaataaccctgtgttccaagtaactacgtgatgtttaagatgtgcacaacaaaaataacaaaaaaaaaagatatcctgagatgtccaagtattagcttggtagttccgccaaaatacaaacaattaagtatatgatcagcagaaagaaaccttctctttcctactaggtttagagaaaaatggattgctgatcttccatggccaaccaagctgaaaacacttcggagacctgaaaaggacagtgtggatctttatggaaaaaaatgaaaataacaacaaattaatggaactcaatagctcaattgatctaccaaccagaagaactcattgaaatcatcatagtttctccacgcagaatgtggcgctcgcccattgtcattgttggctgcttcctgtagagtacccagcattcaaaccactcaatagaagtacaaccaaatgtagcaagctaaagtagctccaagcagataccccacttacagctgcgatgatttcatacataggagaaatgacttggtcaagaaatgatacgccaccatttgaaatgcagctttcagcaggctctgcagtctgtctccgtataatctcctccagttctcttgctagctgtaagaaatataggagcatgaatttcaacaataaaagttatattccctccatccaaaaatatagtaacttctagcattcaaattttgttccgaaatatagcaacttctccgcctactgatggataagtctttggtccttggtcctgatttcttctttttgcttttgggtagtttcaccttttcaggacagcatctactcctttagcatattttcagttgctaggacagctgcggttagtaggacagcagcaattagcatctcctttatgcctcctttatgctttattcagtttggatgccctctaggacagcatcccattcaaatttcgaatttttagactaggagggtgcagcaataggcttgcagccagctatggttatatatatgtatccaacctccctcgggaaggtatggctttgtgttttgtgaatgaagaaaaccagaaaattgccccatctcgagtgccatccccttctcaatgagagtaaccattgaagttctaacacctacattctcttctcaactaatcacaaccttcccccatttaatttctccacctacttccttttctcatccaatcacaatcttaccctatttaattccacctacttctttaatgcctgtgtccaagcccttttttttttatattttcagaggtagtatttgatatcttatacaaattaagttagtcaaaggtgattagttattcaatatcaattggatatgtcacactaacaaccattccctacatcacaaatatttgtcattttggacatctgaatggcctcataagtattattttgaacagtatttctattgttatacgctataaaaacatattgaaattatattgtctctaaacagacaaatctacacatgactttcatattccaattcaaaatatttaaaggaaactgatagtcaatctttgaaaagtttggccagaagtgtttcgagtatcggtgactacagagagagaagaattgaagaccatcagaatgaacagaattttgcagatttctttacttagaagaagacatgatcactttagaaactgaaaatgaagaatatgctaatgattaggggaaaacaattcaaattccaagcatagacaacagtgcgctaatttggcaacaaagtagtagatcagggagggaagaaccaaagaagaatatttttgtatgttaaactggcataggcatgttcgtagaaaaacaggcgcagatcgacctaaagcttctttgggtgcaatactacacgattgtaaacatttgcaataatcaattaagcatgcacaaaaaatagtacagagcagaatcttctgcaaacttacatgatgaaatatatagcataaaccttctggaagaaatcgtacgttagcagcctctccccaaataaggtagtataagcacacatatagcaacttcttttctttcgtcaatgactcggtgctaagagaaaatcaggtaaatctcttggtgataaataagatatagacaggaataagaaattaaatatgttgatcaacatgacaaatcatacttgttccagacagggggaagcggcaaataattacaccatttgatgtagttatcaagggacttggagaaaacaacatgcacagctccctcgtcgattttctgccaacaaataacaacaatgctaacgaactaaggatgaaaatattaacaacataaagcaacatgcaattgagtactctttgcaccaggcctggtattaaacggtgcaatatttcagtggtattaaaaagtacccagaacttttgccagtaaatatctagaatagggatcactctatgccatggaaccaattctacccccaaaaaaaatattgtacgacataaaaaattagggtgcaaagtatgcataccggttcattccctggtagtttccccagtcgggactgttcatttgccaacaggtgaacaacatgctcccgttgattagtcacattgtctttctgcaaccaattgtgacatttcagttccatgaaggcaacaagattctgaaatactgcagcatgtatcaagaatgacccaggaagttgtaactgcagatccacactaaaaggttgtctcccatgacgcatttccttcttaaatattttcagaataacacaggctgacatctattgtctttttcccctcattttcaaccgtctgtaatattaatcataatttttaactagatgctgtttacatccatggatctttattacttcttagcatttctgaccatatagaacgctctacattatgttttctttttatatcaaaattaaatgcttgctggaatgtattgtccaagtcagagaacaaaataaaagaaaaatatcaagatcaaggaaattacggcaaatgttctttctttttccttttcccctcatcttcaacagtctaataaaatcttggtcataatcttgaactaaatgtgagtttacatccatggatgtttattagctcttagcatttctgaccatatagaatggcatgctcagaaaccacattctacaacagtctggtttattgaaacttacattatgttttctatcacattataatattggttgacagaatgtaatatccaagatcagggagcaaaataaagaagaaactacaggtaggaaattagttgaaatgtacagtttcaactatctcaaatgtatatgctgcacatttctacataaatttcatggttactgttgtaacataaaacaacagatgggtacatgtatccttggacttaggggaaagaacagagccaagtcatgtggaaagtgagagagtgtcccattctagggttcgaccatcctatattcatagagaggttggcataaggggaaatcccccttctgccccttgactacacagcccaagcaaggataatttcgtatatcgtacgaaatacagggcatgctccatcggtatatcctccaagtatactctttggacatttcccattgggtttctagcctactcccaacactctaggtctaggggataggggtacctatgctccaacagttagtcagagcatccaaatataaaactactacctccatttcaggttataagactttctagcattgcccacattcatatagatgttaatgaatctaggcacacatatatgtctagattcattaacatatatatgaatgtggacaatgctagaaagtcttataatatgaaacggaggaagtactttgcaaatggcaaaactcaattacaaaaaaagagagaacctgcacttcctcaatcatattgaacagcatatttacaattaaaacaaactgaatcatgcatgatagtaagtcagtaacagcataacatacagtagtgattactaatactaacagaaactttttcacttaagtttgtgattaaaacatatcttctgttagcagtatcatcaatggactcactaagttataagcctacaatatgattgtggttatggttgaaaccacaatccatatagtttactacagtaggtgcgtcataaaggtacagacctgaaaaccaaatacacagtgcaagagatccagcatatcggaattcctagcatcagggacagagaaggtggcagggagccttggaagttccctatggtactgcaaagctgatatagctgcccttacctgagatgaaacgacatggaagtagtacaaccacagaccacggttatatctaaaaaatggtaaatactaacgaaaaggatcgactctaaattttacctctggaaaattcacaatgtcattagtttagcacaaagcatctagaggaataatattataagccacaacatcctctgttctttctgcatctttttgcatgactcttttcatctgaatataacagaaagggatgttatttatgcacaaaaaaatatatgaaacattttattgatctcaaaatgggttaaaaaaggagcaaaacgaattcattcaacagtgctgtttgaactcactgttaactggtaacaaaacattcgagaaaaggtactactgcctgcggacctgaggttatttgcattcaacacatcatactagcaacaaaatgtcagaaagaataatattccttgccagacagaaattattactttttactgttcagagaccagaagatacaactttgaccaacaaacaacattatgtccataagggttgtgttattaaagaatgttctataaatagcatggacagtaaatatactaacgtgttgaattccgattgtcagagcaattgtcttgttaattttacttatttgcaactagaacaatactacaatagtcttctagtaaaagctactacctgcgtcccagtatataaggatttttagggttgaacacaattattaagaaagtaggtataattaatgggggaaggttgtgattagatgagaagtggaggtcggagagaaaattgaatgatggagggttgtgattggttgggaagagaatgttgcagaagttgttacattttgggacaaattctaaaggctaaaagatgttatattttgggacggaggagactatctatgatgacaaaaaatctatacatatgcgaaagtggctatagcctagcggttacagtgctcaagtagcacttctggtcctgggttcggctccccaagagagcgaatttcaggcttgaataaagaaaaaaataccatgggggcctccctcactgtttccattcaaaagaaaatctatatacacataaaagtacatcacttcactcttataattttagtgaatacattgatacactaacactttaccagtatcttactgcagaccagtagttaaaacccattccatactaaccactcaaccataataccaaaatacatggcatggagagcagacctatttttgtttcctttttttttaacataattgaaatttagtaggaaaaaaatagcatgaactatatattatcaaggtgagcaacaaaaacctcttcagatatcaacttttctgcatcctcaggtgaaatttcccttgttatttcctctataactgaccataagaccttcaaagtagcaaggactttcttgcgcttcagagttttgcgttccaacctactcaaacaatcagggtggttaaatcacatactatgggtgacatttaatgttcaacaattgtgcttgaaaaacaagcatcttgaaaaaaaattaaactaccaattcagcattttagctaagtgacagacataatttcatagagaaatacatactctccaaggttaccgctgaacacagcagattctctcaacttcatttcatcttcacacaattcatcaactttatgcttttctctgtatagcttataaaattcctgcagtttagcaacatcctgacttcgatctatagcaccaccttccctttttgctagcttttgctgaaaaattgagatagaaataatcacttttagaaaaataaaatttaaatgtcaaacccatctgcttaatttgtataattcaacaagccatggttccggagatgtgacgtgttgtaaatgaggaggactcacaaggcgatattgtatgttaaaacactagagcgctggccatatgaaataaacattgtaaatccatcacaagaacagttcaaaatgatatacttttgtagcgctggtagagcataagattgtggcggttgacaccataggtccatactatcattctacttcttaaaaaacaaagatgtgaaatcacttatttgtattgtattctctatgtatggcttttaccgacatggtttgactgtatatatgaaactcaataaggttctatcttggaggttgtgccagatgtacaaaataacatgtgattatgaaaaataataataaatcatatagaacagtatgaacataccctgataactgacattaaacctgttttgaactgcagtacacctctcccttcgctatttggatccagattttgggctagtgtgtatgcatgctcacatactgcacattgaagtataaacacaagaaattgtcaccgaactgcatttaaacttcatatgggaaagtgaattcagttgctaaaagctgactcaattcatatcgttgatatacccttcgattttgtggagcaaaagccataaaaaaattcattgccagattagtggctgaaaacaggaaaaaaccttaagcaaccaagcacagttcaccgataaaacaaccttaagctaacatcggtttttacctaaacagggataaatactaactaatctcctttgagttagtaaaagtttactattaataactgactggagaaattgccaaaagcataggcagtagtatcccagtacagagatttcagaacatagctggactaattatgggttgtttgcagcagattcagtaagttgactgattttcaatttagcttaatgaaaagaactaaagactgacaggtgatgcagattgctaattgcagaatgccggattgtaaggcactagcatacattggtcagtgtacatccaatcagagcaaatcaagtttgaaaagtcactttaaccatgtcaacgagttgattgatagcaaactcaggcgagtaggagcacgaaaccagtaaagcattagtccgactgtaacaactaaggccatgtttctttcagcttaagattattatgatctagattattgagtcagattactataagctagattgttataatctgtagtagaataagcggttagttgtttctttcctaaattattagagcatagattattgggtttgcaagtctaaagagggagcggggtggcatggtgggtaatttttcacccaataatctggaaaaagctcacctaaatgagcttatcagattataataagctggactccagattataataagctacttcaataagttgtctgtttctttcaacttgctcccaataatctggattataataatcccaagctgaaagaaacagggcctaaatacggtagatggtactaagcctgatcataacggttgacgaaatttagtagtacaaaaggctgtaacaagcaaaaaaaaaagcaaaagtactcctaatggactagcataatcaattcgtgtagccgatgctaactgcagaaaataccaggaaaaacaccactaagtgaacactactaataactgtataggtagggcaattctgagccgcggcgacccatacagctcacaagcctaacggagcgagaaatggtaacgaaacttacgaatcctggcgacggtagggtcctcatcctggatctcgtcggcggcgcgaagcacctcgtcgatgtggacgttgtttccgagagacgacggcacattcccggcgatgccggtgacgggcaccccgaaggcgcctgccaaccgctctccccgcagcgccgcccgcaccaggcgctcccagttcgccgccgccctcgccatcacgaggccctcagatctaaccacacgctcgctcgcacactcagaggccactcgtcatagcccctgctcaccaagctgcttgcgatcgacctccgcgtcgaagcggatgggagatcggagattcggagctagggttttccgctctcggcgcgcagggaagggaggtggccgtgtttcaggggctcaaacgaagaggaggaagaaagcgtggggaactggggatatgccgagactacttttttttctcctttttttttgagagtgcccttttcgcgtttggcgagaccgcgagacggtttgaaaccttttgatgcgactgcgatctggaacggggggcgtgtcagcatgtgatgccgcatcgcgcgtcgcacagggcagcccgctcccactgtcaactgtccccacacgagaatgggtctagggcgcaagagttttgcggaatttttatatggttaattaatgtaatgtaatcttcacaggttctttataaacagtatactagtagaattatcgttgattacctagacgcgtgacgattagagcagtacaataagctgacacagcaggctgcaaaaatttccacgtcatgctattcttacatggagaagagaaaaacgaaggagagagaataaagcgagcgacatatctgcagcccggcgatagcacaagttcccatgcggaaagctcgcgtgcagtcgatctcacggattaaaaacacatattgtgggcctcatcaccaccccttttgatcccatgcgccagattcatgccatggcgcggcactggtacttattttcaggcgacaacacaactacctacatagacagagttcactcttgatcatacgcaagtatgtgcatgcttaattaattcccggattatgaaactgtaattagcatagtatagccattctattgtataggttggctctattattaactgtaaaatgacatggatgtaattagagccaactactggctatactattgaccttgctcttagagcaggtacaatagcagactattagccagctataagcatattttaatgagataaaagataagagagaagagcagcgggctacagatctgtagccagctgcagcacggactccaagacacagtgtgtgtatgacatgtgggaccatatattaatagtatagtaagcaactattgtataaattagctattagattgactatagataaattggagttagtaatgggctatactattaaacttgctcttagaggtggtgtatctgtgccagtgccacctatgacgcgtgtcttgtggacttgtggtgtttccgcgactagtgtacgaaataattggcacgcaataaagacgtgaccaaagctacgcggattttgagtgcgtaaaagtcgtgtggtggatgggatcatgggaacacgagacagttcgttcgtcaaggctttcctcccggtgggctggcgaccgggaaaagctaggggaataagtctatttgtactccctcaacttttgtctttggttgaatcacgtccctcaaccgaaataccatgtataatacctccttcagctttgaaaccagggcaaatcacctcccttggtggtttagagggcgatttcatatgtcgtggcagctgacttcgatgactagctgagtcagcttgtgagtcccatctaccagcctcttcctctattctcttttccatccctcgtggcggcagcgagacaagcgccgaatgccggatggaggacgccaaagctcggggaggttgcggcggcggtgttccggctccgtccgcgtcggaacagtgatgcgcagtccactaccgcatccgcgcgctgggcgaggtaaggtggcgacactaccggtcgctgctcgtcgcggcggaggcacgccggatgagggagaaggaggcggaggcctcgaatgcggtgtgacgtggctacggacgaaggcgcttgcctaatcggtccaccgcggcggcgctccacacgcagctccagcaagtggcggtcgcggcacaagcgagaggcaaggcggtggaggacgacaacaacaacatcggcgcggcgaacaatgctgagtcagggttcatcgacccagatagagtataggaggtgaccccaccgccgtcgtcgaggctatgttggacatgttggtgtggcagtctctatcgggatgccggtttgtgcgcaggagaaggcgatgacgtgaatgaggtggcggaggagaggcgtgagaagggaggcggcggtggcagggagggagaagaagaggccacggcgatgccgaggaggcgaggatggggatgaggtggcgaggcttcttcacctctgctctctctctctctctccgctcatgccaagctcttgccgctccgctgagctcccgccgtcccgccgctcccgccgagctcccgtcgccccgccgctccactatcctgctgctcccgccgagctcctgctactccaggtcccgccgctccatcgcttctgccgccgagcttgcgcaactctctccatctcgctcgccgctagggataaagagggaggagaaaggtgactgacagatgggcccaaaatttattttattattttactcactgacatgtggttcccattcaggtttgtttttattttaataccatgtcgatgccacatgggatgaagactaagtcaacccgccacataagggccacgtaggacgaaactgccgagagagtcgatttgcaacggttttggaaattaagggatgggttataacctgttttgcggttgaggggtgcgattcaaccaggcgcaagagttgagggagacaaagtagacttattccaaatgttgaccagtcttatcgttagaccttcagataagtaggaacacatcctatgcaaagttttgggtgcacaattcatctacaccaataaaaataatcataacaaattctaagaaaaattgtagtacatatcgttatcattgtagggaaaaaattgggtaggttccatttggtgtgtggcattcggagagtttcaagatctccgatcaccaactgtaatctaattgaaacttggcggttaaaaatgaccggatgtagaacatgaagcccttacgctcttagccgtaatttttcacctccttggctgccagtgatgccgaagacatcgacggtagttggttgtggatcatcctgtaatgggcttgaaattgtccttcgagtttcttcaaacgttttcatgggatggagaaattagggttttgggaacaaaaaattcttaccgtacgagagatcatcactcatacatgggacttttggaattaatgaatgggccttagcccacttgaaaattaattctttggaaaatcacaaaagcccacctcgtaggatgacatgcatgtggagtttagtaccaccttacttattctaggataggggaacctccttaaaagggaggatgccctcctagccacttgaagcatgtgtggtggagagaagagggggaacacacgcgcgcgctcgctcacctcgcagggcaggcggcgcgcgtgcacgacgtaagcgtcgaatggtccgccaaaattggtccctcaccttgcgcagatgcagcctccttttgcagttttgttttgctgcaaattcggattcgtttttgtttttggaaacgttccgaaaaaatccggtgcgtacaaacggcgtggagtccggataagttacgcgtgacttatccggttcggttacgcgcagtggagatcgtgcgggctccctgatcaagcgacccttctctatataaaccgacccgccgtcttcacgcaacacacgcgaaatcaatctagggtttgcctcctactctgtgctgcgccatcgctcgtagattactccatcctgctcgccggcgtgcacctgcgattgggagagcaggtctccggaacctctgccttcgacgtcctgcaccgagagaaggcggcaataaggtttttgggaagcgctttgcgcgactgctccctgttcgtccgtgacggctcgtcttcctcttcgctcgcgtgctgcgtgccttcgtagacgcctgcgaaaagtttcgaccgaacagccggtctttccgccacctcggtacgtgttcaatatgttgcgcatatttgatctgttcatgttatattgtgtagtttacatgtgtagatctaataatgcgttcatgctagttttcgtctgtaatgtcatgatttatttatggaatatattaaatcattatatgcctataatctcaacagggacagtactcttatatgcgttagtgggacttggggccgggggtgtccaagaagaaagggaaaacaccttcgatcatagcgtctctctccagcacacacactctttctctctctttcacgtagacgaaggttggctactattagccagtttgtacccgctcatcttatggttgagtagcaaacgtatggtacagccattttcatggttacagactacggctcccatcggataccctattcagttaaaggaaaagtcaaattttgaattttaaacttaattttgatattaattttaatatatttttaacattattttttatcattaatttttaagttatcatgaacacttatataaaagttttacctataaaattatttttgttttctaataagccattttaacttattactagaaaatatgagcaaacaatgggactctactcgtttatgcgttggattcaaaccccacattgtgacgtataatgacatgacagtatgacacactctccttctcggacaccaattaagctgtacagacagttgaccgcttgattgtgtccaaagaataattattcagttactgtcagacaactgtttaccggtgcagtcttattggcttaacctgcacgagtgcagcaagcttagagcagtggtgttgtaatgctacagccccaagtcgtattatcgtatatacatcaaagtatcgaacaccctgaaaggatatgcacaataatctcgacgatggtcacttcagaaagaaaattacactggcccttacccaataataacccaaacaaacactcatgctccatagctaaaggactactctctccgtccaaaaaaacccaatccagattcaaatacaggattgagttatttttgagacgaagggagtacactatgtccagattcaaactcaggattgagtttttttttcaggacggagagagtaggagagttgcaaagatagtttctgcaagtcccacacccctactcaactcagtcactttgctagctagtactattgctctgtagtactccgtattgtactactgccaactgtgacgcgaaaatgtgatcagttatgagagcagtgacatcaaatgtatatttcttctgatgaatcgccataatgctggcgaaggcgactctgtctgtctgtcttctccccttgcatatcgttccgctatgcagtgggcctcttgcactataagcatcaatcgacggagctgatcatgattcatgagtagtagctgatgctggacgacaatggcgttgtttggacagatagtagcttaaagttcgtagtaggagtattaattgctttttttgtctgaatcatagcgattcattcctcaaaaaactgaaagttaacacagcttttcaggtggcgaaagcaactacagaaccgcatggataaacgcaacgctcgtcgtcagcagcatcccctttattcttcatcatgactgacacgatacaacttacaaacagtaaatcgtaatttacctctggtaccaggagaagtgctccaagctgtttttttttcccgaaaatgaactccaagttacttttagtgtaacaaccgaacatgttacctcttgaggcacggtaaatttctgtgcaattatattgcacggcttgatcgattcggggcatgcatatgaagatatgcacatccaaagcagaggcacgcatgcatagaaaaagaagtcgcaaccaaacaagcagatgcatggctagccagctgcattggcgtttggcagtgtaggcagccttccattcccgtctttgatgaccgagcaacccccgctgaattggaatggtttttcgtagacagacgttatttgtcgtatgggcgtctccatctgacggctgttccaggacaggatgggcatgcaagatcgatgctcgtgaaagcgacaagcagctctcgccgcgcaagagatgaagacgggagaaatggaaatgctggatttttttaaaatatattttgctctctttaaaaaattattttacaaatgtattcataaaaaacttattttaggaatagatatttttcttgccgccagtgatcctggcaccgagatctaacgtctgagcatcaacgatattagtgacgacactctcatccccataagccgagatacagaagggttagctcctaagaaattagcgcttaggacctatttgtaattttttttaaaaaaaagactacaatctaattttttattacaaacatgtcatcgacgttaaagttttgtaagattttttttacattttaatccttttttaaataataataataaatctttaacgtcgatccccttcacatcaacagtttggctattagggggatgactagacgagggtgtcgtcgcttagacattgaagcttgacactgagaaaaatggtccatttataacataatttttttacagtgatctatttataaactaaagctttcaaaaagtatgaaaaagtaaggccgtgtttggccctgttcactttgttgtcaaaaaaaccttaccaaattttggcatagttatcaaaattttggcaactgacaggattttttatatagttaccaaaatttagtagcaaactaaatgtagccacttttttgacaactttactaaaatttggtaaggttgaaaacggcatcaaagtgaacaggcccttagtttcccccctattcccaactttccatcacatcatatcacattaaaaactttcctacacacataaacttttaattttctttaaactttaaacttttttcagaaactaaacacaccctaaaacaaaaattctagaacggaaatgagtgatgaatggtgccctgcagctgcagaggataggagtatgggtggcctgaggtccaaatcagcagagggccgggacggacgacgtgtaaacgtccatccaggcgtccatatgattccgggcgggcaggcatgcaggccattgaatccgagtctgcgtcagcgcaatgatatctgctcctactacgcctctgcctgactgcctgcatgcgcatgtctgagttggacatgaacatgacctccatcgcatcgattgcaatcaataatcgctggccaggacgtactcgtacagtacgtgtcattggtctcctgtaccaccccaacgtagtacgccgcattcactgatccagcgcacgcacgaatgcacgatgtgatcaagatcaatcgatcgagccacagttttttttttttggcccttccccttgcgtcacccccggccgtacgcgcggccgtgcatccctgcgctgtgtttcactgtgtggcgtccatccatccaacaacgcgcggcgcgcgcggccccggcgttttgcacgcccttcgtccatccggcgctggaattttgtctggttgatcatcggtcgccttctcccccgaatgattggatttcgtatacggccggggaatcgcgacggattctggggtggggggtggtcctcgcggcggctctggcacggctcgatcggattcaagcaatgcaagctgtttggattgtgtgtatagcatcctcaatagcctggacctctctcaactctcatctgaaatgagatcgaccagttggcaccatcgagtggctactggctaggcagtttggtacgccgttctccgcgtacattttttttttggactgttccttgtacgttactactacctacgtatcttcggcacgggcaccggcccatctctgacgctgcactgcatacctcataatctcgacctgttacttgagtttgtgttgacagtttttgaccacccggattgaaatagtttaggaagtttttcagtcggataacacatgcaagctggcacagctgatatatatatatatatatatatatatatatatatatatatatatatatatatgcaatgacggcatttcttatcattaatcgatcgtgttattccaactccgctaattacaatcatcatccaaatgaatagtattaattagtttggttgattattaaacaaattagacacattattgccttattggactgaagaatttattctgctgatcactttggacccgcgagtagactgcaagtcttttgaggggactcctacgagcaagtttaatagtatagccaaatactaactctaattcatttatagtcaatctaatagttcattcatacaatagttacatactacattattaatacttggtaccacttgtcatacacacactgtatcttggagtctgtgctacagctggctacaaatttgtagcccgctgctcttctctctccttattatcttcttaaaatatgtttgctattgtacctgctctactaaactcatcatcatggtagcaatgtactgtcaattgtcctgctgcgaggttaggagaagctactactaattgtctagccctttaaaactttaggttaggcagacgtagcactcgccgggcttgcatgattaagggggtgtttggaagagaaggccaaactttagggggtgtaggaactanggactaaactttaacctctctcacaaaagtataattctctcccctaaggacttatgtttttgagagaaggg

SEQ ID NO: 75839 - DNA, 3426 bp, Oryza sativa
ctggatcataatcaccccctaatagacaaggcatggactcccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgagctatcattaagccatcattaaataatagtgaatcataagttatcccaatcgctgcactgcacggtgtctagctttttccccacggcatgcaaccaatccaacgcatccacggggttgttggagctagagaaggtaggtggacggatgcggaggaactcggcgagtttagagtgttgtgggggtggtggtggagcattctgttgtggcggattttggaggtggtggaggaaagcagtcatcatgtaggcctgctgggcgaggatttgggtgagaatggcgttggtgtctggtggtggtggtggaggcggaggaggaggtggaggtgggctgccatggttgttgtggttgctgccctcaggttggttgccatcaccggtattagcacttctcctggtcgtcaccatctaaaaaccccacacagaaccagcaaacagagagagctgacaattaaagctaaccatccacgactaccataattcttgaatttattactgctattaaattggttaattaaagttcaaattgcttaagcaaataaaataaagacaggctccgacacagttatgccacacaccggcataaccatgccccacacgactccaacaagaagacaaacgagaaagaacacacgcgcaagcctactaactgctcgtctaccgctgcgacgggccaggacggaaggtgagcaacagcgcatcctccgtgctaccaacgccggaggcttccccctcctgaggaaccacgggcgcgggctcggcacgaggggtctgaacgaagcaagtccacgccagggactgacgaacaagctcgggcctggaggtgctcttgcgggcggtgatcttctggctgcggcagacgcggcgacgcttggggcgacagacctctccctgggcgatcttgagctgatgcagctgcgcctccactgcgtctaggtccttcttcagctgcagattctcctgacgcggctccaggatcttcatgttgttctcgaccatcccacggcgcaccatctgatggaagtcgatacaagtcgcgtcgtacgcctccaccatgcgcgccaggtgcatgatggtagcgtcatcctccgagctagcatcccggaaggtggcgaagtcgcgggctcctccgtggcgagggtggtagcggtagggcgagtgctgcaactcgtccgggtagcgctggtgaagagtgccgatggcgaggagagcggcgttctggcaagcggcggagaaagaatctccacccgcggtgactgccaacgaagtcctctcgggtgagctagtgaggatcactgcagtaacctcccaagcagcgtggggctctgcatcgtcaccctcctgctccgggagcggcctgccctggtagtccactctatgcggataccccaggacaactcacatgccccacagctccaagacgaaaccagtcaggtccagaccacgacggctgatgctgccggccatctacaaacaaaaacaaaaagaaaagcaacatttaaaagtcagattttggcgataaatgaagcagcaggacagagagagactagagggttttcacaattaagacaggatttttatttttgaaaatattgctaaggcttgggatctaaggctcgtcctagggtcaagggggctctgataccaacttgtcacgaccggaaataacccaacgggcgttccttacgtgcgtgtattattccttgtcccaggaggcaaggtacaccaaaagttgatacaattcagagtttaacaagcggaagcgtaaatagataatttattacatgggcagcgaaggcccggcacacacaaagacaaacgagaaacagcggaagactagggcgacgaccacaggcgcttgacggcaggcacgagctagacaccaaagccttcatcttccagggactcctcttctgggtttgggaaaaattgagcaagactgagtacaaccaccgtactcaacaagacacacccacaagtgcagaataaatgcaagggagtacaagggagttataatataaagggttagggtttgcagtaaacagcgttaaaagacacttagttgctcaaagctattttgtaatcacgattctagaattatacaatattatttatcaaggccgtgaacccacacgaacctgccttaacccaaggcctacgatgattcagaccgaaccggcaacccgaccctgggtcccagctcgtcccaagccaacccaggccaaccattcctccttttagttgttaagcaggttttaagaattaaaacactaacttgggtacattgctcggcttgcccataaccgagggcgcggctgttcgaatagattttactctgatcagaggtgtacatctttacccacaagacacaatcttcctcacgtgcaaccacgtgccacataccaccacggtatacagacggaagacgtgacatagtttccaacccatcctagccatagccaagagtaccgacccaatcccacctacggccggaacccccgggacaggcaggcaggactgagcccctagcagcaggacaccggccctgtgccatgacatctcgactaccaggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaatttcacaataatccaacaattccaaagtgtccaggtgatatgaatatcccaaagtctagagttgtaaaaccacctaatgttaactaattaaatagcgaagcatctacctaaaatcatactagtggtaccatgagtagagtgtccactagtggggttttgtttattctagggtgaacaaggaaataataacaataacaataataaggtcataacaaaggtaaataggcatggctagataaaacagtgataacgcgggaatttaaataaagcgataatgcaataatttaaagcaacataa

SEQ ID NO: 75840 - DNA, 114090 bp, Oryza sativa
  unsure (1)..(114090): unsure at all n locations
aatcaatcatgtacctgcttgttgctcctgctggagttcgtgtacggctcacttagcaactgcacacatagtataagaaaaggaagatgagaggaaggataatcagcacggcttgagagctcaaaaggggtcgttttgcgaaatgattgcaacatgcatgctgatgctgtatacacgtactgtccttttctcatgttttcgtggctgttgagaggcagtacaagttgagaaacattctctactttgctcttgggtgtgactaggaagcccactgacgaaagggagcactaccgggtcaatttttcatatatggaaccagctaaacagtcactgcaaatgatccattgcatctctgaagataccacacgcgaggatttgtgtgtgtatgtacgctgctcacctgtagtacacttccgttttactactaatgtcacggtggtcacaaaaatcatgtgcttttctggaagatttatagctaggtcaaaatataggagctagtacctaacctttttaatccgtgaggtcaaggacctgctatcaggagatagggagattaaattcatcgagggccataggagccaaaacagtattagccatattttagtaaataaggcttggtgcgagtctgtttcggagctctggcctgaaaattcttgtaacttaatttgtctcagatatggtgtgtgaggaagcttctcatgagtaatatattccttatttccccgaaaaaaaaatataggagctaatacataatttgcatgtcgggatggttgcaggaacggaattttacctgtacttgttcgtgcagaaacttgatatacttgatcgtttcaaacagtaccgatgctgtatccgtctggtcatgtggtgcaatgcatagggagctgagttagattatacagaagaattgcagtttcacactatttgcagaagaaaaatcaatgtagtaattgcagacatatgtaacctacataccttcccaaacggcgaaacgatttgctgaagtgctgtgatcttctcccctagctttactttaggcactggttgctgcatttggttccaaattaaaacgatcagttcgttcaaatactgaatatatggtcggacgatttcagagataatatcaaatactccatttgtcttctatgtgttgttaccttaggaggtgatgctttggaagcctcttgcttggacttcttgacagtgctttcctgcctttcctctgacttcctcttcttacgatcagtcgccgccgctccactgccgctgctactactccttgcctgaaacgagataattaattagcacaacgccacaaacatgattcaaaatccacgcgcacatatgcagatacaaaactgcatatattcagttatttagtactacgtactacaagcaggcgttttagtactacgtataggactactttgcacttattcagttattctcactggcctatttatgttgggggtatgaaatggcacgtgaatcttaccgggacagtctcctgttcttgtcgattgctgtcagacgaattggcgcatctcatgtacggttgcaccgacgtcgactcgatggccggcgtgtagccggcgaatgacccaagatccggcaagctcctcatgccaaaaggactagcctccatttcccggccgtcctggcagcaaatcttgtcaggctgatctcctaagcctgaataatccaggctactgttgtgcacgccaacgctagcactgccggagcttatttgctgcagaaatgaggccatggggctaatcgcaagctcgtgctgctcctgctgctgatggttgcagctgccttccttcgtcagctgatgatggtggtggtggtggtgttcgccgtagcatgctggcgtgctactcatcatggtcatgtcctggacctggaggacggtgttagtgccacccaagtacagcggcgagccggcgatctcgtacttgatcggcgagacgtcggagcgagcatgatgatcgaacgaccgtgccgtcgtcgtcagggtcgtccccgcgggtgcgacattgtagtgctcggaggcggggacttcctcgaacatttccggcgtcacgttcttcgacgcgagcagatcgaggaagttctccctgtagccgccgccggtggtgctgttgcttctgaaaggaggaattcaccggcgttggaattgcgatcatttacacaaagcatgaaatatatagagctagacagagctgttaattagaggactcacagttcgccgtggctccagccgtgtccgtgggcgtgctcgccggcagccgggagacgcatgacgtcggtcgacgacgaggaggagtcggcggcgaaggccgagccggcgagcgccgtcgacccggagtaggggctccagtaactgtagggaaaagaggacgagggctgcaaggccgcgtgcgtcgacagctggtgatgatactcccacatggtggcggcggcggcggccggcgaagtggaggcgctgcacgcggtagccgagtcggcctggtggtggtcggcggcggcggcggcggtggctccctgctggggcatgaaatactggagttgcactgcgccggcgtgcagacgcatcgcatgggttcggagctgaggattggaatgtggagtggaccaaagttggtgctggggcctatttgtaggcgcttggaatattttccggtggggttatcgaggaggatatgtgcttacgtcggcgtgatgcaagcatgctgcaagacatcattgatgagtttttttttttttgcttcttttcttttcaatttataatatgcacgctatgaagcagccatagttaaaatgcgttagtgtaagcatataatttttatagctaacttgtatagggtagcgaccctgtcctttctcagaagtatacctttttttcttttttttgcaaatcttgaagcaatctggttgttggtggtggtacttctgaatttgaaagtgctacttgaagggcctttcaatcagtctacttgagaattgagatgttatgtggttcatcctgggaggttcaatttactacctatccattcgttagctagctggagtatcaatgagtaaaattcaccggcagttcttaaactaattgcattgtcatatatgtccctacacttcaaaaatacaaatcaaggtctcaaaactcgttaaaagtatgtcatctagatccaaaactcttcaggtgcttgcatggttgattgacatttcactctcttaatgacactcaaaaggtgtatgtgacagtttcacgtcagcaccatgtggacttgaaggggtatgcggagttttggacatagatgacatacttaacaagtggcccggaacttgcttgctatgcattttgaaggggccaaaatgacatagcatggtaagttttaaggaccgtcactatactttatgagtttacattcacgaacgctttacttgacaacttattggattggatttaattctatgccaggtaatggtttgaggacgacaagagagttttgggattctaaaatctatctattatattattaagacagctcgacaaggaggcaccacgtttgttgtggaggctagaaattcccacattaatcggagaaaaagagaaaaagaaaaggagagtccaaataggaatacaatctaaaaataggtgaaattcggaattaaaaataagcaatattaaaagaagtttccatatacgaacccaatatgagattaatcaaaattcgaaataaaaataaaataaaatccaaaattagaaaaggaaaggagaatccaagtaggaatacaatctaaaaatagctgaaattcgaaattaaaaataagcaatattgaaagaagtttccatataaaaacccaatacaagattaatcaaaattcgaaataaaaaaataaaatccaaaattataaaaggaaaggagagttcaagtagcaatacaatctaaaaatagctgaaattcgaaattaaaaataagcaatattgaagaagtttccatataataacccaatacgagattaatcaaaattcaaaataaaaataaaataaaatccaagattagaaaaggaaaggagagtccaagtaggaatacaatctaaaaatggctgaaattcggaattaaaaataagcaatattgaaagaagtttccatataagaacccaacacgagattaatcaaaattcgaaataaaaaaaataaaatccaaaattagaaaaggaaaggagagtccaagtagcaatacaatttaaaaatagctgaaattcgaaattaaaaataagcaatattgaagaagtttccatataagaacccaatacgagattaatcaaaattcgaaataaaaataaaataaaatataaaattagaaaaggaaaggagagttcaagtagatatacaatttaaaaataactgaaattcagaattaaaaataagcaatattgaaataagtttccatataagaacccaatacgagattaatcaaaatttgaaataaaaataaaataaaatccaaaattagaaaaggaaagaagagtccaagtaggaatacaaattaaaaatatctgaaattagaaattaaaaataaagaatattagcaaaagaaaataaaaaaagagttcaagtgggaatacaatttaaaattagctgaaattcggaattaaaattaagcaatattaaaagaaaaatccatataagaacccaatacgagattaattaaaatttcgaataaaaaataaaataatatccaaaattagaaaaattaaaagagagttcaagtatgaatacaatttttaaacaactgaaattgaaaataaaaaataaaaacattaaaagaacacaatacggtattaactaatttttttaaaaaataaattctgaaattagaaaaagaaaaataagattttaattaggaatacaatttataaataactaaaatttgtgataaaaataaagactattgaaagaaaagaccatctaaaacacatgacgagataaattaagtaacatgcctataaaggagtagagtggtggcggttgatacgacatataaaaattgttaataaaacaccaaatagaatcctaatgacgattaaaaggagggacatcaggcaggccgtgaagcaaacaagtaaggcagttgctgggacttctagaaagtaaaaaaaaaataaaccccattgataatcatattcaatttttaaaatctcaatgacaataaaaaggagaagcagcgggcggggtgtataagagtgtagctgcagagccgccgacggttgacgggacttctagaaaataaaaaaatgaattccaatgatagttatgttcgatttttagaatcacaatgacaataaagagtaggcgaacaggctgtagagggcatagtggcatcgtttgataggacttctaaaaattataaaaaataaaactacaagtccaatttttaaaggttcggaacttccaaaaattaaaaaaacccaatgataatcatgttcgattttaaaatctcaatgacaataaaaaagggaggcagcgagcgagccgtagaggagtacaatgagaaagccgctgatgatttggcaggacttctagaaagtaaaaataaacccaaacaataattatgttcgattttaaaaatctcaatgacaataaagaaaagaaacagtggacgggccgtagaggagtataatggcaacgtttgacggggcatctagaaattataaaaacgaaacccaacgtgataataaactctaaaaactataaaatccaatttttaaaggttccaagaataatgaatagaaatagtggtatatcgagcaagcaaataaagaaggagatgacataaggggtagcaactggtgtgacttttaaaaactatataattagaaatacgaggatgataaggtttggttttttaaagtctcaagacaatgagatagttatttaaaaaaatttaagtaaaatcatataaaaaatatatgattttatttgggtgctagccgcgcaattgcgcgggccgcccaactagtttagttaatgagaatctagagaggttgcatttccccacttctgcctattaattggttcatttgttcattttctgaattatgaattatgtagcttttgattcttagaatctagaatctaggtgaaaatccaaattgttcgacagagttagagattaactagagctgtcaaaagctctttcaaatagaactaatacttttggggattatgtaggtctaagagcttagctgtggctccaattggtcttgcatgtgcgacaaacccaataagatagcctagatgctgtttcaacttctagcggaaacaaatgcttactccaaaaattttcacattagcaaaaaacattgtttaatcaatgcattgttagttaaactattatttttctccttgttccgtacgctctctcgtgatacaagtggcattgcatggcatttaattggttgaattgctcatgcttgtgttggagcgcgagtgcagctagtgcttaaatagttgcccggtgatatactctctcacctccaactcactgctaaaactgatgtggcaggcttatcgctagtatactacttatactactttctccgtttcagaatgtatgcattttaaaggtagatagagatgattaaaagaaagtatatagagatgattaaaagaaggctacgattgatggagaagagaatgtaggtgaagagaatggttgtaattggttgagaggaaaggataggtcaagaaatagctttattttgaaacacgattgtgctaaaaatagctatattttgggaaggagacagtacatcacttaagataacatgatgtgcatatatatagttttacttctaaaggtaaaaattagaggcaggacaaaagcttcttaattacaaggttttatagatgcagaagaaatgggcataggttaattcagaaacttgaattgtcagtacgagacacggtgataacctgccaaccttctcactgagactgctgccacgttattcggtgatgggcgattggtccatgaaaggtgcctgtcacaactcgcacggagtaagcagcacccggcttcttgcgcatcaagagcatcactctgtcctaatagtgttctttcgtagtggtaaacactgaaaaaaaaactcacagtcacacaatagtcccaacaactcaaccgtcttcggggcataaagcaagccaaatctaggaagtaattaatcagatgtgtgcaccaaagatgtagtaccgcaaacaccggaaactcgagcatctctgtgtaccagccttgtgcttctgcaaaacccgtcgcacgctcagcagcctgcttgatatgattctggaaatgatatggacgtgctgcttagtctgctgatagtatgtcttccagatggtgaagatctgcagcatacaagtaaaagaagccactcaacttcgagacgtcatatcacgtcactttggagttctacagtggagtacattttactaacctaagctgacttttttcatcaactttactttaccatgaccatgtcaggtaacttatcattacaaaatgaagccatgggaaatcacacagctatggccgacgagggaggaatattctcagaaacagtaagaagagctactttgctccatggtcttcttccacttgagtgggtcagttgactgtgtctcagtgtcatgaatccctctgctgtttagttccctgcttactgcaccaccttgtcttgtttactctttgttctcttgctgctcggccaacaatggagcagagactgcatttgcagggccattgaacaaagagctcgccctagggttggtgagtgacggtgatggctttggtggtagtgggcttggggacaaaggcttcaagaatgcaattcattgcttcctgacgctttgcgtcacataagatgatgtgtgaatgccaggaaagtatcagcctgaaatctgaacacagattaaaatcagcggcaggtcagatgcagaaagagaagcagggaaacagcataatgtgttggctgcctttccttaattgaggataaggcatctcttcccagtgaggtactccggtaaaaatgcaaataaactgttgattaaaatactttagtatcttcattagcatgacaaatagatgtagaactatagggtaatatgctaagaaacctagggagatgaaatttccaagacaaaactgaaagggaaagctacagaatgagaccggtgactaaagcagacagttttttttttatcagggtaacaaaacgggcatcatatgtagtataacagatatctcaaatacagaaagtaacatatgagcaaatatatagcatactgatgtaactcaatatgtactctgtgattttctttccttcgcaaagcagtagtttacatgttccagcaagagaagaaagtggcacttacagctacaggagcgccccaataacagagtgatttcacactatattcaagtcagcaaattgttagcttggactgagaattactgctgtacaaaatgctgggctgctggcacagtttttttaatacataatcatggatatgagaaggttataagcactaggctagtgcaaatttaaaaaggaatacatgaaaaatagcactcatattcaaaactaagattagcaatgagcccatgatatgaataaatactcaaattagctattgacaagaactcacaatggatcacaccttggcacgtgtaaaaggggcatagtggagtataagcttaaaatgtgtcccatcacaagcagcatgcctcaaatagcctttcttcaaatcaataatatcctggggacccgcacagattatagaacaaaataaagacgagcttgaaatttaataacaggacttcagtggaaactgggattgctcataacacttgtcagcatatgatcatctggtccacactcaaatggttgagcaaatggcctccaatcagtaacactaaataaatacaaataatttatttcctgtgctttagacttgccacagcggtggttcctgctgacaattatgtgaactccacttccactatttaattctcagaaaactcatccctgatcacttgcctgatctgacccaaaaaaactggtaatcttagcagttaaattaagaggaggaggaagcgtgccctaataatactcagtaacctaattgtcatctgggatcagctgactgaaattggttgtctcatcgagctaaaggaatgttgtgaaaggaacagcaggcacttttcgtcaggttcttgtttataaggggatgactaactttggatatcatcgaacaaagaatatggtttccaatgccgccaccctgtctccattcgtgcagtacaccaagtctgcactctgggtagctaactacacaagcatggactggagaaatttcctttcgcgtgctcaaagttagcagtgtcaaatagcaattaggttgagatgtcaacccaagtgcggtggcaaagttttcaacttgagctttgacaagagacaggaagaataaccagtcgtatcctatccatgtatttacaacatgcttaagatttaagaagaccataaacaagcattgcaggggcatcacgcctacacataaagtttttcaagtggttatatataatatctaaaggaatgactacacacggaccctccacctttaggaaagggagagagacaaaacaaggataggcagcattaagcacgcgcatcacatattctaatagaagaggaaaagcacaccaggaggaggctctgtgtacggtgaacttaatgacaggcaattgaaggagtagctttgtttactccaagttgactctcagtgaaatgtgtcaaccactagaataatataagaaaagaagcttggaggcaaggacagacagctcattctccctcaatttgaaagatgtcgagcgtgaagcttccccactaacgaccttagtaggttggtggaggatgacagcgatcagtgaaaatagcattttgcaatgagaaaaatagctgacctctagagacaaccgtgtgataatactgcattcatgcatgacaaactatgagatggatgtaagcagagttttggactcttcttgagcctccaaatctcttcctgtcgtgacatgctcacaggtacaagatcactctggttaagtcaaagacgttaagcacttggaataggaagatggtcaaaagaagagtcatgtctcttgaaaggtctcacggtggatatcatgctacacacttacaccgaggtcactatacaaattggtgcaggagctagtgacttcatcaccaactgtagttagcttagagcctagaggtgaatttgactacaggacaaaatagtaattcatacattattagaaatgtcagttcataaatatgaaaagatactccggatggacatgttgagacatatacagaatacaaaataaaatatgtggatgcagatttactgagtcactaatgataactgaagatataaaatatgacagaactagaaaaggacagaggaataaaaggttacctggacacagcagtatgctgtagctcttttgtagccagctcaaatgcatcctctggagtcaagaacatctcaatgtacctaaaaatggtttcagacatatcgatattcttcttaaaagagggcaatggtggtggcagattcactgcctccacctcaccaagtatagtaacttcttatttaccatctactccatcatgttttataccaactaccccatgtacttttatgttataaaataatccctttacatatatgattatatcatatttcacctgtacaatataacatctacaggtacaaaattgtcccaaaaacctcactattaatttgttttaatccgtagcaaagcatgggtatctggctagttataaactaaagttgatgcagatagtaaaagatactatatgcagattcatttggcaaagaatatgcattaatattagaggcaatcaagaagatttacagtgtcaaaagggccctaacattgatcaaatatatagtatttgacatttaagtgcaactgcatgattagtcctccacagttgagaatctaggcttaggttacaacgttcagttggaacttggaagtgtctgatgactgatggcatacaaaacaaatactcttaatcttcataggatccaaagagcaagtcagaattccgactccatacttgttcttttttccaccggcccagcaaaggagtttttttttcaatgctttcatactgctgcattgaaaattaagagttaaatagaggacaaataaagaaaggtgcactttagtaatactctctctatttcaggttataagatgttttgactttggtcaaagtcaaattgctttaattttgactaagttcatagacaaatatagcaatatttacattaccaaattagttttattaaattaataattaaaaaaatnnnnaaaataaannnattnggggaaaaaaanannannannnnnntnnaaaaacnnggtcaaannngaagcannnngnnnnngnccanagtcnnnncatcttataacctaaaacggagggagtagtatgaatcaaaacaaaattccatggcatcacaagaaaatcactacacctgagaaaaaagaaagaaaatagcatctagttaggttacctccaaaaacctatttaaccaaacaaggagacatcaagatagtgctgagtgccatattgttgctgattcctgatatgtacacctccagagggcagtacccgtgctaagagaatacacgccccactacaaaacaaaaatgtgtatattccacattgcctatccgagggcttaacactggcttcaatcatcagctgaactatcaattcaccaccagcataacagccatcttgcatccaccacacatttcatagtcactaacactggaccaccctaacataacaccatcggtgacagcaatcacacaaaaccatccaaacagcagcatatacagtccgcaattctacaccacaaaaagaatacgaggtacctacttagcatagggcccctatgtaggaagaaaagtagtggacagggatgaatgtggcggtacgcagcctacacatcctcacaacctaatagcataatacagcataaatggcagtagctattccatacctaacggtgcaaagccatcattttggttataccatgaataatacaagctgcggagaacattgcaattttgaattaaaaatccaaactgcaatcacatcacaagtttgcttaccttctaacgattgccaaaccaatcacgcatcattatgtgctcaagtgaattgcccaaccaatcacgcatcattatgtgcccaagtgaattgctagagaagagaccaaataaagtgctgatctcgtaggccctcatctcaatccttcttccatacagatgatgtggtaatgtatttctgtactgaatcgactcattacgttccccaaactaaataaatcagctctctaaattaggataggttcagagtaaggatcaataaatcagttctctaaattaggataggttcagagtaaggatcaaatcgtctacttcctcgaaccgaaccagtaccaaacgcaccaaaaggggatgaactggatctagtcatcatcaaagctaacatcgtgggtaacatcaacccccgtttcaaacgattcgtccgactggccccgaaaccagcgacttgagaaagagcctcacctcacctcacttgccgcagccgccgcccggggtacctcgcgcggctgcgcctttgggtggcgccgcgggaggaacctggactcggtgggagccactggtcgacggccggtcggctgctcgtccggcaccgtcggcgcggcgcaactgtgctgccctcgatgcctccgggggcgtggccacggtgggttcgtcggctgacgcagcgcgggccgtggcggtggtggtggtctctcgtagcccagctttctgtaagataagtggcccggttgagcgtgcggcggtgcgggtgggtgtgcacgcgctcggaggtgtgaaaacacgcccgagtaccaagcggcagcgtctgtactacttgggcccgataatttgaaggtatttgggccgaaagactgttacggcggtaacaccaattcgatgaggaataagttcaccttactcgagttttgatcgtaatcttaaactaatataacacgtccttcaacttatataaaactaaattatcaaaatcacacgatagtattgtgtccgattttgactgatgagacaacttggtaagcagtgagacccatgtgagacctcatatgttagtggctagcgctttgttcctcctctttcttccctttctgctaatgggagttgtagagggagcaaacgggggatgttgaggatgaagacgacatggacgtgcgccgagtaggagcgcttgatatcgccaccgttgatgcaaccggctactcggggatactagagctatggcacgacccatagaagacgacctatgccacctgtcttcttcgacacgatgggaggatggagctatggagctatgccagtatgccacccatgcctcgattgttgcctctctccctatatcccgttggcctgctacctgcaggctaggaagagggagaaggggaaagaggaggaagaaagctaggaggggagaaaaggtgaaaggaggagaaagctaacatgtggggttcatacaggttccacgctgactcagccgccacatcaacaaaaatatagaactatactggctgggatcttagctagctacaccggtattataagttgaaggacatgttatatatgttattgtggtttagggatgtgattcaaactcgtcgttaacatgttatatatattattttattttgtggaaagatttacaatacatatccgaaagacgtgatcaagtcttcaaaaaaagaaagacgagatcaaagctaagggaaagaagcgtggctgaacatgaatcgatcaatcgcgtagagaaaaaaaatcactgcttcgggccagcctcatccgcgcctttattttttttttcatgaaaccacagatgcagcctctgccatcgatgtccagagccagtccacgacacaacatcgggtcccgttcgtcggcgtacggatcggtcgagttggaggtggccagcctcaacacggctgcgcagcgtgtctcgcccacggttttgtttctcgatcgacaagtcggcaagacgggaatcgtcgcatcgtggacaagattgtgaggcgcttcggtcttcctgggccatgcttcgtttgggcattgtgcggcccacggtggtgttcccgggcgcaacatgctccctccacttcttgctttccgggccacaggccacagttgttctttctcgaaagggatgtgtgttgtgatcatcattcatactaagaagatctaatcgtcagtccgttgttgtgtactggggtttatcccctaatatctgttcttgcttaataaagttggttgtgtttaaaaaaaaaggttatgaagaaaaaggtagttcgacaaagcatatgatactctttgtcgtgtcaaagagaccaagataagtacaggagtaatcgtacagctgcccaacctaatcagcaccggtgaccgagaaaagctcgttctacctctcgacagatcgccgttagctagctaccgagcatagtcgcccatcgtaagtactagtacttcccattcacgcatacataaggacattcggaatcattttctttctcttgaacttcgatcgtgcgactgttgaaacctcctttgttgcatgctagctccatctgtcacgctctggctgccgcgtaggctggtgcatacatctggaggaatctttgccctgcggtgattattagtggggtgacaaaaatgggctccgttctgatggcattggttggaaccgcccgtgacccctccagcagtccagttcatggtacgtgatctgttttataggctgcttttcctttccagagaatatcacgcgttcagcccgcttgttgcactgtaacgcggtcagtgccaccatcggagagggacatcgacatgttacctgtacggctgtgctcaatatataaacccgtgtgccgtggtatgtataaaagatctacggtaagtactggtttcatggcaattaatcgttgtttaggattttttttaccttttcgaaatgtaaataaaatagagggactggaattaggttttttttttggaagtttcgaactaaattaccacacaaaacctggaaattgggccttttgttaaatttaaacaaattctaaagctggaaagtagaatcgtcgttgatgacgtatgttctcattggtgatcgacgtaaggcaacagaaatcggtcattggtctccgtgtatggctgtatgcatatgcaagccccctgcaaaaaggcgcaaaagagtgtatagtacggtgaaggaacggcccagcgcaggcgcatgcagcacatgcatgttttccaacagcgctcgcgctggaaagtagtacgcgttcgtacagtatcctgtttgacattctagttgtcgggtggttgcttcggcctcttgctgtccctcggtccctaatccttcgcgtacgttgatccgcgatcgctcgtcgactagcggaagaacaggttttcaatcgatggagtacgcgcgcgcggtaccatctgctactgtagctagcactcgatcgatcgatcgattggcgcggcggttgctagctgcgcatatgcttagatgcaggctgccgatcgaaagcctgaaacaacgttacttgcgttgcaacttgcaaggacgtcatgcgcgtactcggttcttcaattgccgtgtactgcatcctagtgtcggccactttttagccgattttatctgcatggacggacttgaattgtgtgtttatgtgtccccgtgtttcgttgggacttaggacactaccgtgtttttttcttccttgtttgcgaagcttttggatgcagtatcaatctcttccggaacaccggcccgtgaatacgcactgagtttcggaagagagagagattaaagtgtcgcataattgggtttcagatagcagtacaagttactactgaaaagattggatttaacgtggatacctctctcggtcctccacggttgcgtgttaaatatgcacaggaacagcccctggcgtggcacgattacagcggagagattacaacaaatcttatcaagattaagagataaacacaggagactaacaaccatgatctatccctcaaagttaggaagctaatcctatcactaaccgtgactagatagaacaaatcttaacacccccacacaatcacaacacaggcaacaagttgagattgcgcctgaaagcatccatttgttgagcagtgaggactttggtgaaaccatcagcaagttgatcccttgtagagataaacctgatctctaatagcttttgtgcaactcgctctcgcacaaaatgaaagtctatctcaatatgtttggttcttgcatgaaacacacactacactggccaaggtcacctgtgacgggcccaaaccctcatctttgacggcttcgcgcatggtcagtgatcagtggtcactggtgagtccagtcacctttgacgggtggccggccgtcacaggtgacacccacctctgacgggcaagttactagaaggccgtcagaggtgttggtctccgctagccttgagcgagttaggacccgtcacaggtgactcatctctgacggccctttaaataaaggccgtcagaggttgaggtctccgtagttagaagctgtcacaggtgatctacctgtgacagccccaaaagtaaaggcccgtcacaggtaggtcacctctgacgggcctttatttgctagtccgtcacaggttatgttacctttgacggatttttgttccgacccgtcactgatgagttaattccagaaaaaaaataaatgctaaatattggctagcctcaggatttgctagccatgccctctgaaaaatagaaacatcacagatatattccagtcacagatccatcacagatacatcacccccccaatataacatcacagatccccaacaacacatatatgcagttcaaatgccaccattttgcacagcaaattcacaccccttgaaagccacaatttcggtcgttgctcatagaaccgcatatatacttaccaaatggattaaagccataatgtcatcgacctgcacaacctgtcaataaggaaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcgggggggttgatgggtgagatcttgaagccagctctacatttctgtttaataaataagaggttaattagcacgttttgaatagcaatgtagatattgaaatgagcttattcgccattagcaacaacctcagggtcgaaatctttcacctctcttagaagtgttgacatgttgttcacacgtggaaaccacattggtctccgatctgttgtgcgcatgcaaacttggtgtcatgataaagttcattcttgccctccttgtgcctaccacccttttccacatatgggccccaagccatatttaagggcttggtgatttcactgaaatcataatctttggacttattggagttaaggtaggtaaccctactccacttaggtacaatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgccgcgttcacgcttctggcccttgacaagtggtggggagctatcggcctttcttgtggtctttattggagccaagctttgagctatatctgccaagtccatatcagctccaccaggagaatgaggtactgacaatgccggtccacggggagcctcaattgatagcttacacttgggaggtgtaagctccgtcggtcgacttggacgaggagtcatcttcacaactatgtcttctttgggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaattacctcgatgtggtccactgcagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgagcaccttgttaaccctttcttccacccttgcattcatgctagcttctagttcttgaatgacctcaaccttaagttcagccttcaaacgagcgtccctctcttccttggagactttccgtttcctgtattgggagctgtactgagggagtccatgcttccagggcacatcgctaccaattccccgagttcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtacgcgatgtgcctcgctggattccctaaactcttgggtggtcttgagagagcagaattcctcccacaccgcttcggttatttgatggtattcatcgaacggcgtatgattgccgggcgggttgacatactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatagaggatcccgaagttctcacgtgccactagcccgcagcagttagaccatcttccaatgacagtcctgggcgccgtgggcctaccactagcgtcaacctctcttataacttgcactgtggtcggccatatattttgtgaccgcggatttctactagacctacttgcacttgtctcgcccgacatcgacgtatgttgttcctgcggcaattctgcagcacaaacagaaggcaatatttgctaaggggtgctagctaaaatttatgtggtcatgtggtgaaaatttatgctataaattaccatgaatttcgggttgttggaccgccgttgtcccgggatgaccttcggcaattgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcagctactaggagaaaaaagcaacccaaagaaaatagaacaagtgtagttcatctgttcttatcaataaaatagaacaagtgtagttcatctgttcttatccataaggaaaagagcaagtgcaggaaattaaagtagtagcaacagcatggccatataatagcagcaataagagcagtagcagggccatataacagcagtaggggtatatatgccacaggggcagcaacagcagggggagattcacataaacagcaacagcagggtggaaattgacataaacagtaacagcagggtggaaattcacataaacagcaacagcagagggaaattcacatagacagcaagggtatataaatcaacaagtgtagataatctgttcttatccataaagaaaagaacaggtatagatagaatgttattaagcaattcatccttggccatttaacaagaagtacaggggcaacaacagcagtggtatataaatcatgcatatattattgtagataaaaaaatgaacaagtgcagaaaatctgttcttatgcataaaaaaagagcaagtgcacaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactcctcttatcaatccagaagaaaagagcaagtgcagaaaatctgttcttatgcataaaaaaagagcaagtgcacaaaatctgttcttatgcataaaaaaagaacaagtgtagaggtatataaccactctacactggccatttaataaggaacaagtgaacaagtgtaggggcagtagcaggggtgtagataaaaaaggagacagtactactaacttcatgtaaacagcaattcatccattcaattcaagcaagtctagataataaaacagcccacaatcattgtggcagcagcagcaagggtatataaatcatgtatataaacaacaattcatacaattgacctattcatagacaaaaagggtatataaatcaacaagtttagataatctgcaaagcctccttaatcatcaaattatgacagaaaacaaaatgcatggagaattttggtgtctaggtcggttccgtccatggactacactggcctatccaccaaaattccccatgcattttgtattctgtgatggtttgataacctcggaactacattaaatctgcggccaatctatcaattcttcccttgtaactagatttcaaaccctacacctaataaaggtccttaattatcaaagacactccatgaatggttatatgtccaaatggctcttaaatccacatccaagttgcaaactagctacacattcaagttttaactaacagttgcaaccataggcagcagcatgggcaaacatagacagcaaggggcaagtgtagataataaaacagcctacaataatttatgtggcagcagcagcaggggtatataaatcatgtatataaacaacaattcaactattcatagaccacaagggtatataaatcaataagtgtagataatctgttcttatccataaagaaaagaacatccactgcagcaaaattcatgctaagatcctctattgatgctaagattcactgcaccaaaatcatgtatataaaatctagcccctacattcatccaaaacatccatagacaacaaatcacatttaattcatctatacagcagcaccaataatcgaaacaacaaatcacatttcattcatctaaacaatgcaattcatccatcggaaaaaaggaggaatgggggagggtggcggcatacttggagaagcggcgtacttggagacggcggcgcagaccgtagtcgtcctggatcctggtggcggcggcggaaaggcagtggcgaagaggtcgaggcggtcggcggtggtcggggatcccggcgtcggggaggtcagggtcggggaggtcggggaagtcgatggacggacggcggagaggacgaccggcggcgagggcggcggtggagacggcggcggagatggcggtggagaggacggcggagatggcggcagagagggcagcggagatggcggcggagagggcggaggagaggttgaggcggcgacggtggagatggcggtggagannnggacggcggcggtcntgangagagtgagtgaggaggcggcggtggagaaggaggcggcgagggcggcggagaggcggagatggcggcagagagggcggcggcgaggagggtctggatcgagagagagagaggcggtggcgaggaggtggagatggcggtggagatggatggcggcggtcgagagagtgagtgccgcggcggtggtgcaggccggcgtcgggaaggtcggcggagagggtgagcggcagagaggtcggcagtggagaggtcgaggcggtggtggggaggtcgaggcagcggtggagaggagggcgtaagggtggcggagaggtcgagagggcggcggatttggcggcggcgaggacggcggtggagaggcgaggcggcggtcgagagagtgagtgagtgagagtgggcgccggatctggatcgatctagaagatgtccaaccctaggtcaaccctagtcaaactcacctgtgacgggctccaactatgtggccgtcacaggtggcctcacctgtgacgggcgccaaccgtggagccgtcacaggtaagaccacctgtgacgggcccaacactctgggccgtcacaggtgaggtcacctgtgacggccctacagatagagcccgtcacaggtgagtttgcctagagcaattttattttattttatttcactagttcttttattttccttaacatattttcacatacactacatattttttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcctcctcctcttctagaggtatttcttgacctatgccgtggacgtgctggttgtaatcatcctcgtctgcaatattgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggactttgaacttcaagtaatctagctccaatatttgctcaactctaccatagtattgatcacgacgaccaccgtcactagtagcctcgatgcgtaacccactgttctgcactgtgcatttgctgtcttgctttaccgtgtgaaaggtgtatccatttatgtcatatccttgccaggtggtggcactccattcaggaccctgtgacaaccactgaagtgtttcactaggcaagttctgcaacctggcaattcggttcttcagccactcgttgaaagaagacatgtgcttattcctgacccaactctctgatcggcctgggttctcttgtcggataactgcaaggtgttcgtcaacgtacggcaccacctcagtcatatgctgtagtaccgtgaaatgagctttatcgtacaccttccgatccaacctaatagtctttcttccaacagtaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaaggatccccaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctggccgattgcatggaagaaggaacacaaccgctggatcgtgtgtcacaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatcctttcagtatggtagtctccagaatattgacttctttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattcgttctcatattcctatacgggtgataccttgggagaaatctcctgtgacccatgtagaccgtcttgtgtgaatgcttcaaccatttgcttcttgtttcctccatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatttgagaattcctggtaaatcctatcgattgtcctccactgcactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatcccccacaaatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatcagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgtcatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccgtcactggtatccgctcacctgtgacgggccagaaatgaaagctgtcacaggtggcggcccatcacctctgacggcttctaatgtatcggcccgtcacaggtgaggggataccagtgacgggttggaagaaaaactcgtcactggtatacctctgacgggttttcctttcggcccgtcacaggtgaggggatacctgtgacgggccacggccagatgcctcaccggtgacggcatcccgtataacccgtcaaaggtaatggtcactactgaccaattcgtttgcccgtcacaggtatcccgtcagaggtgtgaggatctggcgtagtgacaggatttgatgacaaatacttagctcccaaattatcacaccaaagacaagcagtagttgggtgactaatttttaactcatcaagcactttttgtacccacattacctttgctgtagcattagccaaagacttatactctgcttctgtactagaccgagagaccgtggcttgcttgcgtgcactccatgaaataagattctttccaagaaacacagcaaaacctcctgttgatcttctgtcatctagacatcctgcccaatctgtatcggagaaagcactgacaagcatagatgaattcttacttatcttaagaccaacatttcttgtaccatgtacataccgaagaattcttttaactgctgaccaatgagtagtagtagtaggagcatgtaaaaactgacaaaccttgttaacagagaaagaaatatctggacgagtcaaggtgagatactgtagtgctccaactacattccgataccgagtggagtccaatggccctagctgttctccactagtaatagacagcttttctaacactgataaaggagatgtgactgacttacagttggtcatccctacacgctgaagtaaattagttgcatatctttcttgtctcattgtgagaccatcatctgttctctgtacttcaatgccaagaaagtagtgcaagtctccaagatcttttaaggcaaaatctgcttcaagaccctttaataaagcatctgtagcactttgtgaagaactggcaactataatatcatccacatatactaaaacaaacatggttaaatgtcctttgttaaggaaaaagagagaagcgtcagctttagagggaataaaaccaagctactgcaatttctgactcaagcgtgaataccatgctgtcggtgacatgggaccgggggtatcttgactagaggtttggggtagctgcagtcacccacgtggcctaaccccctcgggggggtcgggcccgagggtgatgtggccgcccctccttctgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacagaccggtcagatcgcgggttaggtggcaacaggcggcctttcgcacgcctcgccccgtcccgtcggaatgatgagagcctctaggcactcgtccctagccggagccggcgtgctgactcctggagttagcacgtcagtcccggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcggcagacaaccgtggtcccatgttgcgcctgcttccggcggagtggaggtaggtatggcccatcccatcagagggtcattcggacaacagccatggcaaatctctgcccattaatgagggagtaacagggagatccccggtgtcaggcgagtgatgacgctgggcctcactcaaagacaagctgtgatttagcttccaggcgaaggcgcaagccagttttttcttttttgggaagatagggtgagtccccacccaaaagaagagtaggtagaagtggtgcatgtgggatccccttgagatataaaaggaggaccttgcccacttaagaaggggggagctggggaaagaggggggagaagacctgagctcgtagaggagagaaagaggaagagggtttctagagtttgaactctcttgctctccagctctttgtaactccttcatacacagatccaccagaacacaggagtagggtattacgcttctcagcggcccgaacctatctacatcgcccatgtcttgcgcatttgctctctcgcgaaacattccacagatcgagtgcttagaacctcacctagcgcccccggccgaaccggcaaaggggggcccgcgcggtctcccggtgaggagccccacgctccgtcacatgctctaggcacttgtttgagaccatataaagctttatcaagtttgcaaagataatgtggatgatatttatcttcatacccaggaggttgccgcatgtatacctcttcctccagaactccataaaggaatgcgttctgtacgtccagctggcgtaagctccatcctcttgtaactgcaactgacaacacaagacgaatagtggcagctttgactacaggactgaaggtgtcctcatagtcaatttcatatctctgtttaaaacctttagcaacaagacgagccttgtatctatctatagttccatcagccttctgtttaattttatagacccacttacaatctattatattcttcccttttgtaggagggactaaatgccatgttttgtttttctgcaatgctagaaattcattgtccatggctagcttccaatttttactattcaaagcatcattcaaagtatcaggttctgactcagcagtaattaaatttgcccaacgaactgtaccgtctgtgtaaaccttgggtttacgaattccctgttgtagacgagtggctggtcgttgaggctgagtcagggcagcttcgctggatgtggtagagttgttcgccgtagagttggtcgccatggacgatcttgacgacgagctgtccgagagaggctccgacgagcccccgtcgatcggaacagccaaggagtcatcgccgcgtggaggagacgccggctcgggcgcactgtcggagacacgcgacgaggaatggctggtggatggcgatcggctgagagaagagccggctgcagcgcctatatccccaggatgatgcgccgcagttgcgtcagaagtcgcagcgtcgtcaggggctgcgtgagtgttaggagccgcggagtgcccgggccgcccgccgagcagaaaaccatgggtgttttgctccaaaatttgccctgttcgcccagaaatttcagcagcagcatctgcactcgtagcaacatcaactggagactcatgagcagggttagtagaagaattaatcacatattggtcaacatgttcgtcccgagaaggattcaaaagatgttctgggaggagaagaatttcagcccggagacaatgaccagcatttggatgaaggtcagaaaatgggtagatatgttcatcaaaaaccacatcacgagaaatataaacccgaccacttaaaccctttgtgcattacactgtaaccaaggaaaacacaccgtttcaagcggaattggagtttgtgagaattgtaagggcgtaaatttggccagcacgcgcagccaaaggtgcggagggaggtgtaatcaggtttgatatgaaagagcatttctagaggtgtggagccttggagaacaggagtgggaagccgattaataaggtaagtacctgtaaggaatgcctcatcccaaaacttgagaggcatctgagcataggctagaagggatagcccaacttcaacaatatgatggtgcttacgttcggcagacccgttttgttgatgtgcatatggacatgacacacggtgagaaataccgatgcgttgaaaaaaggaattgagtttgtgatattcaccacccaatcagtttgcatagctaatatcttgcgatcaaagagtcgttctacaggattctgaaaattatggaaacattgaaacacatcggatttatgtttaaggagatatatccaagaaaatttgctgaaatcatccacaaaactcacataataattattcttcccaaccgaggttggtgcaggaccccaaacatctgaatgaataagctctaaaggagcactagaacgactcaaagacttagaataaggaagttgatgactcttccctttctgacaagcatcacaaaccgaatgcttgtttgactcactaacacaaggtaaattattatgactcaagacttgttgaacaatgactgaggacgggtggcctaggcgacaatgccactgcgaaggagaaagcttgatagctgcaaaaacttgtttatttgggaatgatttcagaggataaaggcctcgctcacatctgccttggtgaagtagtttcctcgttacctgatccttgatagaaaaataacgagggaaaagctctaagaaagcttggttatcaaatgcaaggcgatgagcagagattaaacttttgtttgcttcgggaacataaagaatattttttagtataagatcacggtgttgggtgcgaacaatagattgaccaatttgattaatcttcatacctgaaccactggcagtatgaacttgatcacctccattgtacttctcccgcaccgtcagcttgtcaagatcgctggtgatgtggtccgtcgccccggtgtcaatataccaattggtaccaacaccgtaggaggaggtagcagcagcagcactcttctcttcgccagtgaaggaagcatcaaacctcttgtagcacttgaccaccgtatggcccaatttgtcacacagctgacacttggggtgatctcctccttggttgttggtgaagccaccacggccgcggccttggccgccgcgaccacggttcagattttggccctggtttggctgaccatggccgcgacctcctccattgccgccgcgagaagcagagttggtggacgactgaatgccaccctgtcgaagttccaatcgctgctcaaaagtaacaagctgtgaaaacaactcaccgactgagattggctcagaacgttgggcgactgcagagacaaccgggtcaaaatcatcatcgagcccagccaggatgtcggagacgatgtcgtcgtcgtcgagcttctttcctgccgaggccatgtcatcagcaagaccccgcatcttggccacgtactcggcaaccttcagattgcccttcttcgtggccgtcagagccatgcgtgtgttcatcacacgcgcacgggagtgagatgcaaacatcccacttatggcatcccaaaccccaacagcagtgggaattgagaccacctggatgaggacatcacgtgagagggagagcaacaggtagctgagaacctgctgctcttgcgccacccactcggtatgcgcgggattggtgacccgcacatccttgtcgtccttcttggtgatgatggtggccggcggctcctcctttgtgccgtcgatgtatccagccatctgagctcccctgagcgcagcaagaacttgcgcctttcagagaggatagttgctgcgggagagtttctctgtgaccgcgtgcgcgagagaaggagcagcgccaccggctagcgaggatgaagacgacgctataatcacgacgtcgaggaagcaggctctgataccatgaaaagattggatttaacgtggatacctctctcggtcctccacggttgcgtgttaaatatgcacaggaacagcccctggcgtggcacgattacagcggagagattacaacaaatcttatcaagattaagagataaacacaggagactaacaaccatgatctatccctcaaagttaggaagctaatcctatcactaactgtgactagatagaacaaaccttaacaactactatacttatacgcataaatatctataggtatgaattgagtgctatctttatcttaaactagtactttatcataaaatatactccctcgttccctaaatgtttgacgtcgttgactttttaaaacatgtttgaccgttcgtcttattcaaaaactttttgtggaatgtgaaaaactatatgcatacataaaaatatatttaacaataaatcaaatgataggaaaagaattaataattacttaatttttttaataaaacgaaggtcaaacatttttttaaaaaaatcaacggcgtcaaacattttgggatgaatggagtagtaacttttaaatataaatataaatatgcccttatctagatttatagttaaaagttattatattaatttgaagataaatggagtaattattttcgcacaacgtgtacatcgcttgatctgtgttcagtgccgtcgatggccatgtgccaagtgatcgaccgcacaggggcccccaaaatcaagggccccaaaattctcatatttaaatacaagacactaatttccaatatgtttttatcctattcattttatttttttttaaaagttcccctcatcttgacgtactgatttggctagaacatatttattttctttgcattcaatagatgttcaataataattatggcaaactcaaagaaatatagtttatagcggcgccatgaacgtgcattctagatactaaacattcaatttttacgattagtaaagaaaatcgaataactacattaagaagcacttatttttcttacttaaggaggtgtaagccaccatttacgtaatattttttctgaacaatttagtatcccttttgttgatattttctaaatataaggtctcattttaagtttcacactggggcctaaaattgctaggtacggccctgtctgtgttaatgtttttgggggcatatgggaccacgtcaagagtgcccaatgtgtcgaggaaaaaaatgtccaatctacgatactactcaaaactaacacattcctcttgaaaacacacgctaaaaaagtttgagatcagcgacaaatttctacctcactaaattcatattcaagtcatacataaatgactccatataccgtaccaaaaacatcttctggaaaaaaaaatatctgcactactacataacatcataaaaggactagggctgtgtttagttcgtgtgccatttttttaaaatatacggacacacatttaaagtattaaacgtagactaataacaaaacaaattacagattccgcctgtaaactgcgagacaaatttattaagcctaattaatccgtcattagcaaatatttactgtagcaccacattgtcaaatcatggtataattaggctcaaaagattcgtctcgcgatttacatgcaatctgtgcaattggtttattttttcacatttaatgcttcatgcatgtgtccaaacatttgatgtgatcgaaaaagttgaaagtttgaagaaaaaaattgaatctaaagacgacctagcactatatataccgaaaatgttaaaactgttaaaactgacatatataaacctttttcctatctacatgggttaaaaataatatacaactagttcctttgaacaactatagatgccggttctaagaaaaaccgacaccaattttataggtgccgccttcaatatattatagatgttagttaattaaaaaaaggcattgtaagaatcgagccaaaaatgggagatatttttttagcaaagtcaacatagatcatccttatcccttcgctcgttccacccctttctctctcgcccacgccatcccttcactctcgccctgccataccctttatctctttgctctcgccctgccgctttctcctcccatcctcctcagcatgtggcagcatcccccttccccttccccaggttgttgttttctcctcaatccaaggcaatgatgggggctcgagcaaagatgacggcggcaatggtttggttggtgtgataacgactcccactccccctcgccctctttgtttctcgggcgtcgatgcatcgatggcgtcacctccaactcaggggtcgttggatgtgccccccccctccaacagcgatggtgatggcggtccgactacggcgagcagtggccctccctttgaccctgcctccctgtgagcaatgactagcaggtaggtatccctcctctccttccccatccatccctcccaaaaaaaaaatcccctcactatgtattctggatttgacagtggtggtgagcggtaatgccttggcctccaataaacagcggcggtggcggcagtggtttttgtgagaatttgttatttggtttcttcttattggatctgtgagaatttttattcagcttttgtccctgttgttcttggcctgaagcattgagtacccgaagcatcaactcgatttgagccgatgcgagcctcttttttttttattcctataaccatcaaaggtactgattcttaaacccgtacctttaattgttcacatcggtattgtctagaggatgcgggtaggaaatccggtgcttatggactgttcccaaccggtaccaataagatttttttaaagcagtgctgggaaccatattggtccaggtttgtctgcatcagttatgcatgggggcgaacaaaggcgttgatatttcgtaacatcttaacagatgactgttttcattttggcgaaaaaaatggttcgtccaacccggccgaaagcgcaaaacactatcttgatctttgacagcatattttgctgcagaaaccccagaaatcacgtacggcagcccagtgcaagagttaagatattgtcaggagactcaggatgctcagcacgaacacaggagactgccggtagtgcggccaactatatcagcgcgctgccgctgcctgtctatatcagctcatcagactccatcactccacagcaggagccagccagccaagccggggtacctggagctgcatgggcccatggcatgcatgcagctttcgcaccgagagcgcggcacagcgatatcacgagccggcccggcgcgctttccccctgtacagtacaccgaggccctgcactgcgcgcgcgcctggcctgctataccgatcgacggcccgacgggccccggcgacgccgcgccccccgctgcggcccttccctgtatgcatggcatctgcgcgcggatcgcgctatacctccatcgatcacccaaccaacccggcatgcatatggcagcgtaagcgttcgtgaaaaggcggtggcgcgcgcggtcctcgtggcacgacgcgaagacagcaagcggcgcgtgcgtacgagcgtgcgcggcgttttgtgctggcgtgaggtgtgtcggagcggtatgcatggccgggccccgatgatcgatcggtcggtcgatcgacctgcggtgcggggtgcgggagccggccgggcttgtactgtagtagcgtagtgccgtggctgtgcatgcgctgcaccgctgcagggtgagacagacagaccgggttcgatcgaggtggtcacatacatatatatgtagccagggtggccacaggctacactacgcgtgcatgtgacgggccagcatatatagcactgtgatattgcgagtatatatatgattaaaacacgtacgtctgttattgacttattgtacagtagtttttttagatacagtagtgtgcagtagctaaggtaggtactatacgtacgaatacgatgttgctcccctttaccttcggttccttggagtagtatacataggaaatgagatattttttccccaaacaaacaagaaagaagaattgaaggtcttcaagtaaagggcagataggaattgaagaaaagtctactccaaataaccaatccttggagtagtactccgtactgatgaatgaacggtaagaagtttgatcatctctgaagaaacgcaaattccaccagatgtgtgcaagctgattgcgctgactgctgaccgatggtacgcttggctgcctctgccacatccgaagtttcatcgacttctgaggttgagtgtgacttcacggtccaagatagtactccgatcgagtagattgcctatgtcacatcttatgatatcgactgctagccagtacttgttgataaacaaaatttgaacacgtctgcctttttttcccagcttccggagtttcagagaatactctcagttatccgataacacacagttgctgctacagtattgtttaccgcaagagcgctgagcgttacatgtatacactgataatactattacaaaggagtacacagtcacacgaacagaatacaaagtgtgctgttgctttacagggattgtcaaggagaccacgattgcttgtgagagttgacacgagctggacgggatctctctgagagcagagtgacattcattcgggcgtgaccacgaggagcctttcgtctggtaggcctttgcgtgcatggcttcctctccaagctctcacaggaaaaaggggacgagtactcagtgctgcaggttcttattccctcccagattcttcgtcacgtataccaatcttcagaaagaacacgtacccggggaataactctggccggcatgcgtgtagagacgagcacggcatcgtcgtcatctcactaaccgagagacagtgaggttcgcgtccatgcaaaatatacttcattcgtgtgaaaaatatagtaatctaaaatggaacacattctaggataataaagttagatatatctttgttcaagtttaccattttacattctatcttaagttcttatatattggaatagagggagtaagtatttttttaagttttaacaaaaaataaaatcaagaaaagaaattaattgttatgaatgttactatgaaaattagataaagaaaaccggttgtgatcggttaaaaataaaaaagaaattttaaaaataccatcagcaaggtagatgaagatataaattgttatatttttagtcgaacggagtactcatctttttttccttttttttaagtcgccgtctcccccgtcacctcgtgaagatagcaggcacgcttactagcacgtgggccgagcgaaatgtattggagacgtctttgttttcctagccataaactctctccatccctaaatacttgacactgttaaccttttaacacatgtttgatcgtttgtcttattcaaaaattttaagtgattattaattctttttctatcatttgattcattgttaaatatacttttatgtatatatagttttacatatttcacaaaagtttttaaataatacgaacggtcaaacatgtttataaaaatcaatggcgttaaatatttagggacggagggagtataatgcatatatatgttcgagaaaaaacatacagttccaatacgtacatatatgcctctttctcacgtgggttccggatgttcatctctctatctagccgtagttttcacccaactcttcacttgttgcttgaaacatagtcctaactaatccaatgcactcaatctggttggaaatgcttccttgaacatattgtcatttcaataattacctcgaaaatcactggataggatttctcattaaaaaaaccattttcgtacatatctcctatttatttttacatgcggtccaaaaaatttacagtgtgtgaaaatgcataggagtctccttatcaagacccgcgtgtaaaaattttgacaggacaccccaaagtgatacggctagtggacaaaaaaaaaagagtaattagctataagatactacggcaattattttattatcttcactccaaatgaagagagaaacatataaagaaatacattttagccgtcatggacgtcgtcgcctcctcctccaaattctatagggttttggagggggatcaggagagggagagtggattagttcaatcaggttacaagcaatctggccctagaggaaaaatagtctttttcacacggtttctctctccatttggaccaaaattaataaaataatgatcacaatatctcatagttgattaccatttttaggattccgatagctatgtcatgtttttggagtgtccttcagcaatgagcataaaaacaacttttctaattaattttcacaaacaatatatagttttaggaggaccgcatataaaaaggatatatttacaggagtcaccctaggagcaccacatgtataaaagcaaataatctattaaaatcgaaggagggtgggccacttctagccgcaagccccttcgcatctctctccgctcctcactctcctctcccgcaccaaactcgatctcctctcctcctaggcgccaccctcgtcatctcttcctttacacacatcccacgttgatgtcgccgcataggcttaacaaggagttcaaagccataagatctgattcaccttggcctttccactggtggcgcgcccaaatcaattttcgtagacggcggtggatcgagccatatgtgaaaatcaactatttttataggtttttaagttataggcgaaccctccaacagcatgtatatatgaaaaaaaaaatctattctagccgtatgtacaaactggttttgtagtagtgattcatgttgaaatgcttattactgagaaaagttagcacatgttgatgggtcaagcagttatatgacttaaaggatgatttcgacgcaatgcagaacacttgaagaatgggcctcggtgaagggcaagagagacaaattttttactatgctcatgcatgtacgaactagtagaacagaacagcatactcagaacatggataatctgcgcaggaaaccataattaatgccatctacagtacgcaggtgcgcgattaagttaaacgcgattgtatgtccgcatcaacgaaaacaaccgcaatgaggccaaagcagggagaatctcagcgtataggctggggccccagccccccaactcagcagatgaggcatgcagccatattcctctgcctggctctcactctcactcgatcacctcccggtaaaatccaaacggcgcggcataattctgccgcataaaaccaagcgaccaaattcccctcctctcaccgtgtcacacgggaacagaacttactactcggcctctgcagctatatagctctcgatcgattctgttctaagctctagtaatctagcctattgcatgccgttcccaaggttagcgaatgtttttagactaagccgtgatctatcatctgatagtatcaggctatcagccatgaattaatatatatatataaatactactatatggatgcatatatatgtctgatgtgacctatagctttgacgcaatttcctcacctaatgcttgtgatatctatgggttgttgtcacgacactcgttataggttagtgatatctaaaactaattttgattacgtttctggagtttactttttgtttatagttaggacatcgaagggtcctgtttaaaaaggtcctccttgacgtacggattagagtatgggtcattgtttgagtatatgcaataatacgtacacaccatttttcccggttgatatatagacgggcagcattacaatactaataatcacactgtaactgccggcctaacaacgtcattggtcgcgtgcgatttgacgcctgcttggcaaatcgatcgatcaggctagcatgccgctagctggggacatgcgtgaaaagattgtaaaatcaccaaaaccagagaaagcacgtttaattattaatgtctgatcttgattcttgtctggatcgatcttcagaaaacatatatatgtgtatatatatatacaactgtcagttagaacatatgatccgtgaatttctcacatggttggcctgttgctacctgtggtcattgaggctacatcaactacttctatttccttgtaatgaaaaaggtgaaatacgcacgtagtttagactcatccgttgcctgctgctgtttattgtagtataatcaagcgatattttgtgattatatggaagaaatatacacacattattacttaaatctcctattgaaagcgtgttcacgtgtaagtaatatttatacgcaccaagatttgaaataatcatacaatcatagtcatatgactttatcgagacgaccggtgcttccctagaatcaagagatataattcgatcccaggaactgtcactactataaaaacgattttcttatacacagagctctttagattttagatggaccgtaactggtcgtgtctgcaacaatcgtcctccattttcgggtgtggatccttaagaggaccacacgggaaaatcgattttcacaaacgggtctcttaagtggaccgcacgcaaaaatacagatttttttatcccatcccctctccctcttttccctctcgctcatttcaaatttttcacctcctctctattcctttcccttttattcactccctcctctctctctctctctctctgcctcacctctcctctcctctcatcccctccgagcgtgcggcacgtgggatgcgggaggcggctggctcggcgccgccgtggccgaggcggccagcaggaggcggcgcggtggctggcgaccggcggttgggcgtcgtggccgggaacaggcggctagcggctcgggagtgacggtgctatctgccgcgcgcgcgcgtgatggccagatctgcgtcgccgcctccaccgagtaagaggtggccgggagcagcgccgccctccccacgcaaggtggcagcggatctggtggtggggtatgcaggcggcggcggatctggcggtggtaaggcgtagcggcagcagatccggctcaggtgacggcgacgggagcgggcagaccaggcgacggcgacgatgaggatggtggcaatggcttctctagggttagggtttcggatatttggattttctttttcggttttttatttttgcgtgcgggcaacataagcacccaccttcagggctatggcggccggggggggcttcctctcaatccaagcacaagactgatggatgcagatccgccttcgccatggtctctctaggcgccgaaaggggatcagattagggcttggcaaccagataagattagttggtgatcaaggagcttggcaaccagataagattggttagcgatctaggattttggccaggctcacatcgacctgctggtgttgtggttaccaccagcatgtgcacaaatttcagcgtttcgacgacagtgcccccatcaacatgggcaataccatggatcgtggtacctactcatgctacgcaatccaaccatccataccatcgtccaatggggatgactgcacatggatgaatgatgttgaacaattctcgcctgccaatggcaaatgatcgacggaaccttcgggtccaagaaaggaaccaccccactctcctcaacttggtagttgttcctttcatgtctagtgcaaccctcattctctaatcgtggggacagccgcctgctaggctactagcgatcaactggagatagctacaagagtagtggctttttgcaggattgggaaaattggtcatgggcaactaaggccgattcggcagtcttggccggtcatgagcatgtcatatccgactgttctcggtgaccactgttgttggaggcatatgtttgttttggtgagctatttggtaatcgaacggggccatgaggtccagtgagataactgcgggtgaaaatcctaatcctatttctagatttggcaatgttgttgattgtatgttgtctcctagttgaaggtgtcgtcttagacttggataaaaatctagttccggttaaagatgatagcggcagacatgcgacagtttcttcttgaaggctttgttttgaagtaggtttatataggtctttgtatttattcggtgactgagaattttttttcctctattctggctatgtgcatcctagtatgatggaagaagatgccatgtgtaatttcatttattaatatttttcttcccattataagaaaagtatcgtcatcctcctccctcactatctagctccccatataaaaaaacaccttatgaaaaacctccccaccaaaaaaccagtattttcacgcgaaaatcaactcgacaagccgcatagaaaaaaaactaaatccattaattccaatcccgtataatgcatgagcatgacaccgggtttggctcggttttatgtggacaatgggcagaatagctatattaaggctattaggttagctagtttggttggaccggcactactaccaaactccacatccataaaaccctcataagtatcggttcacttcaaaccaacacttttgaggaattttccggcgcaaacgagcatttttaactggatcaaattaaaaaccggcacctataatcactcattggtgccgattcataataaaaacccgtaccaatagtcataggtaccagttattataaaaaattggtacctatatataaaacaatagtaccggttttataaaactagcacctatatgtgagagataggtgccggtttttataaaaccgacagctatgaattgagccgagtcgaatgcactgacaaaaatatctcaagtagtaggtggtcggttttctaagtgtggtcgacctcttatctcccacattctcttctcttctggatccatctaggcggcgcgggggggcactgccaggcaacgagcgggggtagtggccggcaggtggcacccctccatcgaggggcgggtggccggtcggggcggtctctgccgcgtcgaggggcggttggtcccggtcgacgggcatcccactacagcttgatgggatcaggagctcgcgcgtgttgtcgctcccggtcgcgctctgcctccctcccgcccccctctcggggccttccaggtacggccgccatgagctcggcacagtatggtggcgagcggcgtcagtggtggcgttgttctcttccttgaagatcttttttcctcgatgttaatctatgcatgttagattctgtaattttgtgctttgatgttcttgaatatctctcaatatcggggtctctatatatgttgttgttattgagtggtggattggtggtgtgtggatgttgatgaatatgttcttggatgggatgttgttgggatgatagggagttgcgcgatgcatcagctcaaatcgaaccgacgcatccatcgagccatttttttttattcgtgagaccttgtttgcgtgatgtgtcgttcctaaacaggcacctatcatttctcctcataagtgccaccttggggatgccggttgagaaaccgacatcaatatgggttttccaattggcacctataggatgttctctagctagtagtgtgggttctagcattttatgcatgatgtgatctatgtaactacatgcaacgaatcaaactccaactaattaagaaaatgtgttagacatcatcgcaaattaaatccacacccatgcatgattcgtatatatatatatatatatatatatatatggaaagattagtccgaaattaatcgttgtttttttccctgcaaagaaaataatcacgcgctgaacattaagcgtggatgtaaataatcgctgagtaatttgtaaagagatcttttagttgtcatataaacaaacaaaaaaataaaatggtttcttcgctgtgtacactactagaaaaatcatttttcccgacgtggaggtctcattttcgcaggcggatatgacccttagagccaaatgaccgcctacgaaaatataaatcggggtgaaatttgatgtccacttaagcggcgcctgcgaaaatcattttcgcagggggagcacttaaggggcgactgcaaaaatcattttcgcaggcaccgcttaagtggtccgcctgcgaaaatagacttaatataaatacacgcgggcggcaattttttctaagtcctcagtcctcccctccacacctctcctcaccactggcccctcccctcccctctcctcctctcccctcccctcacttctactctccctggcggcggctcccggcggcggcggcggtcggtggcggcgaaggggcgactgccaaaatcattttcgcaagcgccgcttaagtggtccgcctgcgaaaatagactttaatataaatgcacgcgggggccatttttttttaggtcttagttcttcccttcaaaccttttcttaacaacgggcccttcccttcccttttcttcttttcccttcccttattttaattttccccgcggcgggttcccgcggcggccgccgttcgttgccgccaaaggccgcaaccgccaagaagaaaagccggcccgcccaaggtggccggcggcggccccgacggcgtggagcggcgacggcgcaggctagccgncgncggcggctcccctgcccccctccctcccagatctggccgaggagggaggggggaggccggtggcggcgccgacagcgtggagcggcggcggcggctcccggtgcgggctggcgtttttttttttcgtttcttctattttcgcaggcgggccgttgccccgactgcaaagatgaatgattttcgcagtcgttatggtgcaggcggacctctctcccgcctgcgaaaattagctttgtctacttgcaaaaatgatttttcagtgatgtccgcaaccatcatgcctcaccgatcgagaggaatgatcgcacgtgaaccgccagtactcgtgttcagttcacgcacacacgaaatatctacgagagaaccgcgtcaaagtaagaaggcccccaaggcaataattgactatggaaaacaacatcactagattatttcctgtataacaatgccatgtactaattctataatgctcttgaaattaaggtcaccgttaaattggattaatatatgcacacgtacgtggcccttgatccggattacagccggccggcccatgtctaattgtccatcattgccgacgatatatactactcccgtaaaacgacacaaggttttttttcaaagggttgagttgaatcgaaggccgtgatgcgtgacgccatacgcgacgacggcggcgcggcaggcgtagatagctagcgagcaagcaggaagaatccatggttacgtgcggtacgcgtgccattaatttgacggttgagaactccatccggtctcctgtttgatcgatcgtcggtcgagcatttattatttcttgtaccaatctgcgcacgtacgtacgtaggctgaggcatgcatctatatatggctcgtgcgcatatatacagcacctacaaaggtgacaatcgtacgtgcgtatgtgcgggtggaccttagtcaaacagtgaactcagcatatatatatgcacaagaatttttcccttgcttgatttgtttatacgtacaagctagtgtgtacacgccgcaacacatgcacaattgcacaaacacaaataaagaaataacatacgttggcatatagtataagtcaagttttgatataagctattagtaaatatttatgcttgaaacatttttttctactattatctcgcagtagcactaacagagccaagagcactaaaaaataaggcaacaagtagattctactgaataatgattatgttcaaggtaaattatttcagcggtggaccatgatatatgctacctaagtatttagttcgatcgggtggcctcccacctacctatgaggtgtgcctctactattgtgtttgttatcttttgtggagatagaaaaacatatatatggattgtcgacctagttgtgttggtcgtataggaactatttatattgcgttgagaagtgttcttaattttagtagtcttcctcacctacctgacattaagtacaacctccaaaatctttttatatttgtacacaacataatctctttacatttttttcccaacgtgcactccgtctgccttgctaatgttgggccaccagttgacgcctttgaaacatcaccttcctcactttcacttccatctacctcaaacccctccatgcaatctgcctctccggcccgttcccctctatgcttgatcatctttgtcgatcgagcctttcgtcacattgcaccttcctaatctccatcattttttaggaaataagcgtcatcattcacatcctcgcaccatttaactttcctacctacgtcacgaaacatatatacatcctcttcttttatgctgccaagatggtgacaaacaaagcctcttgtatctaaagcccgtccttcctcccttttacacatctagaacactaatttaatgttgtgctaccacttcgtagctatttgcaataagggatcttttaaagcattggcggaaccaaaactttctagagcccggacaaatctaactgtgccaaagatttattgtgaacttactattatctctctccataaccgcgattaaacttggcggtttaaccgcaaaaaaaatcaggtggccgccaagaaaatttcggattcttgtagtgtttgccaagcggtgaactcaccactgttgtgaggagcgctcatcagagaagccacaccattgtcactggtaagcatatccttcccctccaatggttagagggatgaagaagcatggtaatttttccctatttttaatataatttatttaccgtatggatttctcctacaatgttttccttaagaaaaaaacgaagcatagtaagtaagccgtttgattgggatcgaacagccatcatcaatctgcttatattttctcatcaacagctaattaaaaaaacatgagaaacataatgccttctcgccacctcctagccaggggcggatccagcataggggcagcggggtctcgagccctcactacttgcatgaagattatgagagcccccacgaagataccactaaatttttttaccatatatagttagaaggagggctataactctatctagtttattcagatcccactgctatttatttctgtatcagtcactgctcctgcctccctgagtagcttaattagaaatgccctcgtacttatgcttgcaggctgtagcactgtaggtcacaatagcgaaaattttcttgtcccaatccaaaagtaagtcggcttatgtgaatggtatctcgtgtgctcacagtgcacacagcacatatacacatgcgccgctgatcggcgagggagagatggatgcggtaagcccccgcagtctgtggacccaatccacagccgcttgacgacaccggccgctctcgcctgcgtgagcatttctcccccatcaactctaccggagttatacactcctcttttctataattctactacgaccctcacttgtctcactctgtacatcagactgtacatttctgtacatgtgaaccctgatagatacgtatgcgtaggcatcggaaaaggggtaaataaattaaatcgacttgtcccctgaataaacctaaggtaaaaaggctgtttaaaaatatatagtagcagagaggagagagcatatagtagagtgtggaaagaaggaagcaaaagggggagagagaaaagtatgacaaggagatgaaagaaatcagacaacaaccttcttagcctcctcctctccactagcttcttctcccttgccatgagttccctagtagaccaggactagcaggcaagagcaagcagctggaagagtattagcagcatgcagctctagagacgacaggcacagaggaggggagaggtatggagaagaagctaagcaaagctcttgtttttgctttggttctttagtttatatacgtcttgggtttgggtgtttgcgagctttttttttcttcttttcctttgtttctgagtgtaactgtttgtttggatttccctgcgcactttgttcttttgttcatctcggacgagccctaaccctttggagtttttccccagcttcttgtcgattcctttgttgttgtttcagatcgattccaagcagatacttacataagtattgagaggtattctcatccctttctgtttctcctttctgctcttttcttttggttttatccccatcctccttttgctagagaactttctgacatcttctcatctttgtgtgcttgcatgatgtgtagtgtcaatcttggttgttcttgcttgagtttgttatcgccatgtctcactcggacactacagcttcttgcagtgacgggaaatcaagaaaagaaagctgctactagcccaagccaaagctctacaagaagggaaaagattcccttctgttcttgagtagctagcttcgctcgagggtaattaaatctgagagcggccatggcatccaactcatcagcggcagctgtggcggcgttgtttggaattagggatggcgaccatgaggaccagattaagccgctatttgcccagcagcagcaacaccaccaccaccagccacctatggcgccatccaacgccgcggcggcggcttctgcggcagggtcggcggccggtcaagcggccgtggcggcgccaccagcgaagaagaagagaaccttaccaggtaatccatgcaaagtttatccctttttttttgttcagtttcagactttcagtcatgcatgcatggatgccagcatagcattcttctatctccttgctgatcttgtctcgatttatcggttggagcgagtttcaattcctttgttttagcatgcacaagaagacagctagctactgctagcttgtccaagattcacatggtttttgtatcgattttaccgtgtttgtctagtgattttttttcttggttttgaaatttttgattcacatgcataatgtcttttttggaagggatttgtacgctagcatagagtccaagatttggttcccttggatttaaattacatgaaatggtcctatatcttcttcggtttctaatttctctctcttctctagcttggtccaatgaatttcttacgcacctggattgtagtcacccagcactacttcatttaaagcttgtagtctcacctggatgaatagtatagtcctcagttcaggtgaaggtacaaagcacaaaatgatttcttgttttttttttgtttttttttctcatatgtcattataaatcagacttatttttcagtagatagattggttcccctaattatttctttaccgcagtaaagttccttaattcaaatagacaatcaccatcatttaatcatcaattaatcttagagattttttgggcaagattccatgtacgtgagctgttctcctcttcacccttgctggcctcttcctttctcttaccaatcatgagagatgcagatacgggccatgacatatgcacgagcaatgtcaattcatttgttccctacatgcctcttgctgcaaaattaattctcttttgccccccccccctccttcataatctcgtgcaaatattctctttttgccttaatttgtccctggctactaaaatcaaaaggaaaaaaaatcactactccccattacaaatcatccttgcatgcctaaccgatcttcatcaccataaatctactccgattgggaaattctttcgtgttaagaaacatgcatgcgtttgtcatcatcagccacactgcaatttggttttgtcatcagtagtgcggcaagctgtactccttatttctctctcttctaatccccacataatgttaaaaccaccgtgcatctatatctatatatcgatctaaattaaccattcacatatatgcatctaatatttatgttgaactaacattttgatcaggtagtgcagcgcatgcatatgtatatactcctatcttctaattaatactactttgcactagtactaataagctgtacttgcatgcattgcatgcgcagacccggacgcggaggtgatagcgctgtcgccgaagacgctgctggcgacgaaccggttcgtgtgcgaggtgtgcaacaaggggttccagcgggagcagaacctgcagctgcaccggcgcgggcacaacctgccgtggaagctgaagcagaagaacccgctgcaggcgcagcgccgccgggtgtacctgtgcccggagccgacgtgcgtccaccacgacccctcccgcgccctcggcgacctcaccggcatcaagaagcacttctgccgcaagcacggcgagaagaagtggaagtgcgacaagtgctccaagcgctacgccgtccagtccgactggaaggcccactccaagatctgcggcacccgcgagtaccgctgcgactgcggcaccctcttctcccggtaagcccacactctacccatctctctactacgtatatatgtatggtgtttttcgcagcttgatttctccatctgcatgagacgttgcatgtgtgtgcgtgctagctagcgaagaatgtttagtagtgtgcgcacaaaaatggcagcatgcacgttcggccggggttagggttttgtctgggtggtatagtgtagtactttaactaatctgttcacgagggttaatggctagtgggaggagaagaattatcgatgtcgtacacacgtgtacgtaccgcgtggtctgcaggatgcatatgcatatgtatgggcgaagagcattagggctactgctcgcacgtgatcttgccattgtcttgctgatgcaaatgtttccaagcgttcttgtgctggcatgcatcgtcgtcaagcctggctgaaaaggcctcccgtctcttcctcatgctatatatattacaagtcacacaaataaacgcgatatgtttatatatgtgtgcgcgtgtgttatactgattcatggccccaattcgggatcgatatgcccggaacgtcgacagctagctagcacattcttaattcgttgggctgtctgtctattcatcagacaactgaattttgaaatatctaagcggtcagaattattccaagatccgtgcaataactatatatatatatatatatacatatgtaagagcatgaccaacagttctctaaatgttaataattaaatatacactgtaagacactctcctacagttttttccttaaaaaaagacaatgctcctaaataaaatccaaccataaaaagatgggtttttctatgaaaattaggatccaacaattcccatgtagagatgataaaaaaaatttagcatccccaactccgtttttatcgttctccacatctagggaatggcacacccaaaaaactgatcatgcgtgggatgagagctatcgagatagcggcatggaaggtgggcgagggagatcgcccatgaggagagaagggcccctttttattttaggaaattaagtttagactatctgttatagagatcaaggtatattttatatccttaaattcttattagagatttcaaataagatatttattagaggagaatattggacatttgttggggatgcaataaaccacttcgatgcccggaatcctgatccatctctcgcctccgctagctcttcgatcgatctccaccttattggaaggcgccagaaattccagctagttgtcctctccatatcaaatcctccatccacaccatagcgttattattggggtatatatagcttcatctatgatatacagctcatgcagctgaagttcggatgtcgctggtgccaagagggcttaccaatgaagtcactagtgatgttcttagtgagtcatcctgttgcctccctctcttcctcgcacctctctcggtcggctagaggtagaagatgcttgccacttgtcgaatcgtcggatcaagatcttcatagatcaattggccaagatttaagaaacaaaatcccagtggactagtaaatagaaaaattgtcgtccatatatataaaaatataattaaacaagcttatatgtgtggcactacacgtctgcactatatttttattttaatgaatcagcgagccgtcaattttattgaatatagaaggagtaaattgtacaaaagaaatgagctgtacacgtctgcattatacacccccatatgatcgtaattggctaatctgttttgagctgccatatagaagagtatggatatatatagtctttcgctgtgtatatccacccgtggattgagccgactttctatttatatctaaaaataatataatgcaaactataacttatatcatgcagaatatgatatgtgaatgtgtgtgagctggccggctagatagatgtgcggtgcagggcctttcgttggccttacgtgtcagaagagcctgtggttcacgcttcacacggcttagatttccctcggatacatgcatactccgatccaggcccttacatctgatctcacgagtcacatgggtgcaacttcgcttgctagcagcagtgtcacgcatactgcagactctctctctctctctctctctctctctctctctctctctctctctctctctctctccagaatagcagcaagtgttcacccctatctttcacaactcgagcattttcctctctggcttcatggcatgacctctgcatgcagagttcttagcatcaataattttgatgcaatgggggcctagccctatatatatgtgtaggcttttgtagttttgcatgtgttttttcatccatatatattcttgttggatcaccctttggttccttggaaaatgagctttttacaaagtcttctcatgtctccgggcgagttggcgtgtgcgtgtgctactgctctctaccatggcgatgtccaatatgtctactactagtactagctagtagtagaatttcttttcccagccctttctccttggaagcttcttgcaccatatatattaattaagaacctatatatatcggtgacgccatgctatatcaatctgcctactcttttcctcgttttcatccctgattgacatgagtttctgggatctcgagcttcaattgagtgtgatagaagtcaagtgatgaaacgaacaggttttagtcaaccccacacttgaaaacatgtagaatcactggtagatttagattttttttctaaaaaaaagatttataattttttaaagtacatgcaaacacaagtacgaacaattatatatcaatgttattgaacacttcaaatacaagacattataaaaatgtgattcattgacaaccctgggtggcctaggagctacccggggtcgctaggcatttatctgcaccttggtagaagttgtacatattttgagcctttaaaggtcattctaaaataagaaggtcattgccctccttttgcgtgtcgcttacataatcaataaaacattaataacgtatattgggttgtcatatagttaccctacaaatatgtatgttcaaacttaatttgaacaagtgggaaaaaatataactgcgggaaatacacacacacactactttaatttcatagttaattaggtttgttttttctttgatgtaaatgaatttggtcgtggatgtctgtacagtaatacatgcatgtgacggcataatctatatggccaaatcttgttagcttataactatttagatttcatacatgaaacgagggcgcgcacgacacacattcttgatttaatatagcttaaaatacttctcccaagattttttttttcggaatactaacagtaggagttgttacacgcaatagataaaattcacttacttgtagaagaaagaattaaagatatttcaacgatagtatatcacacagttctactgtttagacgaccattatttctcgtacccacctcaagtcatacgcacagtgtacacacattcatgcatccttgccaattactgtactagctagtactccagcttgtaactttttccgtacaaatatatggtcgtcctgtgtatggaacttggaatcttatcggttcaaggcaagaatggaacgtacgtactacgtctcctaaaagatgcaaatatataattcttgaatacacattgcatctaattattatagtgcttttttgcatggatttctgtactgttgtgcttaacatgcaattgattagagaaaaataatcattttctcgggagtggattttaaactctcgagaggatatcccctcgttatttgcatgcaattcaaatagttacgaaaaaaatctaaataaaatatgagaagatgtattaatatgtgatatatcgctccacaaacatgcaagttaaaattcaacttttacatgtcgtaacgaaaaaaaataaatttaaccatgaatatgcattaactagctataatttaattttttttcgttgtgagatatagaagtcgaatttgagcttcatgtttgtggagtgatatatcccatattaatatatcttttcatttttttaaaaaaaacaactagactatttgagtgacatgcaaacaattatgggacatccttctaagagtttagaataaaaatactattttctcaactctctttgagagtttgaggagagggggattgagaagattgggaagatacacaaaacgaggtgagctattagcgcatgattaattgagtattaactattttaaattttaaaaatggattaatatgattttttaaagcaactttcctataaaaaatttttacaaaaaatacaccgtctagtagtttgggaagcgtgcacgcggaatacgatgtccttttctcacccaatcccccagaactcatcacaaagaacgcagccttagttgttagtatcgatatgatcaatgccttctttccaatatatagtaaactagtcgatacaccgctttttgctgcggaatatgtcgatgaatgcatgttatatatcatagaaatggtaatgtatatgtttaaataatgtaaaaataatgtggagatattgatttgacattgtttgcatattgagttctaaaaatacaacaaaattgtataagtcttttgtttttttctagtcaacttatttaattttgaccaagtttatagaaaaatataatagtatttaaaaaataaacatattattagaatatatcaaatgttagatttaataaaattaatttgatattttagatgtcgctaaatttttctatacatttaaaagaaattgacgagggaaaaaaaatcaaataacttaccgtataaaatagagagagtactactacatttgcacggatgacacagcaaaaattttgcatctagctgtctagctgatgagcaccacttcacgtgatttctgtatcagtacccgatactgtagtgacatgcactgtccttcgagttatcttcacttttgcgtcgtacaatttcacgtgcaaacttgtgccgcacggacagtgatcagtttgatggtacatcgcatgtgtccgtcgtcgtccatgcaaatgcaggagggacagcttcatcacccaccgcgccttctgcgacgccctcgcccaggagagcgcgcggctgccacccgccgccgccggccacctctacggctccgccggcgccgccaacatggcgctcagcctctcccaggtcggctcccacctcgcctccaccctccaggaccacggccaccaccaccaccatcacggcgcctccccggacctcctccgcttcggcggcagcggcggtggcgccatggctgcacgcctcgagcacctcctgtcgtcgtccagcgcctccgcgttccggcccctgccgccgccgcagcagcagcctccggcgccgttcctcctcggcgcggcgccgcaggggttcggcgacggcggcgacggcagtggtccgcacggattcttgcagggtaagccgttccatggcctcatgcagctccctgacctccaagggaatggcaccggcgggccgtcgccgtcgggtccgggtctctacaacctcggctacatcgccaacagcgcgaacagctcgggtacttccagccatggccacgcgagccagggacagatgacgaacaccgaccagttcagcgaaggagggggtggtggcggcggcggcggcggttcagagacatcggcggcggcgctgttcggcgccggtgggaacttctccggcggcgaccaccaccaggtttctcctgccgggatgtacgcgaatgatcaggccatgatgctgccgcagatgtcggcgaccgcgctgctccagaaggcggcgcagatgggctcgagcacgtcgagcgcgaacggcgccggcgcgtccgtgttcggcggcggcttcgccggctcgtcggcgccgtcgtccatcccgcacggccgcgggacgaccatggtcgaccaggggcagatgcacctccagagcctgatgaactcgctcgccggcggtggcaacgccgaccaccagggcatgtttgggagtggcagcatgattgacccgaggctgtacgacatggaccagcacgaggtgaagttcagcctgcagcgcggcggcggcggcggcggcgacggcgacgtgacgcgtgacttcctcggcgtcggcggcggcggtttcatgagggggatgtcgatggcgagaggggagcaccatggcggtggcggcagcgacatgcatggcaccttggaggccgagatgaagtcggcgtcgtcgtccttcaacggaggcaggatgcaatgatctcttaagcatatatacgtggcacgttggcatcaacatgcatggcaggaataagttgttgatttgcaggttgcaatacaatgctgtgacttgtgacacatgtgatagatgtttttgcatgcatccatgcaaaaggataaagccagctttgatgatgatacaatcttagcgagagacatggtgagcagaagagcttctcctagactcctactaatgcatgatgaagctagatcaacaggaatcatgagacttgagctgaagttaggcgttattactgcaatatactattctgttcctgatagatcttattgctaaatttcatttgaaagaataggtcttgctaaatgtaattgggttaattgtactggatcagggataactgcaatgagactgtattatcttcttctttcttttctgtcagacgaattataggtctgtgggggataatgagacttaattaccctactgatcttttctattttttgtcctctttcagtcattcagttaaccctctagagcaaaaatattgttcttgcaattaatgcagttaatcatgatatatagtccatgttgtggtgtatgtcgtttcatgttaattatgtcatcaacgtgtcggctgtgttgctaatatagatgggttatgtttactgagctcgaaattttaaaaagtagccgatgagaaactactagatctttctataacttctgttgctagtttatttcgaaggtatatagctacaatttccaatataactttttttgctagtttattcttgggttctatctatagctactaacattcacaatcaagacgaataatttaggttgttttgggagctagctggagattcttgaagtagctacaattcgccaaaaagcttcctaaaacaggtccataatccctgaagaagaacaagaaagaaaacaaagctaatatatttttatttttctccctgattataatcgattttttttatctttgtactattgttttcattatatatatacgggatggataaacaaacttaataaaaaatgattccaaccttttttttttccatttcctgcaactacatttaggtaattgttccaatatattcaaggggttgcaaaagggcctgtaacctagtggtttccagtatttaacggctttgtgtttttagtggtaggcgatgtacccgttgacagcgagacgtctgtggtgacttcgtcaatctccaggatttgccggtccagtcttcaaagatgctcataggggtagggtttacgtgcgtgcgttcatggggtgagtgtgcgtgcgttgtactgtgtaattctcaaaaatatatatatacatatatatattcaaggggttaattattttgcgactcattttcatttttatatagttagtatgatattcttttacccgtgtgtgtgcgcctatatatgtgattttgtaagattgataaattatgttaacacctagataacttgcaccaaaaggatctcttgaaaacaggagggcggtgcatgagtgtgatctaaagtgttgttgaataaaaatgcaccagtagaaatcatcacccaactcaggccatgtttcattttttgtttttgattctgccccaacaattaattttgaagaaaaacaaatagcttgattccggaaacagattagcaaaatcaaatcctgttttttttcttctaaaatccaaaagcaggatattgagctatttgtggattttgggtaatgatgttcacggcgagtattgcgactatttccaaatccacaatcaatttaagaacttctaaaaatcacaatccagaaaccggattatgtgaatcaaaagaaaaagaatcagggcctcaatttgctttaaaatagcttgagatttcctatcttatatactacaatttcaaagtatttttataaatttgtaataaacatataaatcattaatgatcacatcattcaaaactgcaattataactttctacattggaacatatataattgatttcacctagtacaaatctagccaacgttgttaagttattaaatattttgggataacgattgggttacatgtatatgagatatatataaaaccattgaaaagttataatagatatgcgattgatcaatatgaaatgtgatttttaagtcctggaaataacatttcaaaccattatccttttctgaaaaattgtgagagaattatatggtctatatattaattttaatattatttgggatttgaagtatttcaaaattgagtggatttcatagcctcaattaattctcaaaaagttggtgctttctgtgcagatctggtcaaattattaaaaactagagccactttcgacctatatattaattccccctctcaattatatgtttgacttctgtctcatagcgcatcactcaactaattaatgttcgaatttttttttggtccaaatgaaaattgaatgattccgattttcaacttgggatttaagtttcaaagagtgttttgcaacaacctcaaagacagcacgccaagcgggaaattcttctgacatgaaggttttgcttggggtgagggcacttgataggttctcgcatacacttggctatatatgtagcgagcaggggaactaagaagaatatatagctcatggtcatgcaatgacgagtttggcggctagctctatcatttgtctctaattagcttatcagttatgcaaaaaaaataaatctaattattttagagttgtttttattgtgtttgtttttatgcattaccttttaaatcgctaattaagaacacaaattaatatacaaattttacccataataacttttagttttattgcgttgttcattttccacggatgaaccgtagagtaaatgatgggtgatcgtacgtctgggcttggtactgccacaaatgattggctgcttgttgtggcgtccgcgagctagcaaccttacagctttatccataaaatagcgaaagcgtatctagtgagatgttatccacaacttaatttgccaactagactagttcatcataccgttgattggtttctctataatgtgatctcactgtctcggagtactcctggtatttttctttcaaccggtcaaagaaagtgcatatattcaaatttaattaaaattttgttcagattttgaatttatctcgatgagattttgctcaagatagaggccggttagctcttcgctggcactcctcaattaggttttgaagagagggcaaggagaaaaatgaaaaaaccgtggttcctatcgctatcttgcatactacggcaaccgtgtgacgcagggcgtatacaggacgtgacagcgatgattccccgtggtggggggacaaggtgttcgatcgttcggtacatgcctgcctcgatcgacgttgatatttcacaggagaacggaattagacaaagtcctcgagtacattctcttcttaattataaagtagggcatatacatatgcatgagtacgtccctaattccatttgtgcattaaaaaagttcagcacctagacggcaaaattaattagtcaacaatctgcaagcctcgatggcgatctctgcacgtacttttcgttggtaattaaagggtagcgcccaagttaatatatacttatagggtttgcttgcacgaagctcgcgttccattctgatgataattctgagggaaaacaagtgaatgtttggtagctggtgaaagcgacctttcgagatcgtctgtcgccacaggccacctagtggcgtcgtgttgcctgtatgtgtcgtgtccgtgacagaatactaatgatacagatgatgacgagcttaagatttggcacagtatacagttggtaccatatatgctttcaaacggaaggataaaaagatcaaaagagtagagtcttgtgtaaacagcatgctagaataatagcagacagctagaagagttctgcttgataaattgtttgtccttaatgactaatgcacttgtgtgtacttaagtgaaacaatcatggatatcatcggacgtttgtaatggccctcataatgtctaatcgatcttcaggaaaatgatggatatgctgtaccttttgtactagaagcagtacgcaatgtactatacaataattatggtgattgcaattctgtgttagtgttctggaagctctcagagctacagaaccaaattataattacattgcccagcccaactgccgggaacaaattaagctgttgctaaacttcctttttactaactgcatgaacctgtagaaagcttttgctcacctaacacttgtcattagcttgtgccaggttaacaactctgcacacacacatctgcactgctgctgatgtggcgcctgttttgtttgtagcgttgtcgcagcgtgccttggcctggatgcacggcgagatccttcgcctatagccaccggctgataattgcgcatctatactactataatatatcgcccacggtcacgggcgtgttctagtttctgagggccatatggccgggagaatccaatgtgtgaatatatgctggttaacatatagctttccagtaagcaaatcatagtgcaggagaagggagctgtgtgatcgctgtggcttcttctgtaggccgttttggtgttatgctcatgaaaacttcagaaacaattccagccgtgggtgcaaagcaggtgttgggtttgtaccaggtaggggtctgtctggacgagcggctggaataaattagtagaatataccatgcctttgccgtgtaggtagatgtagcaaagcaacatagctagtgtagagcgctcaggtacagaactattacatgttgactaggaaaatgtcctgtggcactgtataggatagttgctctgcatgctcagacaaactatttggaatgtatgtctttggaaaaaaagaataaaaatgaaagcaatcatacttagagctgtctaccatcaaacaactatttcaaccttgacattatttgagcaaaagtgggctaaactgcttaatgcaaatctagattctatgtaccaggagccaactaagcaataattttgtccgagacaaaaggctaataatccttgcgaatcaaggtgcgcatccaacaagtggaaaggaaccgcagtagctgagatcagcttgtcctggaaacatggcagcaatgtaattgtcaattattacatttcttcgacgatatgatttgagtagccacactgaaagagtctagaatcctcaacttctagtgttgataatagataaacaaccagatcatggtcgatagttcacagcaccacaatcattaacgtacacacactataggtcgttccgtcttagataacagggggcgactcaaaccgtcagacgttttcccccatacacaaatattcccaaacttagcagtagaacatgacacgtttgacattttccttcagatcaggaagcggccttacagcaacattcccagcaggcttagtgctgcgtgcaccaggaagggggccaccgccacgggtatgggcaccgctcgccatcgacccactatctgaagtatccggctccatgtaaaatcgagctcgaaatgccgcgagatgggcataatatgcaggaggaactgcagaaatcaaatccattgtaagaatatgtagccacaccgagggaccaaggggttaacgttttctaatcaggttaaatagaggagtcatctgcttaccgattgatacggaacgggtgcaccttgcatagctgcaataatagggttacagggacaatggttagcttactagtcttgtaataatgtactcctaaatagcaatatataatgacatgaaagaaaattacgtgtagcacaagttgtttgtcagagtttgcaaaccatcagcagtgaacttgttctcatcccacagaacatgataatgtgcagggcgacttgttccctaaaaatagcataaagtaaaatcaagtccatttcatcttgtaaaagaatgttttttttgttgcggagaagtaatatttgtaagtgcagaaaagctgacctgaatgcccgcatggctacacaggtagaaatcaaactcagtaggatggcatatctttgaatcaaccacggtgcctgaaatcagatgaacataaagaaattaaattcaggtaaagaaatgaggtgtcaatcatagggttaacaagatatacaaaataactaaaattacaggaaggcgacaaattacctggtagtatatttccacttctgtcaacagtgcgctggtccttgtggttattagcaaacagccttgtgtgatgacgcttctggaccaccacaaaggtaacgggtggctgataatcggcttccaaagatgcacatgcctagtttttattgaactgttagtcggggactagagagataacttcatggtgagaagaaaagtagataaattaaaatcacctttctaatggcatcaagctcataaaacagaacctgataaaactgtccttcactgacaccatccctgaaatgagagatgttaaatatgtggaaaaacagtaccaactgaatatgcagttgtgcacaaatgaagaaaattacctgtaaaatataatcctctggggtttctgtccagttgccctcttgaaagaaatgagaagctctctgcatatttaactaatagaatttatatatgtactactaccaagaaatattcaggttcaatgcgaactaggacatatatacctgatcattccaccacttacagttcctctttgaggatctttccatactttaaaaagatcctgtatcaattcctgacgatgggcctgtgcactcactaatccggcatatttggtgacctcaggccagtcttgagaagcaacaacctgcatgaagcatgaaatcaccaaaaacaatcagaaggcaacgcaagacataaaaaaggtcattgttctatcatatgataataaagagacggtatgcgtaacattgaaaagctatgcacttacagctgcaatggaagggctagaatcttctccaggatggggatgtgtaacatcagcaccaaaaatgatcgttggcctatcactcacaaggggaatcctccttgtcaaagcatcaacaagtactgtatttcttcctcccacctataaattaaaggaatataaattactacaaaataaaggtaaaaaactacaaaatcgggcaaaaataattggtagaacatttccgaaccttaacattgattttaagggcaacgtttgctaaatactgtttgctcatcttaaaaacatgcttcgtaagacagcattgcgagaccaatccaagatcagtctcacatatccttttgagatcgcctgaggattgacaagcatattaataaagacttttttatcagataacaatcaagtgttgttttgaaataaaaaggcataccataaagagaaccattattgtcaggcaatattgcaatcagcaggtcaagctccccgccctgtggtttcagtatattcatggcctcttgatagcgtgccttgagcgctctttccacatgttcaggtcttgcagtcactagaggaaccacaggatcaattgagaagtcctacaacgagaggatatgaagcatgtgaaaggatgttatggtccaagaatatacagagtcaaatagcaacactgaaagagatgtctggaggcaccattagatggaagaaaaacttaccatcccagatatttggcacataatagcaagctcgcgacagaaactcctagcagcattatcttggacatgacgagaaaaattgatgcatgtccagttgttaactctaccaccattgaccattttctgcaacaagcacattaaagaaaactaattgtcgcaactgtacgcaattatagttgggagacatcttgaaagacggcaaagcaacagttattgaagaacagaagaaaaccaatttttttgttggaaaagaaaaaaaggatagcctaatactgtttttaggggatgcttcgtataggtttgttttctaataactcacttctaaaaccataccttattcatcatattccattggccaattcttggcaagacatccttctctctgccactatcgtggtacttaagctgcaaagaatattagtcaaatattgaggcataacatacaaaaggcatgagatattgacaaatgtcagccatgtcttgaactttgatcttacccaggggggtggtagaacacgagcttcaacagatgcaagtcgctcatcgatccttatgccaaactcctgtgcatatggatcctgatggtatgcattgtgatgcacagtctggtcatcaaagacaaaacaataaaattataaaacttagaagccgattctgatgttccaatagggaacccgattaatggttatatatccaagtaacacaaatagatggtgagctacatttgaaatgtgttttggcataacaattgacatgaatcaaaccaccttaatatgtaaaaacatatagaaacagtttaaatccaaaattaaaatataacgaggactcaactgtgggtacaatagcaaagcattggatatttgagtaagaactaaaaaaacttgttttagagttcagacccacaaaaaattgaaataaggaaaccacaaaacctttacaaataaagggcttgccaatacataaggcaatacaaactctagatacaataacaagtgtttatacatactcaaatactcagtccaaaaagagtagataaaaattttacatgatattggaagaacttatatgcatggcctaaaatgcatatggcttaataaagaaatagatcaccaaggcatgaaacaatgaaatagcacagttttatagtacaacaatgttatagggcagttggaagtaatctgccaacaaaatgcacccataattacctgcaaaatgtccagctcacgctcttgagggcgctggcaggtcactttaagaagagcagttatctgcttctcatttagtctttttgagtaacgctgtccctccacaatcttacagacctgaaagttaagagtgatatgaaacacttttctgatatcataaaggtgcctatagcatttctgaccttaatgggtgttgaacaaaaggaggtttcatacttcataaagatggcattttaggacactaacctccattggtagataatttggcctttgttgattgcccacttgcaagcaaggcaaagttgtgtgcttaatgttaaatccatatgtctcctggaagtattgcaccaccgtcttcacagtaccatgattatcaatgggaaaactatacaggacaaaccaagcaagtgaaatcagcaaattatccaatcagacacacatctgcaaccacatgatagagaggcttcagatatgagcaaagcagactacgtacgacaactctcgtgttgcttgcgaggtaaggccagaaatgcgatacttcctgcgcatattgcctctatgtgtgacctcaacctttacaccccttagggccttcttgatctgaccaatgggacagtaaggaagcatgtaaagcaaacacagagaacacaaatatacaaataaagtagtcaataggataacctaaccttcacacgatcagcatcagataatggtctaactgagatgtctctgttcaaaagctgtgcaacaaagtcaatcacaggtagaggctcaatgaatgctgtcgatgacatatctgcaggacaaaatatcaggttaccccccagatgcaagagaaaagagacgtggtttgatgatctttaccaatatatgacaatgtacacacattctagatgattatcaaccataaccagtgacagataaatattgaatacaacatctaagattcaaggtttcccaatacaagtgattcctaatattggctgctattgtaccataacattagattatgataatttgctttgcaaccaacaagctcaattaatcgaaatttgtaatttatgtagataacttccacagatgtgcatgtaatttatgcagcttagataaactttcttactatcagcctacaacagaaagtggtgtaagtaggaaaaatactaggaaatgaaatattaaaaaagaattagcagttaagagttccatgtatcatagaaatctcctaagttattgtttccaaaacacaaatgatatttatcaatagtcagtcaaatagatcattcaatgagaacacagacctacaggttagtctaaagggggcaaaaaaaagtagctattctaaattataaggaattattatttttcttcgagtagtaacatggaacatgaaaacgaggacttggaatctgaccaatattcagagaaagtcccatctgcgtgggtcgtatgctttggtaaaaaccacgccaactttccaggccctcgccaagttgttggcgccttcctaagttaggcgaataaaatgaccttgcaactggagagtacctacatataaaaaatatagaaatgttcaaaagcttgctaacatgataatgatatagcaacaaatggcagggtaaatttaccttgcagtaggcaattcacgtagaacaatgtcaagaacttgaagagcttcttgaggagcatccgcttgccttccagctaaaaacatggctaaatggtggagatcagcgcgtgcagcaaatttgatcacgaccttaaatggtctctcacgcctgaagacaagcagatgaatcattggaagatgaatttatcaaattgttgaatgttgatatgtccagagagtacctctgtgcaccttgcccaacagcaaggctctcttcctcatcctgcagaataacgtcaaaggtcctagaagtaaatggtaatggaccagctgtgtataagctcttccttccatcatagactggaagacggccacccaaatgagactgcctatattgtgttacaatttctccaatgacagcacgattgacaccacgtgaaggaacctcaggagttatagacacctgaaagcatgttaaatgaaagctcatgaaaaacaacaaaagttacaaagcttcatatgtataagtataacaaggcaacacataaacaagatcttacatcatactggtgaaggtctttgtcaggcaattcagcaaagaaatggttggctttcacgatgcacctatcaccaaatgtacccttgccagggcgcattggaaatctcactgatttgctcgatggtggtgctggttgaatggcctggctagtggggctttgaccctggatggcaagttcctgaaactgatgttggacttcttcgctgctggcctcaacaggcagcgaagatgggccagttcttgatggtgatggtgcaaccaccgtagcttggtactggtcttgtgaggcttggtgcagctcgggaactgttcttgatggactggcaggaactccatgtccaccactgccactcctgtgttgtggcattcctccttgccgttggacaccacggccatagtactcatgtgcttgatattcaaccggaccaccacctggttgatgtgatgttggccctccacgaccctggtaacgtccaccacgtccctggtgttgtccaccaccacgaccagcttgttgagcatattgaggattggcaggttgccaaccaccacctccatgctgttgagctctctcaggtcgctgtgaaggaccccgtccaggagctccagtggcttgttgagttccagaactttccccagcattacggggttcagtttttttctttctcatcatggctaaagctgcaatgcaaggtgcagttatagctttagtattattattatcataggctaatacaaatctaaagagtgatggaggcccaaggcacaaaatcaagtgcaaaacagataagaaagtagaatgaccaggcaaatactataataaatagaaagagggaaatccatcattgccatacaatcgaagatactacatctgccacattgaatgacctgaattacaacatggtttataatctttcaggcaacggcggtacagcacataatattacatagtctttgccaccatattaatgatactatctttgttatgtccccaaatacccccaaaaattcaaagtatctttacaaagtgcagctgctcccagattcatgcattaaaagaaaaagaggagttacaagcaacaagataaacttttttctttttccacatgagatgcagtgatcgacagtagtcaatactcaggtcagcatgctaaaaagtcagagaaagtgagcgagaatcattgtgaatactgaataggacgaaattcgacaaggtaattaaacaagtcacatcatcctaattcccttgacaatgttagaaagccacacaaatatgacatgcatgatcaagtgggagtaattttgctaaagaagaaaagtaaataatagggaaatgggagagatgggaacttggaaatcccttgacaatgttagaaagccacaaacaaatatgacatgcgtgatcaagtgggagtaattttgggaaatgggagagatgggaacttggaaatgaaatggaagtttgatgagcaatgtagtggaagtaattttgctgaggaagaaaagtaaataatagggaaatgcaaaagaaaagaaaaataaatgggtgcagcatcatcttgcatcttaagtactcattaggttttccactttcagaccacgccagcatcatcttgcctgtaagtactatgtttatacaaagtattaggttttccactttcagaccacgccagcatcatcttgcatgtaagtactatgtttatacaaagtattaggttttccattttcagaccacgccagcatcatcttgtatcttgcatctttaacttaagtactatgtttatatatatcggatggattgcatatatggttgcttatccagcatcatctttctttgcatcctaaatactatgtttaacgaagtatatatcggatggattgcatatatggttgcttatccagcatcatctttgcatcctaaatactatgtttaacgaaggattaggtatatatcagaaggattgcattgattaggttcttttccaaataaatactatgtttaacgaaggattaggtatatatcggaaggattgcattgattaggttcttttccaaataaatactacagatcgtgtataacaatctgcattgtaaacatcgaggtaaatcaggtagcaatagcatagaacaacatcgcatcaaccaacaaacaaaggaaatcaggtagcaatagcatataacaacatcgcatcaaccaacaaacaaattacaggatattgcagatcaaccccaacactaacacgtctcactcacgcggggcacctacctcggggcacctaccttacaaatcgagacggatggcccgacagggattgctgggtaggggaacgattagagcgctggaaccggtgactctcccccttcgtcggcgccggcgccggcgcaagagccggtgcggacgagcgcgggcacgacgcggcgcgccgggccgatggaggaagacgggcggcggcggcgggcgagcgcctagcggtagcggagccgaggaaggaggcggcggctgcggaggggggtcgagggctcggtgcgggtgcgggtgcgcgtgcgcggcgaaggggactaggggtaggggaggcgaggggcgagcgaaccggggtgaggacgagggtgacgggagagcggttttgggcgaggtcggtcgtgcactcgtgggctgcgtgtggagacacttttatcctttctgctttattttcgtgtcaatcttctccctgttttcctccgtattttaaggagtctgaaaaaccgaatggtaattgataaggagaaacatccgttttataatcttaattgctttcctaaatagatttctaagagcaccagcacattagcgataatctatacccaaaatttgatttttttagtttcctaaactaaatagggagtgaaaaagctcaaagatagcctaaatttaatcccaaaattaaaagtggatcttttgttaaactaccaatagaaatttctgtttttttcattccacacccagcatgctcccaacataaattttcagcgctcgcacacgtaccagagattgagagtcgctctctcaccctcaaaatccatggggaaggagagagaaacacaccaactagagatggggagttgctctcttacctttaaatccacatagcaagatatatggggatagaaaatccaaaactactgcagtgctttttggatctgttggatcggattttttcactgaaatctctcgaaatcaattttgggaataaaataggatgattgttggtgatattaatcccttgaatttgttcgcttctacaccctcgtatttcaaaataaatacatctatcgaaaaggttattctagttaaactcttctagtacttcttgtatgaaagttagacccaacaatggatcggagggtatgtataatagatactaccaaaattttatatttttgttaagacttatcaaattttgatttggtattaagagcgaaacgtccttgaatttttaaacactttaatagcggaagttgagtgttttaactatatctagtctattatcttaaaaaaaggtaaaattgaaaacttcaaggaccaaaacgtgcataggtacttggtataacattgagccacgatgctagtaaagcacgattttagactgttattttcgctattttattagactgtttgttccacgcgtttaaacatatgttttcccaaaaatattttcttcctttccattatttagataactcgttaataaactgtttgctaagcctatttaaaaagtaataatttatctttataataagtagagaatccgctctcaaacttgacctaaacgttgctgtggaagccgacagtgtagcctatcaagtctataaggacaacaagtccatggtcaagagctttcggaggataaaaccagtcactccagcatcgtatagaagcgaatgcgacgtatacaagtttgaagtacaaacatgaaaatctcaagaccacaactgccatgtactgttgtactaacacgtactacttcaagtcatccagtacgtagtggtacttttttatggatggtttttactcctggttaaactttttttgaggcctcgtagaagatatacttttcttgagatgtgcaagtcaatctgcacatgttagactagtctatctgtttatgcaaccggtttgatctatgcacaaggaagaacaagcaatcgccaggtttactggtaaaccgtccatacatatagacagctgcttctagtagatttggttgtgttataataatcgttgttaaaggaaatgcgtactaggagcagtacacatataatgtagggaaaaataaaaggaaaatggagtacacatcgaaagatgccaagtggggagtgggccggcccgctgacgcctccctacatgtcagcagctagccagtgggccagaggcggcttcggcccactgatggaaaaaaaaaacctggaccgctaaagcctcgaaacgtgtcaggtggggtccacctgcaaggcccccaccgcacgcacctggtgcggcacccacgacctggcccgcggggcccttcctcggtcagtgtggcttccgttaaacaagatcgcgcgggccccaccaacctccgtggctatttcggtttcacgtggattagaaacaagctttgtcttcccattggttattccactattattgtccttggcttatctgccaaatcgcgagtcaaatttcctgctcacctgtcgtatttggtacatttcatttttcctaatccttctcatcgaagttgcaagcatattgttcatctgtcaaattcgttctcctgttcattgatttgattggctaatgttctggcagtgcgaaggtttgctggactcaccgagagaacgccagaacggcagcatgtcgacactcccggtccagattaacccagctccgccgatcgaacattcgacggcagaagagcctgtgctagcaatcattatccctaacctgatcgatcagccgatcctctcaatccgtctcccggcccaggccgcccccctaatttggccgtatcccggtgcacgtcaaatcaagatcaagaacgacaaaagggggagctgcatccaccagcgacaggggaacaggttggaaaacaactgctttgttacaacatgcacgggagactatttagtaactgtagcactaacaccaaccgcaacagtctaatgggcatctcacgtacgtacagttcgatcgacaggcaaaaactgtgttcacagaagcaaagaagggaagaagaatcaaataggaagaagaagaactgaagaagcgaggatcgaggaagaaacagcgatcgcgatcggagaggcaactaaaagcgggaatgcgtgcgtaccttgatgggagtagtacccgttgtccaactggaaggccatgtgcaagaagcttcgacaccgcggtcaaagccgcagcgcaaaggagctagcccctgatcacttcgtcgatcgccaatggcggatcgattgagatatatatgatatatcccgcagacagagtggaaactttctccttttgcttcctagggacggacgacgaatcaggaggaggagaacaaagaaataattggaggaggtggaggcgagagagagaggggtgcgtccttatagataaagaaccggtgtttgatttggcggtgggtgtggtggccgctcgcgcgcgagaaagcgacaccgggggaatcggcgatggtgtatgtgtagtattggcggacgacgcagcagcaacgcacggtcgctacctgcaaaccagattgctatctaatctagctattatctcgctgctggtgaagtggtggcaatggacttaatggtgaggcaccacacgcactgttcggaaacagggaggccattggcacccatttgcagctgtgccttagctagctagcttgccctgcagattatattgtggctaatgaagtagcttgatttggccatgctttctgctcctgctagcaagatcaaactggcgatgattaatgttattagccgggagttgtctagctaggacagtgcgttgccttcggggttaattaggaggtgacaatgacatgtggggccctggacgggaggaaggccaattccagtacagtagcccggtactccatgtcactatttatcagggtcgttgtgagtggtttcgagcctcgaatatgtgatatagtacgcaggaaagagacggatcactggattgacgctttatgtggctctgccgcttcgcgccaccaattggttgttttcagaggcaagtggccagtttggtttggtgcttatccttttgcaactaaacaattacggagaccttaattccatggcctatctatacgactatactgtatctgctttacatattcaggggtttgtttaacgcatagagcgcctagctagtcacacgccacaatggccgtgcacaaaagcatcggttaatttccggcaatcgcatgcaaaggcaaaggaggttagggggaggaaagcgagcattaagccattaattcccctgtgattgttgtgccctgtttcgtgatcaagttgcaatgagacgggaatatgccgtgcactcgtgcaaccctcggcttttgcacctactcgagaacaattaagaaaaggcaagtgtctgtctggaggcactagtagatagcgtactcgttgcgtgcgcaggtgtaaagcgcaacggagaccaatctgggtgtgcgagcgagcggcagcgactgcgaggcagcatcaggatcgcagagttacaagttgcaaagttgcaaggcctttccgagctccggcggcttctctcggttcgcctgcgagtgcgaggcagctcatgcacgcgttgtgttccccctgtctcgagagggtgttgtactgggcctctagtgggcttctttaggctacaattcatttcgtcggcgaatttcctataggaataagtccactttgactcccttaaaagtggctcgaatctaatccatgaccctaaaccgcaaaaccggatatctcgactccgaactattgaaaccggtgcaatttgactcccttggtggtttggagggcggtttcgctgacgtggcgctgacgtggcaatgttgacttagtatgtgggttgacatggcgcttaggtggcatttgaattaaaaacgcatacgtgggacccgtttgtcattcacacatattaaaaattgtggggcccactgatcttcctcccttccctctttctttctctttctcttctcgccccttcggccggccgcgggggtcacatgacaggttgtagcggcggcgggcgggggcagagcggcggcagcgagctcaccttccacgacgaccgcgtcgacctgcctcgccacgacggcgggcgggggcagagcggcggcggcgagctcaccttccacgacgaccgagtcgacctgccgcgcgctggtcaccgcccaacgccccggcgctgtccatggcgcgtaccgcgcaggccaacggcgtgtggttgtggagctcaggggagagtccttcacctacactcgccgcatttcatgccctaggaggctgccgtctcggccccccatggccggaaccctccacgaccccaactccgggtcaggaggcgaaaaatggcgcccactcctactactactcccatggtcgcgccgttcgcccagtatgtagccgactcctcctccacattgcaatccgccgccgccgctctggcccccacccaccgccgttgtagcctattcccccgcggccggccgtaaggggagagaagagaaagagaaagaaagaggggaggaagaagaaagagagaggggatgacatgtggggcccacatgtcagtgggccctacaattttcaatatgtgtgaatgacaaacgggtcccacgtatacgtttttaattcaaatgccacttaagtgccacgtcaacccacatactaggtcaacattgccacgtcagcgccacgtcagcgaaaccaccctccaaaaccaccaagggagtcaaattgcaccggtttcaatagttcaggtgtcgagatattcggttttacggtttagggtcatgaattaaattcgggtcacttttaagggagtcaaagtggacttattcctttgctatatatatgccgttttgttttttttccttaaaaatcatacgttttattttgacatatgattttcactggatttcaattttttaccgatcaagctgtcaagttagacctaatttcatcctttactcatttactccctctgtttcataaaaaatcaacgtagtacacatctagtattaggttggttttttatggaacgaaatgagtacattgatatagtccagctacacgcatgtatgggttggtttgattattcaaaaaagtaacgattgaatgaaattacattacaatttaaatgtagttataatgtaattaaattatctttatatttgtaattgcatttgtgtgattttgagtgatatataactagtctctttcgttagagccgacatgcctaggtgtgtattcggttagactgataaattcagtctaggtattcgttctttagtagatttctgtcaatggaaattaaagcatgatcagctctgaacaatagaattaaagaccgagcaattcagtcttggtcatgaccagattggacaatagaccctatgagtgagaattgaggagcataggcattttgcaaaaatctagctataaacaaacatcagatcagctgggtgggtgcaggattcacaattccgatgaaaaccaatcgaatttcgcgaaatttcgaggtttcgacgaggctttttcctatttttctagtcaccaattgaaatttcggttatttcgctcggaatttcaccaaagccgactggttttcgcgagctaatcagtaaactcagagaatttgtattcaaattttggtttataaaatttattcggaatctaccgacttttcaccggattttgcgaaaaatcgtcattctgtgagagcccgaaacggaaggttatctcggaatcgtaaaccccatgtgggtggggccgtgaggagaggaatacagagagagttggctgtattctttaacttgaggttcccaacctcaccccctcgtttactatatatattgttgggctggtggtgggtctactatcaaatttctatttgttaaagtatttcagttaaccatgaaagtggccgaatggaccgaataaaaattgcttagatccagtgattgaattaggttttatttgaaatacaaaatgggtctaaagtttgtaagttaaattataaggggtttaaaatgttataatttctttgaaatataaacaaaatgatcaatccaaatattaaaaattattcacggtcacagacccacgattatttgaagttaagtaacaagttctaaaaaatttttagatctgaaaaagtatgccaaacaggataaagtcagcggcggagctagcgtgggggcgggggctcgagccccgctaccccgctggactccatggaaatatgagggaggaggggggggggaagagggagaggaagaagaaaatgggggagagagggggctggaggaggaatgaaagggttgagcccccctctcctccaaacctagctccgcctctggataaagtgaccaaatttctcggtccgagtcttttccgtttacgagttatgttccagtatgttttgcacagtacacgcctaccgatcgacgtgagctgtgtgcccgtgtctccggtcccttgtgctgttcgttcgaccgaacgacgtacgcgagctagctactagtatgccgttgtgccccgccggcacgccgccctctcgtgcactgcgaaaagcatctactacggagtacatggtacgcaggccacacacgcatgggccgtgatgcgcgcaggcagaagcgcgcgcgcggttgctaaatttcatgtacgtactccccggtggtccagtgggaattctggtcgatcgcgattgggtcgcgcctggacgcgcgacggctcgtgtcgtactgatcatagcgtatgtcaattgtccagattcatatcatagtttaaaattgctatattttgagatgaaggtagtacgtcatagcgcttgcgggcggcgtgccggtgcctagaacggaagaaaccaacaacgggcaacgtgcaacgagcggtagtgcgagaatcgcgtctgtgtctctcaggttttccgagtaacgacgcgattctcgcatgctagccacagggccacatcacaccatgatcgaccatgtacgtttcgatcgagcagtcaaagccggatcgtcggaggctcggagctagctagccatgtcacctactacctagctagctctcgatgcctatatgtacgtttcctccacgcagcaaggggtgaggtcccggccgttctgaatgtgcctgatatattcttccatctgcgccgtaactgcttactgcaatgccatcaaacagctctggccacgtaggctcacatgtactcgtgcaggtatgcataaacacacactggtaagcacgtacttgtacaagctagctagtagcctgggacgaatctaacatgaagacggtgatgactctaagcctccactattaacgcgagggccataggagtcgccacgaaacccctactaaacttttttacagaaaagctaggagagttgcagttttatctagtctgcttagtcctcctctcttcccttatacgtcactgggagtaactaactacgttagctccaccgtagctagctagctagcgcaatgtacagcggcaattatatacactgtgcatcccatcgatcgatcggtcgacaaaacgtgcagcgcgtttcctgtcgtccgtccgcccgcgcgcgctttctgagctgagccgagcagcagcagctagctagccatcgatcccattgaattcccgctaatgatggccgcgccatgcatctcgcgtctcgtctcgtgatgcggggcgtggttgcgccgcgcgcgcgcggatccgtcagatcgatcgctattgccgatgcccgccgcctggcacgctgtcgcgaaccctagacggctaccgcacacgtactccgtacgtagtacgcccaacgatcgatatatagcagccatgagcgcatagccatcagccaaagcccacaaggcaaacaccacacgcgcgacgtcagagagagctatagcgcttgcgcgcgcgacggcggcggcgacaagcgaaacggcgtggagagtgggagattgatcgatcgagcgagtggtaaaatgggaattagcggcgagaggaagggagccgcgaggcagtacaacaggtccaaggtgccgaggctgagatggaccgcggagctccaccgcagcttcgtgcgagccatcgactgccttggcggccaacaaagtaatgcctcgatcgatcgtcgatcagatcagtcacttcaattaattcctttctcctgctttcttgctgatctctgcttcgatctctctctggaacgggtgttgtttatccatttgtttgttcaccctcacttacgcgtgcgtacattcatgcgatctctgtcttccaatggcctcatgttctcaatggcgttgtttaactgcagaagcaactcctaagctcattcttcagctcatggatgtcagagggcttaccatatctcacgttaaaagtcacctacaggtcagcttcaattctcccgttcttcaggcgttattttgctatactagtcatcgaccatggaattataagaaagtacaccagaatttactgtttgtttaatttcgacagatgtacagaggcacacggcatggcattggacaaaacggtgaggctttgttaacttagttcttctctttcttgggaattgggattggattatgctttacaggagctgattatagtgtaataattcgacaatgttatacgtgcctaattattgtatactaattacattactctatctgaaacaagagatctaaacttcctgaaacttcccagttctggttggtgtaaattaggacctcactttgtggttgtggacttgtgggggctgtaattcttcagcacacatgtgaattgctaatggaaagctaaaccgactttattcttattcttttctcatgttaccatcagatatgcagccacagctacatctgaagcagcactcattcggcagtgatgagcagagccccaaggaattcatgtgcccacccataaaaaggttttgctgccgctagctttttctagctagctcccaatagtgctaagttaaaaagattatctttagtggcctaatctctttaaggcacaagcaccttttccatactcattctctcgctcttctctttggatgaacagggccaaggtagggacagaagcttcaggcaaatacagatgcatggaagggagcagtgacatgaggagtagtgctcctcctgcaggcacccggtacttcatcgatgattgtatgcgactgcaagaagtgtccatggataggaggagatcagatcaacacgatgctgcagctgccgctcgtgctcgtgctcctgctgctgctgcttcaagccttcatcaggcactgggattttgggtgcagggaagaagagaggagccctttatggtacaccaggtaaaaagaaaagctaaaagaaaccttagctagggcaagaacaaaaggcttatcaaaagaagatacatctagctctcttgtcttaactgctttgccgccactgatctttctcttcacatgtctctcactatctctagtcttttcttcctagctttatgcatattgctgcatggttggcgtaatatttttttcgtataattctcccagatgctagctagatttgctgatacctacctcctttccctcatcgtgcatactataacatgttcacttatatggaactggactagagtgtccaaagatatactaggacactttacctattaggacttgggagtcatatctctgattggcatcgatatgggcatgttcatgcacatcccagcaaaggtcaacaaactccagacgtgtccttcaaaaaagagagagagaagaaaagaacaggattaatagaatttatacatagtatagaaatactaggacagtgtggtacatacactgtcacagttgtactaggcaccagtatatataggacactgccacaaatggcccttgagagccctgttttctgataggaacacgacggtggtgtaactttgcctcagagcattcccttcagctcatcgacaatgataagccaaaagaagtggctttttgcagaactcggttgctatccttgcagttgcacgcagcagtttcatgatggacgatgatggcgcggtgcggacggaaagaacaagatcatgaaagctctctggtgcccctgctccggctgcaaattagtagcaaaagttgactagtgtcaaatattttgctttggaagcacattagctcgatctgtagctccttctgtgtgttacagtttcactgcactcgtatatatgggctatcaacctgcatatcagggaaataaatttgacagttgcagcaggacaaaacaaagcctgtcttgcttgaaatgcagttaaacatttagaacagtttgatatatcttcctaacctttgctgtgtcgttggattttgcagattagtaaacccaaagcacatcaactgaaccatatggtcaggaacatgaagatatcttgcaaggagaaccacgaaagtagattcttcatggtgagaagtgcaactagagatgaacaagtcaagaaacgcgcaccgccgctgtcgctagccgtcgaccagaaagctgcgaacgctatctcctcctggcccagcgaggccagctgcgttatctcgccgtcgccgaggaacttcagtactgactgctctgggcctccagggtgcagctttgttggccggagagttaacctggaactttccctgtcaatatgtggatcataatttagatcattaatattaataattatggtagtttttgttgatcagtccctcgtcatggtgctattactaatttctgctgatctcgtttctcgtgaaacaccctcgaagctgtgattgctgatcgtatggatcaaggtatcagagcaagttcaaacttataagctagctactcgacacacgatttacagacgagtatattacttcctccgtttcacaatataattcattctagcatttcccatattcatattgatgttaataaatttagataaatatatatgtctagattcattaacatcaatatgaatgtgagaaatgctagaatgatttacactgtgaaacggagggagtacacaatagcaggctacacggttcctaaacatgaactcgctccgtcccattttaagagcggacttgagttttcgtgtccaactttaattgtccatcttatttaaattttttttatgattagtaattttattgttattagattgtaaaatatgaatagtactttatgcgtgacttatgtttgacaaatttttttttatgattagtaattttattgttattagattgtaaaatatgaatagtactttatgcgtgacttatgtttgactttggcaaggcctctggtagaagtggctagaatttcaaacgcaaaacagtagcatttcagacatgtacccttttttcccctcatttgagctttgtgtgctagtttggccgcgtttagttcctcctccaattttttcttgacgtatacggacgcacatttgaagtattaaacatagactaacaacaaaacaaattacagattctgcctgtaaactacgagacgaatttatcaagcctaattaatccatcattagcaaatgtttactgtagcaccatattttcaaatcattgcgtaattaggcacaaaagattcgtctcgcaatttacatgcaagttgtgtaattgtttttttttcatccacatttaatgctccatgcatgtgtccagacatttgttgtgacagaatttttagaagtttgaagggaactaaacacaacctttgtccattatctttttcaaaaaaaaaaaattcccttttttcaattcacctccttaaccctagttagacacatcaaggaatgcaaactttgggccctcatgaattcaaatttttcacaagatctttgcaacataccacaaatacagtttaattcatacatgaactatgaaaggtctgcacattttaactagatatagtggaaatgaaatgagggcggcctataagaaaaatcacccattaccagtttgccaccgactttgacagctcctgcatctgcaggaatgtgctgaacaaagaagattcctcctgtcctgaaattgttattccttgtctaaaggcattcagcatatataaaagaatcaggtgataattttgaggttcgcaagtgtatatataaatggaatttcagagtagcatactagcatcagtagtgatagctcacatgttgcacagtatattatgtgtcaggagatcaaacagtagtagcttaaattcaggcttgtatttataagcaatatgtactcatgggtatactgtagtagagctaccatgtgcttttctttcttctccctcgctctgctggaaggaacacaaacagaatgattaaaacatagtcagctcatgtgcgtgcgtgtgttgtctgtttcgagttgttgtttctcaaaagcctaagagaagcaaacatgtcacgtagaccactgatttgctggttaaaagattgacaaatacaacactattctggtcgccaaaagtaaagaaaacatctaaaaaggtggttaggaatatatactcgtcagtttctgtgcttacctttgatactgcgaatggcatcatcttttgtcaaaatcaaaccatttaccacttacccaaaagtttcagactgacagcatctcatctcaagtacacattattaccatgatgagcaccacagtagattgcagggaaaaagtacggtggacgaaacaaaagccatctcagtagctgcttcttcagcaacatgcatgcttttgtctgaactggccataatagataaagttcagaaaacagtagaacaccataatagccagcgacctcatggttttgacatcgcaacatgcaaaaataacgacaagaagtaccctccaagagctgcatgaacgaactctgcagggctgcaacttatacactgacctacccaaaaccagccaaacagcagttggtggggactacagatgatatgatgcgtagaacagcacgcaaccatggaagggtttgatgtttgttaaaccatctcgaccatagaagattcaagctgccgcagagttgtaaacttgaaatgagcagactgatcaaattgtatcatctgtattatgcccatcacggtgccatctgattgatatcaaccaaggaggcatcacttcttctttgccgcttttgcatcaggcaccaaagccttgacacagagacgaggcttagtcgagatgagttcagacgggagaacggacaccccagccactgaagatcccagggataccccagaaatagggagcatctccactagtactgccacctggacattagaatatatcatttattgtgcaaaacagtatgcaagatttatgcacaacagtgcaaagcaatttccaaaaggccatagatctaaaacttaagtttttctctgtatttaaagtaaaagaacagagaatataattgcgtattcaaacatgatagtgcagaagttatctaaaagtgtaagttgtcctctacgcttcaaagtaaaagagcagataagtatacatagaattcaactttacatagttattatgactctggataaatggttccaactttttatctcactagtaaattagtttgtttcattttactctcatcactcctcgtttatattattgaaaagtgaattataacatttggaacccatggtagaagccaaaaaacacgtaaagttgtgaactatcagaaaacctagttggccgttgggtttcaaagttcaaacaaaaagacgtggtgaaagtagaggtatacttagcggaccaaaaagattattattgaacaatcttgatgatgacaactttgatgaaaaatattgacttactgacatctgctgcatccaaaagtaaacgtgctgaaattgcaggatgtcagataatcacgtgtcaatactgtccaaagactcaaaaacttatctcagttgtcatcatgatcgagtggaaaataacacgctaacttcactagtcagcattgataactttgttgtttttccaatttggtgtctttagattatggttctttaaatcctccatgttagctggcaagtaactctgctaaagtattgagaggttcattcaaggaaccgattttacctcaggagatctgagatccacaattgagttctcagcaactgatttgacggcaccagcaacgaccttgaagcattggtccctgtccattaaagtttgttgttttgaaccttcattgccattcttctgccctttcatctctgtttcatcaatgcctcttctattatacccaactgcgaactttaccataggttaacattatatgaaatattaacagttgatatgtttccacgagataatgctgccaatgctaaagcccatgccattttcaagatagatacaattataaaccgttcaaagcatgaagctatttcaatgggtaatgattaggataacagaaatgcgtaattttgttacttgtgcatagcattacagtaccattttagagaactaaaccaaatacaagaaatatttttaactcaacacatgcaatggcaagagaactggatatgagatctgcaatggcaaatatatatcacaaaagaactggacaagagaaatccagctatagaactggattgattggattccatcaacggtttaatccaatcagtaaatgtaagcagtgcaatatgctgtgtaccttgataggctcatcttggtcttccttactctttacaaagtcaagaaataactttgacacagtagtatgtagttctgcttctgacagaacacatgtttcctgaataggaaatatgcgatgacaccatctgcccattgaaggttgaatagtttcaaatcagaaattttccagtgcaactagagtcaatcatggcatacggaattggttggcagaaagacgcactgctgccatatttcttgaacaaatgaatggtaataggttgcataaatcaaatcgctatgatgcaaatctagaatagaaaaggacaaaatgataataatattatcttcttctgctttcttagtgatctggtctacactgcacatcattcacacattcagcatattagcagaaagaagcaagcaagcgtaacatattgcgcagtcactaaacggtaccgaaattaacaagttttgaagttgaaaactgaatcaaggttgacaaacttaactatactcttttaaaagggagtagtggtggtggtgagtggtgaatctgctagtaaaagaaattatgctagacaaagcgtgctctagaaatagtatgttgtaatatgtgggatcgcttattacttttcggcacttccatatgacagctgaagcctgtagttaataaatcaactttgttaacagcattttgagagaatgagtgtctaatgaagttaagaacttactgtggagatttaagcttgccagaatgcagtgaatgaaacatttgtgtaagcatttgaacaacacgaaggcctccgctaggaaacgaaaagaaaagcaagccacttcttgacagtttaaccagtgagagatttgaagtgtcgtcaacatttttacttgttttggagtgaggtgaaactgagtctttttctacactgcctgttacagaaccagaaaagacacagcgttagaaaaaagacaggtaaccaaaccatccaaaatcacaccctttagattgaatgaatgaatgtggctaataagttatgaaatacaattgatgctaaccagttgtttctgaagcatcacccttctcatatgttactgcatctcctgaattttcaatatctggtgtctcggaacatattttccttttctttgctgaaacttccgtatcacttggttctgacttttcagaactatagctgtttgcatgaccaatggactggcgaaaaacagtagcacacccagtatatttcagaatagagtgtaaggaagatgaagtggaaaatggttgcccaaagtatgaataaactaccacaatcaaaggtaaatactacaacttaaagttgctctatacttgcaagatattcagatggtagcaaatgtgctgtaacattaagttttatgtgctagaattatccattgcagaagaacaaccaaagaataaggagcaagacctacattttcaagaatggaaatggcttcctttgttgcgcttttctcacgttctgtaagaagatgatgatcacatcaaatttttgcagtagtgaatagaaattaagtgtatatgtagaatttagctatatttaagatttgttttaataaatatctttgtaagatctgtcacagggtagcagctggattctaaaataacccaatagtaggaataagatcaaaacagggataaaatgtaggataacccagatcactcaagaccagcagaactttccagaataaccgcaacctaagtggtttggctgatgcttcagcacattacatacctaagaacactcctggctacacaagcggttacagattttattcaatccttgactcagtgagcatgttacaatttccagaatgcacatacagcagaccaaacatcattacttatttttttaagacaatacacctttggtctctcaactctttccatggtttaagttttcacccccaactccaaatcgtttgaaatatgtcgataaacttttgaaagcatgcagatatcccttgcaaaaaaaaaagcatcagttttgccatatgtctagttagtgtgtatttggcctacttgtcagccccctctcagcttcatcttctagctggactacatgaggactgaggacactggcaagtatagcgaagttttttcttctcaccatatttttttccttttctcctatactgcattatgacaaataaaagtacaatagttgcaggtgatccaccacaaatttataaactatgccaacattaaacagttgtaaatttgatttacttttcagcacatacaactacagttcatcaactactaactgacaagtcaacagaagaagtgtctggcagggtcgagtatacaaccattgggtaagctaaccgatatccatacaacaatgtactaaaaactcatacaccaaagtcgaagggtaacaaaaaggtagttagttctgcgcctccaatatccacatctaatgatctaaatgctactagtaccttttagcgtcacaggggtcactcgaatgaatccactaacaaatccaccacctgaagtatctagtcttcccctacgtatccatatccaacaaaatagtttttgctaaaatagcacgagtaagtctaaacatggatgaggggcacgcactgatggggcaggtgatgaggaagccggagtgggagcggaggaggagggagcccgacgcgcggtagtcgtagcgcgggaggtttatcaccgccgcgtgctgctcccatggctgcagcggtcggtcgctggctgcggcggcgggggcgggggcggcggctggtggctcagttggaggctcgcgggccggcggtggggtttcgatttcgggcttcggctccggttcctccgccgccgccgccatggagaagcgccgaggatttctctctctctcttcggtcgcactttgggcggcgccgaggtccgaggagggtttggggtttgcagacgtattctgttaacctgttaactcgatccgaaggcgtatttctgttggttcccgtgaactcgaacagaaagcgtattctcttcctttgcgtaaactctcctcacgcgcattgcttataggatcaaaataatcgattagagttacacatggaaaagtctaggaccggaatctgatatagtcacggagcttttcttactaagttgatttcagcagctgccaagtactccatatgtctaaattcattaatacctatatgtatgtgggaatactagaaagtcttacattgtgaaacggataagtacctgagatgatgctagtagatttgcgatggccggtctattcatcttgtttatgaaaagatacatctgggtccaggtatgaaaaaacgtacgcataattggaagactatagacaccaaccttacaatcatgattattgaattattggtatatccatgtcctgtcctgaaagaggctatttttgaacaatttccgtgtttgtgcagatacgatatgcacactgttgtgtgtttagggtgctacttacctttatttcagtgaagcatacacaacaaccacacgatccgactcatgtttttgaaaccttacaaatatataaagagattgatgttgtttatcgttgggtcgatgaagatgccgactgatgtatattaaggagaagggagaaaactttacgaacataccctctctagagggagcgcaaatacagtgcgtcggtacatcgcctttacaacattaagaaattacaataggttgaaatctctctgaaactggtgttgtggcaatactcaacaaactaaagagcctttgattttcaagtttcccactcatcacacatgattgcacacaactaagggaccgacgaggttgttccatcgaatacccacatgttgcgctctttctagatctaccaagttacgaggatgactccggcgtcgaacgtcccacggtcgaccttggaaacggagtgctaggcagtaagccaccaactgggaaagtccgaagacgatggagaacaggagagactcaaacgagtccgaatctgtacccaaacctgttgcgagaagggttgagaaggggcaaccctggaagatgtgttagtatgactggccatcattggagcataggtgacaaattggcgcgagcttccaacctcgccgctacaggttgtcagttgttaaacaagcattgcggacggcaagaaacatgaataacttgtatctcgccggcgcgcgggatttccaaatgatcttgccgagagggcttgtttaacatatcgctaaaatttagcgttaacaggtttcacaaggtgcaaacatatagtgaaatcaaacttcacgaataacaacacaaatatgaaaaatatatgaactatgaatccggcattggccatggacgattaagctcgagattaagatcactttcctatagatactaggaataaaaacttttcctgagatcacattgagtagtaattcaacctgataaacaaattgcactcagcttcgtgggagaggcaggaactccacattgagtagtagttcaacctggcaaataaattgcactcagcttcgtgggaaggatatgcatccgataccgagatctaacgattagttgaagaatcggcgtgtctgccaagattgaagtgcgtgatgtatatgaaccgacccatatcaagatctaacgattggtcggttagggatggagttaccgtcaccactatgttttattttttaaagtgtatatagtattagtataaatatgattctcaacgaaaagattagcatttttttgtccattaatttgcaggacaccaaatatgaacagttacaaactattaattgagatcagagttgctagctagatactacgaataaaaacttctccaggcgcacaccatgttgagtagtaattcagcctgaaattttactcagcgtaaataatccaatctggcggatagcttcggcgcgaatctctgaagcatcggcttacccgcgacagctgcgccggacaggactccgccgaggatgccggcgacgatcatcgaccttgggccggacgcgatgcggtagagcgccccggcgctggcccccgcggcgacggtgttgacccagtcgtcggcgccgtcgcgctggtcgcggacgaagctctcggtcccggcgaagagcatcgcgacgatgccgaaccggttgccgaaggcgcggccgacggagccgctctggttgagggcgcggttgatgcgcagcttggcggactccccgcgctcggcctcggcggcggcgcggcggaggcccacgagcgcgccggacgtggcgccggcgaggtagctgacgccggtgtagaacgtgaggttctcgccccaggtgcgggtctgccggaacttgtcctcctcgaagaggcactccggcgaggtgggcaggtcgtagagcgcgcggtacgaggtggggaaggcgaggccctcggggcgatccggcgagtagaagcggcgcccttccgtgggctcctgctgggcgtcaacggcgcgggacatggctggctgatctagggttgccgtgggctgctgctgccgctgcgtgccttctgggtttctggacgatcggttttggttgccgccgccgtgtgccgggggtttaagagaggggagtggtctccgatctgcagtctgcgccttcgccgtgtcgccgaagaaaagggggagggcggagccgtgcgagatgcggactcgaaacccagtaggaaaaggaaccacaacgcgacgccacggttccgacttccgattgagaaaagagggtgtgggccggtgaggtgggccgtgggtgtcggccttcaagtaagtggtctgccagcgcggcctccctccgcctcctctcggcctccacacaactgtgcacgcaaggggctaggcggaataagtccagtaggactccctcaaaatataagtccagtttatttgaattccttaatcgcaaagatatttgaaactggctccgtcgtggaataagagaacatagtatttgcaaacgaaaaacagtttgtgaataaaatttttatacacgtgtttttagcgatctaaaagtaaagactgaaaaataaacttcgatgaaaaaaaacccaaaaatcaactccaaattgagagttgaaaatttaaattttggctgataagcataagcaaaagaaaaagatgaggctgtggtgtaatttgacttcatagattattgtaagagtggttttcgctgaggtggcaggttaacttgtctgctttcggccagctattgggcccgccaccgcgtcccctttctcaaatgggctcgactttataacaggccgggccgtgcaagcgccacgtagctgcacaaacaaggccgtatcgcgtcgtgtcaagctcgatctagagttgcaagacccccaaacccccgtgacctctccgccgcagccgcaacagcaatggaggcgcaggcggacgccggcggcgacgacctcgccgccatgcgggagcagtgccggagcctggaggaggccatcggcttccgccgggagacgcagatgggcctcgtcgcatcgctccagcgcctcgtccccgacctcgtcccctccctcgaccgctcgctccgcatcatcgccgccttcaacgaccgccccttcgtccccaccccgaaccccgacggcggccacggtaagagccccgccgccctcaagccccaccaccgccgcgccctccctgacccggcgcgctccacccgccgcaagacctcgcccggatcctcccctgcctccgtcgccgctgcccccggcggcctcgacgccgtgcgcaccatggtcgccgtgtgcctcctggagctcgtccccttcgccgagatcgacgccgccgcgctcgcccgccgcctgcaggcggagagctcatccgccagcgaggccgagcggactgctctcgctgacctagccgccgaactcggcggctcggcggcctccgctgtagtcctcgccctccgccgcatagccgaggacaccggcggtgtgcagatcgaggaggccatgattgggggcaagtcgatgacgatggtctgggccatcgaccggaacaagctcctcaaggagctgccagaatccgctactttgccgctactccaacctcctccagccccccagatgcccccctctgagaccgatgccggcagcgcaatgataccaagaacaccgcagcagcagcagccgcagccggatatgtggccgcattcgatgcctccgatattcccacggccaaggggcatgacgatgcaggggatgcagagggtgcccggcgtgccaccagggttgatgccgctgcagcggccattcatgggaccagctggagttatcacaatgggtgggggtgtggggcctagccctaaccagcagaagcagaagagcgaggaggacgaacttaaggatcttgagttgctgctgaacaaaaagacatatagagagaagcagaacaccaagaccggggaggaacttttagatctcattcaccggcccacggcgaaggagacggctgtggcagcgaaggtctgttttcccttcacctatgctagtggttttgttgtttgcactgtgtagttagtgatgctttgggttgctgatttgttattgatgtagtctcacactgttagtcctgtagtagtaaatgagctggcagtggcggacctaggatttgaacccagggtaggcctagcaaaaaaaaaaatctgaatgcaatacaatatgattcgatataaaatgtggtaaacgatacggtatataactctaaatggttcaatacaagtagaaaataacaaataagtttgaatcttacctaaatggtccaaagttggcatggaccttttagaatgtaccctcttctagccgcatcttgatcgttggcatcaaaacttgaaatagaagcccttaagcctggatcatgttcaatatcatcaacatcataaagcagcggcggttcttcttcagtttcaattgacccctgttgagttatgtgtcttagtgaatatgtatatgtttagggactaaatgtaaagaccattgcatacaaggagatgggggacaccaggtccaaatcatccaaaatttacagcatggtatcagagcaggacgatcctgcttgattttcttgcaatccctagcaacacgagttaatgtggaatgctggtttgcagactgcagtgaatcatggtccagaggtagtcctgaagagatgaggttgatccatgtttttttttggtgattagttgcatctggtttgctgcctgctgtctgtaagagtacggtatgttttttgccaaggaaatccatccaagccttgccttgtgatttcgctcctggacttgcattttcttcgttgctgtctcagcctctcaggtggcgttgctgctgttttctttgccgtgtgtgctgtcgagagttgcagcagacctgtgtagttgtgtgaccttgtataagttcagtcttgataaatctatatagaagtttgtgttttgattgggttccaacctgctcactaagaaatgagtgagccaactacagcaggggcggctgggcgctggcggcgtcgggcaggacgccgggaccgcgggagccgggagctcgggaggccgctgggcaacggccggacgtgagacggagagggcgcggccagccggccaggggcagagtcgcggagatggcgcggccgcgggggcgccggcgcggcgcgcgaaggcagcggcgttgccgccacggatgggcgtgcgcctggcgtgagccgggaggccgccgaccgacggacgcggcgggaggagcggcggcgtgagtagcggcctcaccggacggtgggagcgccggagttgcgccggcctcgcggctcgagggagcgctgtcgccgttggtcggtcgggaggggagagtgcacaggagagaacagagaagagacttagggttttttttgtttgttgggccaggcttttttcatgggccaagaaaaaataaatacctgatcttctctaggccaaattctagggtagtcctgggcctacctggactaccctctgggcccgcccctgtgagctggtctacttatgcattgctgttgttaaaactatcataggacgcataacagctagttgtcggaggcacactgctataatgaacggtttatcataaattgcttagattctgcactgaattagtgcgactgtcaaagtaaaactgttaaatgttgtttgacccatctgcattgcctatatattgtcaacctctcgacacttataacttccactcttccagttcttacacatttaattgtaataatatggttgacatgaaaatcattcatcttgttttgttaatatggttttatgttcatgcagtttaaaacaaaaggtggttcccagctgaaggaatattgtaccaacttaactaaagaagattgccgacgccaaagtggatcttttgttgcctgtgataaggtctgtggtgatagtgtcctgcaccccttttcacaatgtgtacttccgcacgttacattttgtctacttttaacaacagtagagcaaaacctgttgtgtttgattcaatcacttaaaatgatgtgcctatccacaatcatggcctctttgacgatgaaattatcctgttaacatattaggccttatttctggttacttgaatttattccaatcaaaatcttcacatttttttccttgaatacttgaatagcttttgttatctggtcttttagctgttcatggtaacaactaatctggaagtaactgtttatatttcattctgagcaggtccatttccgccgtattattgctcctcatactgatacaaacctaggagattgttcttttctcgacacttgccgtcacacaaaggtgactatggcatatacacccttgtattttcctctattatgatgtgtgtttttgtatcttacatatatcctataatctgtagacctgcaagtatgtccactacgagcttgaccaaacaccagatatacctccaatgatggctggtgctcttgcacccccaaggcaaataaggctccagagagctgaatattgttcagaagtagagcttggagaagctcaatggataaactgtgacatccgaaacttcagaatggatatcttaggacagtttggagtaattatggccgatcccccttgggatattcatatggaattgccatatggcacaatggctgatgatgaaatgaggacccttaatgtccctgctttacaaactgatggattaattttcttatgggtcactggtcgtgcaatggaacttggtcgggagtggtaagtttccagaactatatttgattagttgtcttcagcagtaccaacaggttaattaataattgcgtagcattttagcattgttcatatcctaatgccccttactgagtgcagatcatttagatatcccacacttcatactcaaataactcgataggatatagatgctactgtaataacaagttatgtcatattcattcctttactgaattttgtttttacttaatgtctactgccaagtgtaaactttccctgaatgaactttcagcctgaacaattttcttactgacaactatgttgcttgtttttaccattcttcagtttggagctctggggttacaaacgtgtggaggaaattatttgggtgaagaccaatcaacttcaacgtattattcgaactggacgcactggtcattggttgaatcatagtaaagagcattgccttgttggaataaaaggaaaccctttagtcaacaggaacattgacactgatgttattgttgctgaagtccgtgaaacaagcagaaaacctgatgaggtacactcgcttctttgattcatggttctatactcgccgcaaaagcattgtgttttttcttataaaaaaattctaactatagtttataatgtttttcttccctactgtaataataaacatgctcatttcaaggctatactcctacattctttaaatttgttttgctgtgcagatgtaccccatgctagaaagaataagcccaaggacaaggaagctggaactgtttgcaagaatgcataatgcacatgctgggtatgctcctgctgtgtattcttcttcccctagattattttgtcctcaaactagatgctaaccatttacgtaccatttaccctttttctttgtttgctcagatggctttctctgggtaaccagttaaatggagtaaggcttgttgatgaagggttgagagcacggtacaaggctgcctatcctgattcagaggtgcagccaccatcaccgcccagagcaagcgcccctatagatggtgatcaaggcacatcacagaaacctactgtatcagacggcgagaggcctgcctgatgtgaagcagtcggcaccttactttgaggactatgacattgaggaatcatcgtgcaagaatacaaacactttggacgacataagtattttatcactcgtcagctttaactccggttgtaaaattagttaagtcggtttacttagaagttactccagttgtaaaattagtaagtcgattgtttttggtcgcttgaggaatgcaggaggagggaagaattgttgggttttgtaatgttggcagacatccatcttgataatggaacgcgtgagccattactgatcttgttaacatgtcagcacgggcaaatcctgaatgcaacatttgttcccgtcctggaaaaacagcatgtacgttaactcatgctgggatggctaattagcgcaagtgcatcgccacacttttctttagtattttccgacgaaactttttaactcaaatactacaactttttaactccagagcaacattacagtacacaaggtttttctaaaaggttgacataattagagtacaaaactttaacgacagtatcatgtttgctgctaagaatggatttcaggttgacataattagagcacaaaactttaacgaaagtactgcttcatgtttgccgctaagaatgtatttcttgcgtgattcatgaccagtgactatgttaacatgactagagtagagaataagctcaaggcgctgctagatttgatgcttggtcgctcaaggcgctgccaagctgatgcttggtcaggcctcatcctcatcctcggggccttccttcagcgccttgatgaatgcgtccagagattactaacaagaacaataatatattgtttagggtgttaatgaagtatttacctaatgaatcaattatatgttgttcttgatgaaaaaaaaaactagcctcgatgaaaagttgcaaagatcagcgctgaattcatcaatgttcatctcatcaatgataggcattttatcaagcgttgacaaaatgacagtcaaaccttctttcttgtaagaaagtacacatgttagaacacggttggatcaaaggtaactctcaattcctatatttcttctttcttgtaagaaagtacacatcttggaacacgattggatcaaagataactctcaattcctatgtttacttagcatcatgaaacaccggtggaagaccggtgacatatagatcttataagaactcatccctttcaccttgcacgaaagtgcacttataaactttccattttagacaacaccttattgagagctgtcgtaacctttctaatcacaacatacccaaatcaaaacatgcacggcagaaggcttgagagcctttgtaatgtgccataaggtacatgactaaatgaattaaagtggcgggaattaaataaaatcttatttcagcccattactttcgtaactggcccgtcctgtttagcgtgagcgtggcctgtctaccggcaatgacccgacgcagggcgaactaagcgtggcccagttgtattctgcggcccaaagaccacgaggcccaatagcggtggtggccctacgtggggctgatatggtccatccgatttgatggacggctcggatcagtcccgtgccgatgaaatcgccggtcggaggggggaggggttcgaaaaccctaaccctaatcccccttctcccctactctcctgatccaatctctggtgatgcgagagagtggacaacgacgatggtggtgacgacagtccgtcgaggtggagcacgcacgcagcagcgatagcgagtggcaccggcttcaccggctgggaggcgtgcctgagggcagcgccaagccaagccacagcgtcaacagtccaatgaagcgggcgcgcaagtagaaacgggtgccgagataggctgggcttcgacggcggggggtgggggcatagtaaaaaaagccggactggtaagtgacccggccgacctctcggttcagcggtctgccggtctgaccggtgacccgggcggtcgaactgcggttcacaaactacatgtatattacatattcactcatgtaatggctagctctttgctcttgtaactcttggacccgggttcgaatcccatgtagtgcaccatttcttgctatttttgccaaaaaaaagaccaccagctgcaccaaatgggcctttaaacagcccattgtggcccattagtatggctagccggttcaaccagtgccggtttagtgtccggttcgccgaaaaccggccggttcaggcgggcaaaaataagaccaacagctgcaccaaatgggcctttaaacatcccattgtggtccattagtatggctagccggttcaaccagtgccggtttagtgtccggttcgccgaaaaccggccggttcaggcggttcagagcggttcgattgcatgtctggtctttaaaggaaaccgaaccgtggtcacctttggttctggttttttccgatctaaccgccaggaactcctagaaggcgcgcaaacggggagcccaacgcaaccgcgaggaggcgaaggtgcatgtccggtttttaaaggaaactgaaccgtggtcacctctggttctggttttttctggtctaatcgccaggaactcctagaaggcgcgcacacgggaagcccaatgcgaccacgaggaggcgaaggtgtggcagtgtcgcttcccggtgagacccacacaacggtggggtttcccggtagaattagggctccaaatccggtaagaatatgaactcaagcctaattttcttaatttgatttggatttggatttgattcagattttggggtactcttcaatttggggatttcgggaaaattgaaaccagatgggattgtcaggtgctattgggctgcaccttgggccgtgccagctattctccaagttgagcccaagtaagcccaaggagaggggacatatacaaaggcaacggcgacacttgggagggaaggaacataactagcaatcggcggcttcggctacagcagcggcaacgacttggttcggttgaaccttgttgatctctattcctctcccaccctctctcttgttactcttcactaatacttctagaagcttccggaatctagtagcttgcatcctttacatcttctcatcctgtccctattgtattttcctgagattgcattgaattttagttgctcttgagattattgagttgagaagaagaggttgctaacactcctcttctacgcccatgctgctttctcccatcggtcgagcaccctggaaagatatgggggaagagagtggagagggagcaaagggaagtagaagatgtggttacactgatatgtgggatccatctgttcttttttaatttttgtctttggtgccacgtccccatcatgtcatgtaaaatgcttacaatactgatttgggactagggatgacaatttcccccgcggggccgggtcccctgcggggacccgaccctacgggggcaggggccatttctgacccgtgggtgagtcgggggcagggcaccgcatttgggcggggagcggacggagaggatattgaacccgggggatatattacccctcgaaatgtagcccatagaaggcccaacaagcccaacttagcaaaatactgtgatatatgagcaaaaactaaacatgctaaccctaccttatcctctcccgtccatcccatgcagccacacaggcacggaggtggcacactcctctcgcctcgcttttcccttctagatctcgccgctctctctccgtctcttgcggtctcgccgtcgtcagtcgccctcttccctcccctccgacctcctgtcctctccagtctcccctttccctcccatctccccacggtagcgcgcaggacgacgcacgggcggcacgcggggaggcgcacaggcgggcgtggcgagggatgcggcacggcgcataggcgcgacggctggcaaggggacaggcgcggcgagcgggcgacacaggtgacaggcgaggtgaaacacaccgagaggtatttcactaaattggtgaaatgttgtttgtttattgagtgaattgttgtgtcaaagtatttgtgaactttgtggtcatgcatgcattcagatcatggacggaacgatgtatcatggaaatatttgtgttcttgcttgattctatatgatagtcttgaaaaaaaaaatttctgattggatgaaaatactacccaatacggggccctggtcgggttgtgggccggggggtgtcgggggcggggcttaatttgcccccgcatctccactcgtgccaggatcggggacggggccgttctagtctaacccgtccctgccccgccccgttgccatgtctatttgggactatatttctacggttattgcggcattgggatgtaattcgaacggcgtcaagttgagcgaccttgagtgaacttattccttctcaaaattggggagcttgcgactctggccattctgctcacgcagtcacgctaggcccaaggcccaaaaacactatccagtgggctcaaactagaggcttctcttctacccagggtttagcgtcggatccagtctccaccggagcgcggggcggcggattccaaggcggcgatggagttctgcccggggtgcgggatgctgctgcagatccagccggccaccggcgggaaccgcctgcgcttctactgccccacctgcccctacgtctgccccgtcaaaaacaaggcacgcctcttcttagctctctccccccctatcacttcgcctccctacttcgtctgcgactttgcgtattgctgccgcggcctccgcgtttgattgatgcctttcgcagatcgtgaagaaggcgagactagtgaagaaggaggtggagcccatcttcagcgacagcgacgccatgaagaatgcccctaagaccaccagtgagcccttcgcccttaactttcttgttaagacaatacattgggattaattgttgtcttaactttttttgttgagacaattcgttgggaataattgaacttagcttctccattatactgtgtatcatctgtatgtcatgaattgttgattatcttgccatttaaatttaggtgaaaaatcattgctattgccacaccaatgggaaattttgttctaaatgtacttgctgatttttgtactagtaattgtttttttttcttttcttccatccattgaaatgtatagctgggtaatctagccgcagtccaacataaacgaaagtgttttatgcacatattctgtcttctgagtttgtttagcttatgtcgatacaggagacatgattgcttgttcataaaaaaaaaaaagagatgaaaaatatactaaaataaaaggctcaaatttacttcacagccaagcagtgctggtttgaagcataataaattaatatacttcttaagctatgataaaatccaaatagcaccagatttcgtccaagtaccttcaagaaacttgctactcctatgtatttcgttgtttaaagtcatcattgagatgggaatgttcattaggggatgtctggcacatatttattaggaaaccagatgattgaatagttatgggtgcttctagttttgatacattgttaccatggccgtggtatactatcatgcatgtgcgtgcttagttccttgtaaaaaaaaggagtaaaatggtggaccatcagtgctttcttttttcaagcatctattctgtacactttcaacacaagataagattgcttgttgtgttgacagaataagcttgtatcttttgatagtggaaggacaaaaaaaaagcatttttcaaagctgtacctgaatttatttagctgttctgattataatggcatgtctccaacccaacgcaaataagttcaatattttaacaatttccacgtaaagaaccctgacctaacatatggttaaacattttaataaagttctaatggttgtctgaattagtgaccctagaggtgacattctgccatacataatcctaaatacattcaatgattttgattttcagctacatgcccaaggtgccaaaatggagaagcatactacaggcagatgcagattcgatcagctgatgagccaatgtctacattttacaagtgttgcagagaagaatgccaatttgattggagggaggactgactttagtaatatttcttgtttaatgtgtgtggatatttttcctgctaaaactatgtaatcatatgaaaccttttgtaatcagctcatgccgcagcaaagagccaaagaaaacttacacatgggaaaccaacgtaccacaaaatatcgtgatattttggtctaggcgtgtgccaaagtcccaacctatcgtggtgttttgtctaagaatccgaactgaagactggtccattaaggcattaacccaaaaaagaaaaggcttctcacaccctcagaagttagattttggtctttgttgccttgttggtgttagagatgtagattgtcctggtctagaacacgagagcatgaataaacgagaagattgcggccataaggcctcccgctctgccgaatgatctacttaggttatcatcaacaacagcattttgcagcaattacggcatcaaacattcattaacaccatcaaaatatcatgctgtaaactcttgccaaacggcttaataattaccaacaagctggctttacagcattgcagactacagcaacgtttaaactaaaaattattaacgttgctcaattatgtatgaaacacaagaaatgttgaaccaggaagctggaacatgaacatctgaacattctttcttatgatgttcagatgaaacacaaaacttgactttatacatcatcatttatctggtaaccacttcttccgggctccttccaaagcttcttcccgcatccttgttaattcacgaaaccattgctcgtactgagcttcaatcagaccaagctctccatttaacacatctcgattttcagtaattgaaaccgatgcaccgatcaccaactccgagtgatgtgatgcttgatccatctgaaagattgcaaaattacttgaaccattacttaacggatgtctgcagcccagtttatcggttcctttgtacgcaccacattccagtgtcctgtattcgtcaacgccatactcactaagacttttggaactcccatcaagctgaacagaaatgtctgacccttcagagctatttggtcctcctagattggttgcattcaagagagaatcaatataatcacttggtgatgcattggcttctttcgaatgcatcataccttcaactagtacataatcatgtgtcaactccgatggatgctgctgggaagtaattacgtgctcactttcacccattttagattcgctggaagtactcattactgcatcattcatcagctgctgaccagggacaagattcactatcaaaagatcaataaaatcagcaatgaaagtaacatcacagtctgctaactccaactgctcgaccatttcagcagcaacagacatagctgtatcagaatccaagtagaagagaaaatgaatgttccttgcatgtcctgcaaaaataaaaatgatatcgtatcacgagaacacaaaagataaattcaattaacaatagaaagtcgtaccacacaaatcggcaattcgcaaaaccagtgatactgaattgtcatcaagtttctcgcctgttagctttagctctgtgtttttgttagttcgcgtgaactccaacacagatctatgtggaccaccaagatcatttctcttgcatgtgctagtacacatagattcattggtgtcaacatccatgtgcaaagcttccaaagagacatctactgatttgggtaatgatgacggaaacttagtgccaacaagaacactagaattatcagagcaaagaaaggggtcttgcaatagttctttggcagacagcctttcagaagcaggaactaaacatttatcaataaattgttttgcctgaatatttgtgattttagccagagcagccggcttgacaccctagaaatcagagatttagataagatagtgttgaggcacaattatacaaagataaattaataaatacttaccttagatactttcttaaaaatttgagctgcatttgtacattcactgtaaggatactcaagagtgaacatctccaacatacacattccaaatgagtatatatcaacaagttcatcataattctcatcatatagctcaggcgccatgaattcaggagtacctgcagaaagtggacccatatcacagggatgtatcaggagaatgcagaatgttttctgtggattaatttggcacctgctaacatgcttagatgagaaaaacaggtgactctcacagttttgtattgtggacctatttacattagtttatgtttttaagtgacatggttggtgcatcgaactcaattcagacatagctgaatattgtaaaaggaatgtaaaatatgaaatgagcagcataggatcaacatgtaagatgtaactataagaatattgtttaaagggttataaatgtggtataagcaagtcaattttgagttaatggaatattgaaaccccaagtatatcggtcacaatacttgtgtgtgtaacacatcagatataaatgttgacaagtcagatcagtaatggctaattagctatagaagtggttgacattgcccatggattatgcatttagttgcacactcaaaatcgtcatttagtctgtctctccaaatcagaggacaataattcagaaataacattggaatcacaaagtagcagaaggttattaccaataacactttttgctctaggcgttagcatcaccgtggctaatccaagatctccaatcttaacttctccatgattcccattgacaaaaatgttgtcacacttcaggtctctgtggataattggaggttggtgggtgtgcaggtaatccagcccacggagtacctgtctagcccaattctttattgccttcaagtcaacacgtggatgtttctgacgatacctataagcaaaaggtaatggtgtcattccacaagaaacatggtagtattaagaaggcaagactattacttagttgctacttactgcctgagacttccagatgtgaaaagttctgtaataacattaattgtcttcttttgatcatcaacccaataattatagaacttcattacgttttcatgcttgagagactttagtagatgaacttcagagtatagccgttcaagattatctggagattgcataacctcatctatctccacttggctccatgcaacctcaatgccttcaacctcatcaaatgccttgtaactatatccgaattaagcatggatgcaaatagttacaaacagcccgatgtaaacaagagcacagacagaaaatgagcaaggtagcattaatacatttgcagctattgccattagaaatgtataccctggatcccattcgatgtttgttctgtaacagtgttgaccgtactagacaccagcaggcagcaaattaaagagattaacctccacgtaaaccattaaacctaaatcccacagcaattagtaggcctaaaagttgaaacagataaaactccttaggtggtcgttagtttgttgcttaggccctgtttctttcagcttaagattattataatctagattattgagtcagattactataagctagattgttataatctgtagtagaataagcggttagttgtttctttcctagattattaaagcctagattattgggtttgcaagtctaaagagggagtgggatggcatggtgggtaatttttcacccaataatctggaaaaagctcacataaatgagcttatcagattataataagctggactccagattataataagctatttcaataagttgtctgtttcttttagcttactcccaataatctggattataacccaagctgaaagaaacagggccttagtatttcttacctcttaggacgatatttggcatagatatataggtgctaaaaggctgccaagacatgagacgattgctagaatactagtagtccttaagttgaaagtttggaacctgaaattctctaatttgaacgctgtttactaccctgcttggcttcttgtgttagccgaaacatagttgcatatatggttaatgcagcattttttcctagattttgaaaatgtgacaacccattgcaatataaatatatctctttgacaaagaagcacaaaaacaaagaagagattccaaggacatacacagtcttcatagctcctctccctagcacctcattgtactgcaccagggaaaaagttcagatgaatacagcaggcagagttcaggagtggcacatttgtggataattttgacaaaattgcatgcagtttttttttccttttggtaatcgtttgagcaaatttccagcattttagtaatgcatttcaaacatattaaattctatgagcaagcaaaatttagataagcctttctgtaccagtaaactagaagcctgaaaattttaatgcaggtatccgttcatcacaaacttaaatagactagcatgggcatgtcaaatcacgttcacatcagatcaactaaaatggaagaggttcctatcagaaaataaatgagaaaaaaacttacgcgtatgtaccgcctggtcggatccacctccacgcactcagcatcgtccaccttatccagatcgccgaacacctccatttcagatcaccccacgcgcacgaacgaatcaggaagcagagaggaagcagagcgagatgagccaggcgagatcgccgggacagcgcgtggagcggcgcgggcgcccgctacgcacggcggtcagcagctagagccggcgaccgatgcagcggaggagagacggcgcggggcggccagttaattatataggatcgccgggcgttcggtgaagggctcggagaacggggccggcgacggcagctcgcggcggcggcggctgctgcggagcgacgtcgccttcaccccacccgcaactcccatggcccggcacccggcggacgccacgcggctggcgcagcacctcattcttctcccccggtcggtctcctcccttcgtcgtcggcggcgcgggcggatcccatggagggctacgcgaacggggacgcgggggcggcggccatggaggagaggcggaggcaagggctagggttaagaattcagcggcgcgccggtgtacggaatccggggaggaggcgaggagaattaaaaggggaaaggtaggtggtggtggggagcaaaaggtgggagagaaatagtaaaggcctggacctttattacggttcgggagcagcagctgcatctgtgaactgggatgacgctcatattactccgtcacacaatgttagcattttttatatggaaacggtatttaaaaaacaggtaaaatgattggaaaaatattataattggttggagaaaaaaatagataaaaaattaaatagaaaatgattgtgattggttgagagaaaatgttagatagagaaatagcaacattttagaataagatattgtgttaaagttaataacattttgaaatagaggtagtactcccttcataaaaaaattgtactccatctcatattagatttatttttttatgcaatgcaggaagtacgagcgattttggattgataccaaaatgtgtcctaccaatttattggtatcttgaatagtaatagtatggatttggattgaagccaaattattgataatgccaatgatcaatttgtcactaatctagaaccttcttctttatatcatcaatatttgacatcatattggtagtaatccaaacatgtataataaatttctatcctaccaaaaaaattggtagtaccaaaacatgtcaagaatttggtattaccaatgatttggtaaggtagagaacaaaacaacccctacatggtacgcaaactcatatatactgataaacggtgatacagttaatacgcatgagcgaaaatccatttttaccaggcttgccgttctttttttttcagttgagaataggatgaaaatttctggattattgtgaaaaatcaaaatgactgccaaatacaaagtgaatacttattcattggttgggtctagataagttcaaccgaaaaagtttgatgccaaattattcctcatgagaatctattaactttcggcctcttgcttttttaaggagattcggagagagaggaaggatgcttacagcctagattaggcattctatacattctttttttttagaccatattatctacgtgtacaacatgttacttgtcatataaacgtgaaaatacatacaagaatgcttgtgctaggcgtcgaaaccatcaagaaaaattaggcaggagcaaaacatccacccgcccacaagccaatcccttttctgtctctttttcccatttccttctccttccccttttacctctccttgagctagtggtggttgtcgatctggttgacaagggaaaacgagcatccgttgttggtaacttgggacatggcgaccacatgtttcctcaaggcgtcagtattgttgaagttgtgtccatcagggaggtgacaatgaattcgagataggtgaagaggatatgtgaacatattgccggccaaagttataggctgatagcacatcccatccagttcatctccacaagcgatggctacatttggtcctccatgttgtgcattttctaagtgcagtttcccatgaagccatagagtgcttggagttggaggtgccaaggtagactgtaacaccctgaaaattcaagacaataaaaatcactaaaattttaaactttttaaaatttttacatcatgctggatgttatggttgcttttgcttgccaaactataaattgtcataatggaaaattaaactaaagttatacaactaagtaataattataataataagatatttattatgaaccctataaatatttacgtacaagaaaacaaagccagaaaaagggaaggttaattactaatttaatttatgaatcaaatattaaatacttgaaccatgtgatgcgtgccatgaaatataaacacttaggaaatgataatcgttcaaataaatggaactctatctatagaatagttttactgggaaaaattaattagatattatataatttgaattgaatcataaatgctaaattatagaaatccatgtggtggtaaaaccaatccaagaagataaaccaatatgcgtgaaaacagataaataccaaaatcccaaatataggaaattatagaatctttaataaaccttaaatattggacaatattaaattttgggcaaattcacattgaacacttaatacggtcacccaaatgcttaggagtaaatacaaaattaatttgcaacttttctcaatttatatatcaaccagagccgtaaaagtaagaaaataggaaaactaaggaaaatatataataataataaggatatgttcaatattaaatttgaatataaatttcgatggaataacttagattttgtgtgaaacacattgttaggtggcaatagtccattttctaaattagaaaaacatctaataaaatccaaataaatcaactagcactgttcattgccccctaggtgctcgaccctgtcccatcaccgccctccccctgcccgcgccgcgcctagccctgccctgccctgcctgtcgcgcctagccctgccgcgccgctgccttgtgccccgcgccgccgcacgatatcgtgtcgccgtcgccgtcgctcagacgtgccgtgcgccgttgcttcgctctgcgcgcgccactgccgcgccccctcgcgtcccatcgtgccgcgcgccgtcgccgtctccggtcgtgtcgcctcgagccccacccctccgctcgtcacgtcgccatcgccatcacgtcgtcatcatcaccgcgccgcgtgccgtcgccatcgccgtcccgtcgactccactgccgcgccgcgcgccgtcctgtcgccgcaccgcgctctatcgcgacgccgtcgcccttgagccccgcgccgctgctgcgccatcgcgtcaccgccgtcgccatcaccacctcgagccccgcccgcgccgcgcactgtcgccgtcgcgctcgccatcccaacgccgcgccgcgccgtcccgtcactgcgtgtcgccatcgccccgagccccgcgccgccgtgccatcccgtcgacgtttaaagccggccacccctcccccgagccctataaataccccctcctttcccttccctccccacgccattcccccctcttctcccctttttcctctttcttcccctccaccgacgccgcattccgccgccgctgccatgccccggcgtctcgccgccgccgcgccgcaccccgccgccgttgccgccggtccgataagccctcccgcctcccttcatcgccggtagccgcgccgcgccgctcggccgtgagagagagagaggagaaaacagagaaagcagagagagagaaaatagaatagagaagagaggttagagtgggcccccacgtgattagtaaatagtaatccccttaatctttattagttaagtctattacatgtaggtccgggtggttaaaaatctagttatggagagtttatagtttcgagtctatgacaagcgggccctactaggtttaatggccggtttgaccctagtcaaaggagtcgggcccacctgtcatttgcccatatggattcctttagaaagaaaagtaaaataaaagaaaagaaaataggaagaccccacctgtcagtcactatagcttgtggataaggttgtattataaataaatgaattaggaacagtaccatttcgcaattattagaattaattcaaatttgaatctttacactagcataacttattcattttagctccgatttgagtgaaacttgaacctaaattcatctaaattcataagctttccaatggtatataattcactatttgataaaatatatttataattattaaataattaatatcaagatgatgcataataattaacttaaaaatgtgctaataaataaaattgatattgtactgtgaagtagatgtcaaataattgtctttaacacgctttctcactataaaacctatgtaaactaattaggagcattgtttcaaattaattaaagcataggaaatactagtgccatttattaatatatgtcaatatataattatactcatgacgtccaaattgtataaataatgtttagcctcatactttgtgactaaaagttgaacacacgtagatgagtctttaacttgtttatgagagataataacagagctagtgtgactaaaatcacccgcacgaaattaattaacggcatttcctatacagtagtatatgtttaggttggaaat

SEQ ID NO: 75841 - DNA, 9798 bp, Oryza sativa
cgacgatggtccctatggcggcgatggttaagggccatcatccggctgacggtgcgtcggcggcgccgccggtatgtggaggcggggaaggggtctggcggcggggaaggaggagtccgggtgcgggagccccgtcgacgccgggaacaactgtgggcggtggccttggccgaatcgctgaagggacaatgttgttgaccgacgacgatccttcttgtgcggattggtggtgtgggtttggacagggaatcgcgggcgaaagccttgccgagccatttggctggctgacaaccgcaacgccgtttggcgtcattcccctccttggaggcgttgttttagcatacccctttcctttccctaccatattctccaggtgaaaaccttgcttcggttccgaacgagcggtggcggcgatccacgtcgcatcctccttgggggcaccgctttggagaaacctcttcgtgcaaggatattgtcattggtctatgcattggcttcgaacttcagtcctaggccttgacgaggccttctagctccacattttgttttgcttttctcagtttgggtcctctcttctcttgtttggtgtgttcaacttgtcttgaactacactctcttctggagtggatctttgtaataattggttgtagttctttttgagcaaaggccgggatattatattccattatctaaaaaaaaacttgttgtacaattgcatgcgaacaaccatcccaatgacatattcaacaccagcgctagtgtaatacatgagataaattaaataaaacaacatttacaaagcaaatatatgaaaaagaaccttaccaatgctttggatgattgtggcatttccaaatcatttatgacgtagaaagcaagaagtgcctgaccaaatacagaaacgttatagttgatgtgtcctctagctattagttcaaagcataaacaagagcattgtagtttaaacctagtgaaaaaggtaatacgtcaatatacacaaatactgcacaaataatcaaacaaaattcccattatccagtaaacatattagaaacagaaaaatgctaatgcatcgtgagaatgtgcttctatagtatgtctcaaaattagtatgttagtagagaatttcacagaaaaaagaatctaggaaaaaaagaaatatataaagttcatatataatatccaccaccatatttaagcatgaactagtcaatatttcatcccaaaacatacaaagtttttgctgcataataacctatgcgtgaatttggaattacatgcaaaagaatttactatgttccaccatgccatggtccatggaacacagttaacaaggtaaactattttggagtacaatacattaatctctacgagatatcctttgtcatacagaataaccatatgcagggacgaagccaggatttgagattaggggggtgtggggtgaagataaaccatgagaccgaataactagtcctttaagaatagtcaccgtcaataacaagcaatgcgtaaactagtcctttaagaaaaacttaaattttagctctttaataatatcattggaaatttaaaactagtctttattgctaaattcttttaatataaactattaaataatctcacaaataagtatcatctattttactttgaaaaatatgagaaatcacaaactaattttgtagatcatgtctcttgctaacatttttagacttgctaactaattaaattgataatactttcaagctacacaaaataaattagataaatacttatcttagctaacttaatatagagtaaaatacatgagggtgtagtggtggtagtgtttggataggggggtgttggcaccctttggcaccccccttaccttcgccactgaccatatgcttgaaaataaacaagtgatacaaggccattatatacatggaactaaaaatgcattatatttttatcaaaggaaagaagatttcagtcccataagaaaaataggaaaagattatagatacctgtgaaacattggtaaccaatctagtaaacatgtatactagagcaacttggtagtacaatactttcttgaaccagtgggtccatgaaatcctggaaagtctcttattctggcaatgctgatttaacctaaaaaattaaaagtcattcaaatactgcaaaaatgaggaaaacctagtggaagaaaaaccatcaaaattatatggcctttaaactatgaactccacaagtgttttttatcttaccctggctcttccgttccaatcaagaacacaacgacgaaacaagatccaagggcaatggacacatatgctatccatcgatactgaaataggattccaaaatttaagataaatccaaaagatcaggcaaatagtaaaatattatcttaaaacaagagagtacctgaactatcacgctcactgactgacgtagactaaatatcaacaaagcaatgccatacaggctaagatttgcgatctagcacgagcacagaaaaggatcatcagattcagctcttttgtaatacctgagttaagaataattagattaaattaatgttctaaccattgtgaaggcattacggcagcttactaatgcaacccgacttgttgggtttgatgtcatgcagttcaccattgaccttagaaaatacgcagatgatgtacacaagtcaaatgcaggaatcacaagaaaagaaaatggagataaacaatgaaaggaagaggcattacatatgagagacctgagtaactgcccagccaacattgaaaatagcagcgaatgtgctatatccaacagtctccattgtagatgaaatagttcccgtaagtttgcaaggcaaacagctaccaaaaacagatgagaaggaaattgctactaaaatggatcctcctgcatgccacagtttaaaatgtccaaagcgatcaatctggataaaaaaaaaagaagatagaatttacatatctagtttggaactatacacaataaacacaggaaaactagtagcgaacgtctaagagaagataagccatgagaatatgatgtcacagctttataacaatgctttagtaaacaatcatgttctttcttaggtcgtaccagttctccaacgaagattgttgcgaagccatctgccaattgaccagaaagcatgacaacagcagcatcactgaaaaggtgaataaaaggtaaaatgtctaaaagaatcctgaagcagcacgtaatcctttcaaacttccaatgtttctcgtagaaaatttctttcagcatctctgatagaacatttctcgagatacgaatacaagtataatgttctgatgatctggtccaacaattccatactgtatgcagtctctacggcatgtctttgatcataaatgagccaataatttccaaaaaaaaaaaagtcaaagttgctaactttgctatagccgcaacagttgcttggacatcatgaagttgtggctagtcttaactcttaagtggcacaataccaataatgatgcaaaaaattcatccgaaaaaagatgaccaatcgttacattcatttgcaggatatcccggtgaaatatctattgcaccacatttaggacatcctgactttaaatatgaacctatgtttttgtacaattcctcatcaagcagagtggattaagtgtttgaaaacaactaaaaaaagtgcactaatggcttcattcaatatgatttagaaatatgtgtaaataacatgatacaaaaattaacagaacaaatggacaacaaaatctatccctcaaaggcacataccttggactaagcccaatatctgtcaagaaaaccagcaaataagtaaaccaacatgaagaagtgatgtcatttagcatatgcccagaaccatatgaaagtattggaactctccctaatggttcatccagttcttcaatcgatgactgattatccattatcttaaccatattttatgtttgccagactaaaggtatcacctacacaaaaaaggaatacatgttgatttcagtatgtaactagcaatctcaatcccaactttgaataaacaaaacaataataaaatgccattttgccaaaagttaaaagttttgaaaaataaaaaatgcctacggtcctgcacactattttagaggcttgaaaatgaagttgcttagcttacaacgagtgtaataagtcaaaccgacagactttttattcagaaacatcaactgaagttatataagaagatagttggtacgtcatgactggcagcataacagttgcttttgtagtgcttataacaaggcttcaagctatgtcagatggatttgagttttattccttaactagaaaaaatgtctgtgcgttgcaacgggtgaaaactattttaatcatgagctgcaattaggagtctgatcgtatcaagttagcatgcgagttttttaaagagatatctatacggctccttctgtatttacaaaagcgaacgaacttaaaaaccgactcatacacggatgatgtaccaaagtaccggcaaaaacatcttcaatttttataatagtagagatgtatgactggtttttactgactgctgtaaaacacattacatggaccatcttaaagcagcaattgatatgactactgtacttgctaacttccaggaaaaaagttcaagttgtattagttcttacatatatgagaatcatgaaatgaatcaaatgccaatctaaaggggggcacaagaagataaggagataaactgaaggttccttttgttgttgtaaagttttttaaaaaaaaaaaacagcaagcaaatttcaatcgcaatggtaatagatcagcaccttcagaaggttgggatgatatggatatgatcaagaatccccaaaggcattattgtagcatatataccagttgactaaaaagttcagatttgaggtaaaagcaactactctgcacacaacatcaacagccacccaaatcaacgtgttatcgctgggtcccaactcgaatcatcaacgaggagtatcgcaagtgcccgaaagctaaagataaaaatgcaatggcctacaaaagaaatattcgcatttccactaactttacgagacatcaacctgatccccctttcctctctgcctttccttccaaaaattgatcctaatcgaacacaacgcaggagcccacacatactctctgcctgctccccccacccaacgtagcaactgacattcgaaccgtaaccaaacaaagttaaaatttaccaaatgaagaaaacccaattttcgcggagccccatgcccgtcggaactccctccaaactctgctacacccaccccaaaacaacacagagcagcacttccatggctggccccaactccatggcgagcaacctctgtgccttaagcccgcaacagactctacccatccaataaccccggaacaatccagtcaaacagatgccgcacatgctcacctcgctgctgctgctacggcgaggaaccggagcgaaacacctccctccgcaagagcaggacgtacggggaagggcaaggcggaggaagaacgaaggcgacgctcggtggtgtcgcgtggacggcagcaggaggaggagaggagaggaggaggagtgggcagggagcgagccgtgcgggaggaggagacgcaacgcaaacacggaggaggaggaggagagaggaggaaccgagggaaatggaaggagactgggcgagcgaaaggcgtggctgacgcgggcccccaccaccgatcccatggaatggagtctggactttggagagacgagagcgacggagatttgatttattctaatccttctgtttagtttattagtggcgtcgcgcgcgcgtcaattcctccgttttcgtggccgccgccaacacgcgggacggcgggacggggacgttttgctctcggctcgtgttctcctctgctccctccatcccacgaaaaaatccatttctaacattccaaaatagaattagtagagaataagactaactaaaatatttttaattattaaaaaacataataagactaatatgtagataaatggtattgaagtaaaaaccttctcgttttacgttgatgatagataagatagtagaagttggtttttctaaaataaaatttaaactctataagttgagtttttttacgatggaggaagtaaagctgaagaggtggccgtgaccgtgagttgccttgattaaaaaaaagtctatctatacggctattagtatgcgtctcgagtaattagtactccataaactaagtcatggctgcgtctcgatggtgttttcttccgaataattttgtgtggtgatcatgttttcttctgtctgcaagaacatggggtgggatgggagaaacgtaacgtacgtagtgacctgtagggcttgctttgtcaacaagtgagttgttagtcttgtcctattcttaaacaatgaattttcacaagtgcaaagcacatgaattttcttaggacatgtacaatggaagacacccatagagtaccctcactaactgaaggcactcacgtgtaggggtgggcagatttagaccgaaccgaagaatcgaaccgaaaaaaccgagaccgagaaattcggttagttgttcggtcccagccatcaaaagactaaatttatttcggtcattttggttattaggctcggttaaccgaattgaccgaaattttggctcaatagatctaggaagcacgataaatataaatatatatatatatatatttgtgtgtgtgtgtgtgaaaaaatgtctcaaaagaggggaagtgctgttaaaattttcattccaaacttactcctgaaaaatttcagtcggaccaagaccgagaccgaaaagactgaaattgaatttgccagccctgtgtttttttaggatgaaattcagtcctaagttttcaaatactgaaatgaccgaaagaccataaaccaagactgaatttttcagtctaaccgaacgtccaccccctgctcacgtggacactcgtctcccaattaaggccacaactaagtgggttcttcaaaacccgaaacaactggatcaaggtactctatcccacagtagatatcccaatcaaaaagccacggatattaatttcctctcctacccctgccggcaacacgtctctctgctccctctcgttcttttcgctgctctctccatccctcaacttgctctctgctctctccctctctctcaacaaagcagacggcaagccgtgcggatcgccgtagcggatggccccgccccaccctgccgtcggcattgaagcggcggcatcgacggcgcgttggtctcggatagtattgtagcgtattgccataggttaagagtaatattttactaaatccttttagaaagcggcttttacacgaaacctacatgtgacagtagatttctggacagtgtgagacactgacgcaaatcattgattcaaatatttgctgcacaaatttgatagataacgggtgtaatatttcgttatttcactatcattgcaaaagaatgaaagtgctcacataatacttgattgattctagggataaaatggttttctgaaagacttaactaaggtccatggataagaacattgatatcttgtagaacttgcgtttaaacttattttcatctatgagacaaatatttgcattaccacatgcacaccttcgcacacgccggacgccctgcctgctctaacatctctaaccttctcaaaattgagcacatcagcacacacacccatatccccccaaaaaagaaaattacaaagacccatattcactggaactccctccaaaggtcaaactctacagcctctgctcaagtcacccttaataccgacccatgcactatccatgctaagcaatccaacagccattagacatttaattgattattaattatcacaaacttgaaaaatgactttatttgtctatttagaaaactctgtataaaacattacatcgtttgataattcaaaaagcgtgttaatgagaaatgcccaggggtcttctggctagctccacaaggtggtgggctagacgacctgggttcaaagcctcacccctcctaattatttgatattaggtccttccctaatattctagtttttcaaaaagcgtgttaatagaaaatgaaaaaaatgccacccctaaactcactatcgaaggggtggattctcccaaaatctccatgccccctaaacaatccatattcttagattttgtagttatagaatatagaaaataaattcttacacagtcataattcttaaaattttaagcttccctaatatagccttagtaatatgtatagaatcacggatttctaattgaaacaaaacacatccgtagagccgtaaagtagggcagggaagagcaaggtcgaaggtggaaggcacggcaggaggagaggaggtagaagacacgcatagtagtaggacatggattttcattcctccacgacatgatatttcctcgttgtttacctatcatttaaatagtcataaaattttttaaaaaacttaacaatatagattaatacgaaatatagcaccccacaaacacaagaccaaattcgacttctacatgttgtaacaaacagaacaaattaaactgaaaatagctatatatcgtacattcgcatatatatttattattattttacaactagtagaagttaaattttaacttatatgtttgtggagtgatatactttatattaatctatcttaccaaattgtttcaatttttttttgataattatttaagtgaaattactttcccatagtagcaaagcaaagcggaggaggaaacggaggaaacagggggctagcgcgcgcgaaaggcgtggctgatgcgggtcctcccgtcttgggtcaggtgtggatggagattttgtttattggtggagtagtggcgtcgcgcgtcagctcgatcggcaggctcgtccggtcgtcccttcgtggccaccaacacacgctgccgggacggcaggcaggacggggacgttccttccaattccttcgcttgtcttttagccgggagaggtagcggggaagtgttcgctacgagtatgcgtgctcggtgtgtacggcgttcaaatggtctatccaacgtatggttgtaccgtgtttagttctaaataattctttaaacttctaactttttcatcacatcaaaattttcctatacacataaacttttaactttttcatcacatcattttaattttaaccaaacttttaattttaatgtgaactaaacgcacgcttgatcgtccgcaagaattgaggaatacgggtggagtatgtgagaaaaggtagcagtgtgtagagcttgcttcgtcaacgagtgcttgtctacttggccactgtttgttgtcactatccatcgaggatgtcttttaacaaatacacagatactttcttacgcctagttaggagagtttagccatggtagtagtttcatattagaatctttagctcccaaacagcgtgtattctcactcactcaaattataagaatatatagttacatagtctaaaaagtaaactgaaatcagctactcacagaattttaaacaccccccccacccccaaaaaaaaacacccaacaggaccttacttattagtagctgaagatactagactattagtacattgatgcaaggttattatattcctacaacaaaatgaaagtgttgtgtttactcggatgggagaaaagagaagaaatataaaggaggatgagaattgttgttgaggag

SEQ ID NO: 75842 - DNA, 8176 bp, Oryza sativa
aaccttgtttaaattctaaagactgatacattgcacatactccgaccggacgagacgcactgtttcacccgtgtcgtttgagaagcactcacttagttgtttttagaaaagagctcaaataaaatcaattgcaaaaacaacagcctttctttgaagcctgcattaaacacttacttcccttggcttgctgagtactcccgtactcacccttgctctatataaataatccccccagttgctgaagaagatgaagcggatcctgctgatgaggagttcttccaggagcaagccggctatgatgagttttagggtttcggcctagttcccaagtcgcgcctgtgttgattagtccaagtcctggcttccgctttccttttgtaatgcagttgtgagctcgggatctgtccgcagcccaacatgactgtacatctactctataataaagagacctctgttgctgtgatattctgtctctctgtgataccagcactgtttcctgggactggtatcgattaacaggttaatttggagcgtcacgggctagttccggtcgggactagttcggggcgtgacagcccaggactttgtcctttcttcctcctcctccttctacccgacccctcctcatcccatctcatctcttctcttctccaactcgaaaaaactcctcctctctcctctcccaaaccctagccacctccctccaccaaatccatccggttcaaccgtcaaaatcactccggttacaccgtaagtgaatctcctcctcttcctctctctattccatggattgatttgagttcttattgagtttgtgatccatggcatggaaccctaggtgaaggaagaggtgttcgtcgatttgcaccaatagagggtagtttcttggtgtgattcaactccttcaaccggtaaatccctctccctcttgtgcattgctctcaaatcggtctatttcaatctttagggttaagggtagtttccccattgcttcaatagaccttgatgttctagttccaatcttgtgcaacactgttctagcagtttttagaatcatttgtgtggattgtggaaggatttgggtgtgctcgcgtgagtggcggtctgaccggacgcggtctgactggccgtgagccgtcggtctgaccggccgagggccggcggtctgaccggccttgagccgtcggtctgaccggctgtggctctcggtctgaccgcccctgacaggcagcactcgcccttcctcccacttcactatgtggtttctaaaattgttgctcatccatcctttgctccttgtttttcagctatgcctccccacactcggcatggtcgtcgtgagcccacgcccgatcccgttagtaagaatgaggaatcgagcggagatgagtatgttcaaagtgatgaggacaatatggaaaatgttgagggtaatgagttggatgtaagtgatgatggtgatgacaatgggagtggcaatagtgaagatgatgaggcaagtgatgatgggagtcctctcgattccaccatccaatttgtgctaaatttgaggaatgctcaacaatacactatcctccatcatcatgatcaattccggaggcctaacgattgtaatgatccaagatttcatacacggttccaaaagtccgtgtatgaacaagtgtatgccaacaaagccttcgccgaacacaagtggatttcttggaggcacattggtgagacaccggagtttgagaatttgcaagagatgttccggaccgttgggattgataggattgtcaccatgaagcaaccttttgatgaagatctcatccggcaattctatgccactgtatgggtgtccggcgattgtgatgcaatgaagtggatgtcggggaccctccgatgctctatcaaccgccgtgaattcaaggagctcttgcacattcgcttcaataacggggatgaccttcatgatgagcacacccacaaccccttccccattgatcacttttctcagttttatgaagaagggggagggtacacatatggaaaggtggcgggtttgagggctctcccaagtgtgatcaaccgcagagtaagggccaccatcctcccaagatgcggcaacaatgatgacatacgcggagttgcttggcatgttattgatgccattatggatggtcgtcggtttgatgttatcaaccttatgatgaaggagattgccatctcaaaggggactattggacaaggaatctattatgctccctacataatgaggttgattcaaagcaagttgggacaaattggtcacaatttaaaagaacataaggagtacaagcctcgtctccaactgtcctcccctagagctcctcgtgtgcgccaaccaacttttgatcaaggtgcaagctcaagtgcagccccccctcctcctcaagggtatgatccaagtactttattccatccacaatatgcctactttggaatgcaaccaaatgacttcttcaacccggtccttggggctattaataccctaagtgaaagcattcaacacttatccaccgggcatgaaacattgcatgaggatgttcgtggcttgcgcaccgatgttggctacttgaatacttcggtggaaagattgcatactagggtgggtgtattggattctcgcgtccaaaccttggagagtacccaagcttttgtctatcattgtcgccgtgatgcttcttatccttccacttcggcgcgtcctccttctcctccacaagagtgaagacctttttagagcttgatgccaaaagggggagaatagtgtgttttatgttttgtgggttgggactagtagtagtgaggttagtcacctcatatttaataggttaaggaggattgggctatatttggtatgggtatgggctattactctatattgtgtattcctttttcgttttgttgttctctatatcatttggacccttcgtggtcttgtaatagcctatatttatttgtgagccctttatgtggtcttaatgtgaacttgtgctatgatggatggttggtgtgacattgatatatttgtgaccatcttatgctcatgaatgaatatttcttgaagttcacattgagatattgctcttgtgtttgtgatatgttgaaatgtgaaattgaattgtgcattaactccatatttgctatttgtgattgttatgcatatgtttagggggagcttttgcttgtcaatacaatatatgtccatgtgctctatgtttgattatatatatttgtggtgtttgtcatcaattaccaaaaagggggagattgaagcatctagacccctggtgttaattttggtaattaatgataagcactaattgtggactaaccgttgtctttgagctatatattttaagttaggtccacgtcatatgtgcgcatggatgattatcgatggattaaaattgacggcgcaaagcaaagggaaagaagacggtaaaactagcgctttaatttagaattgatcgaggtgtagggcgatcaaatttgctagattaattttagtttcgccgtactattaagaggggtaatgacctagcaaagagatgattttaattgccacattaggtcattgcatttttatttgtgctctctttttcattacacaaattcactgggttcggcctgaccaggggcggtcagaccggccacatagtggcggtctgaccggtgtgccctggccggtcagaccggctacatagtggcggtctgactggcggcactttctcggtcagaccggcctcctggaggccgagacgatgctgctcgggatggccgatacagagccgacggagccgtagtcgatcagaccgagccgatgacggtctgaccgagccgaggccggtctgaccgagccgaggccggtctgaccggccaccccatgtcggtctgaccggccagggcgatggggccctctgacagggctacaacggctagttttctagccgttgcagagtagcacggtctgaccggccacatacctccggtcagaccggcagagcacagagttgggggatttcgcccccaacggctagttttggtgggtgggagtataaatactcccccaccagcagcaagggggctctcttggcacccaattcaattgcatacaccccttgcacctctctcacactcacttgagctttgtgttcatccatctagtgttagagggttgattagccaagagtcaagtgcatttgcttccattgtagagctagtgtggcacttgatcatctccacgtcgggtcattgcttgttactcttggaggttgccgcctcctagacggcttgtggagaagttgcccggtgacctctccgagaagattgtggaggaggcccggtgccggtttgtgagtggtttggagttcaccaccttcggagtgaaggaagaactaccctagtgatcaaggcttgggtagttctctccgtgggccggctcccgccttgcccaccccttgacgaagggggcgtgcggaggcttcgtggttgagcggtggagttgggctcgcctcaacggggagtaggaaaccggcgagtttccgaacctcggtgaaaaatctcttgtctccttgtctcatttgtttgtcgcatttacttttgtgcaatttacttttctagagacaaacttgagatcatatcaccctaggattgctaaacattgacataggagtgtgatttactttcctagagatataattgagcctctatcaccctaggtttgcaaaacataacttagttgcttagttagagttgaccctcaccaagcctagcaacttaggttagttttgattaggtgtcatttagttttaaatcgcctattcaccccccctctagtcgacatctcgatcttacacaccgccgcatcctcccagcgctttgccattgatgcagagccgcggagctcgagggggcggcagactcgtcagcatagcccacctcctccaacacccttgtcggcgccacccgtccccgcacgccgccgcccacacccatccccacgcaccgctgtcttccgcgtgtctctacgcactaccgcccatcgcccgcgcgccggcgtcttccgtgtgtccccgcgcgctgccgcccacgcccgttcccatgcgccgcgagacctcagtagccaaccccgtcgtgttcttgactgcttccctcaccgggaagaatgaatggagggagagagagaggaagagaaagagaaagagaaagataaaggaggggcaatttggtaagccatgtaaaaaagtgggcccctctcgcttagtcagcacaaaaatattaatttaatggatagagtgtcccctggcaaataaccacattttgagagtgtcttccctcaaaagtgacttcatgcagtgtcctacagctaaaaccacgaagtcgcgatgtcctgtagcaaaatttgccttagtgccatggtccaacatgacaacgctaatgacgttggcgctgtcccctctgcccctccgctagaagctaagttaccaatgaacaagaatggtgttgaggattacaatattatgctataaatttgatcaaacttaaaaaaaagttaagagaaaaattaaatgacttatactataaaataagggagtataagctaacagttatataagaaatccaaaataaactcgtacatataatgataccttcagacttgtatatataccacgtaactgcgccaccatatattatcaaatttgtcatctactagaaaagatgcccgtgcattgcaatgggtagagccaatttaatttgtacatatgtgtagtggataaataatcacgcccattatttcgtttattcatgtgcctatccaaattacttgttaccaaataaaagactatttatgtgcaaatctcttatatacatgttattagcgacgcaaagtaaatgctgtaaaataaagtatgataaaaaaagtcattccgccaagaagaaattactaccgggttcgttttttcattatagaatcggaaccaaaatgtcgaaatcaaaattaatttctaaaatttaaaatttggcttagaaataagcataagccaaacaatgaggccttcaaacacgagcttgatttgtcgttaacctttatctcaagtcgggcaggaattgatgacaaacggaatcaacaattcgatcgtcctttattttgattagcatgttcttttcgaaagttgttgacgaaaaacacgaggcctgggagatctgcttaattccaatgcaggtccaaaactcgcattcgggtatgctagcgtgctagttgatttgatcctgtaatcaacaagaaataaagacaaagaaaccgtggttaaatcataaacgatagccgatcggctaggtgctgatgacatatcatttatctttgagccgatgtcatatatgcatcgataggcaagcattaataaataaaacagaactaaatctactcgatcggctgtagatattaacgatatataatccttatatcgatatatacttaaatcaagtaattgggatagatcggtcgccatgctgagacaatataaatcacttagatcgaaatatatattaataatgagattatatatgttcatagcatagccgatcaaatagatctagcatgtatcggctaatactccgatactgctctatactaagatatcaaagcaaatagaatatatcaaacaaaagcctaatatacttaaatgcaacaagatcttaacataaagagcggattcaacatatcaatgaagcatataaaacaaatatagttaaaccaggtaagatcggctgaaaccccgatactaccctaatcggcaaccaagaagcaagctagagattgagactctaatcacaactcataagatcaaaatcaaccgatgcagctataagtatgaaaagaagaacaatatctagacaattaagccattggaagtttcatagagtggtggatatcatatataatctaagccaatattgatatttaacctaatcggctgccctctattaatagacgttagccgattgtagattagatagcgatattgtcagagattatataagatatatgatagctcgatgaattacataaacaagattagagtatcataaagatggaagcactaatcccgagaacgcaagccgtcataacaagttttacctcttgttgaagatcgaaaccgatgcagctcaacctaaaagcaagaactcgtcgaaataaaactaaagcaaaaagggtggcgatgcgccgagattgtattgaacgtgtgttaaattgattacatagggctcggggtttatttatacccgagaattatacaacatatccatatcggagacgactcttatccctaacaaactctaagataccataagtctttacggcagacttttgtccaaacatatctctaaggaaattacataaaatattctaattaatagatacaattgtcttctcaggactctattcgtgcatggcaatcatcttgaagcatatcaactcaacccgatgtcgtacaccaagtcatattgtcggaatcggctgtattacccaacccagtctgacttggatttagccgatcccgatcgtaaccgatttggaccccagccgattcttactctgtttccgcgacgatcttcatctttgattccgcttcgatctagtcttcttctccgatactgatattaccaaatttggtcattaacaaaagtataactgattcttatggattaatgtaactaggggtgaaaacggtaccgaaactttccggattccgggcctgttttcggaaacggaatcagccggtcagaattttttcggaatttcttagaaacagaattgaatatgatattagcagtttacgttggaactcggaataggtcgtaaaaattctagaatatttatcggaatttccgaagttaaaaaggcccatagaatcaatagtctataagtgtccccaagttcctagcccaacccaaaatcgcggcatctacccaaattggagcagctaaccctagagaggagagagatacacatgggacacggcatcgccatcgcgagaccgcgagccggcggcggagcagtgcatccagatcggggcatcgcgctccgcccaccgcccgcgcccacctcccacgcccatcggctcttcggctacttgcgacctcgccc

SEQ ID NO: 75843 - DNA, 9864 bp, Oryza sativa
gggggatggcgtcgagctttcgtccgcgtgcggctgcgactcagcgtcgtcgttttcatttctatcccctttcctctctcttctctctctagcgccaccaccaccgactccgccgccgctccccggcaccgccacatccctcgccaccgctgccgctaccaactccgcctccaccaccaccctcgccacctccgccgcggcgacggcacccagaactggtcctcaccaacaccatcctccgcggcgacggcggggccaacctccttccggacggcgacgagctctggacggcgggccgcaatgaagccccacaacgcgggagcgtccatgcggccggcggccgcacatccaccggagcgcgccacggacgtcggtgggcgggggctccgcggactcggcctccgcgacggccacggagagcgccgcctcggcctcggcgaggcgcgcggggacggcggcctcgcgggcctcgagcgccgcgagggactcggaggtggatgcgtccacagcgactaggtcatcgtcgagcgacgtggagcgggcggcgaggtcctcgcaggggagggaggcgaggaggcggagcacggcgtcgggaggggagagcgcggcgtaggtggcttgtggagcggcggtgggaggacgacgagcgcggtgtagaggcgctcagcgatgccgtcccggcgcgcgcggagggcgtcttggtcgtcggcggcgtcgatggcgtcttccagggcgccgccgctctgctcgccttcactcggaccggcggcgctccggtcgggatcggcgccgaccacgcccgccgccgccgccggagctcgcttgctccgccgcccacccgcgccgtcctctgcccgggaaggagagagaggaaagggaagaagagcgagaagggagagggaagaaccgaagaagagagagaagggagagggaagaagtgagagtgaggctgacatgtggggcccacatgggccccaccattttaaaattatttttttgtgcagctgacatgtggggccattctttttattatttttccgagagataattttcacgtaagcgccacgtcaatgccacgtgggacggaggcctagtcaaacaagccacgtatgcgccacgtcagccaaaaccgccgagggaccatgtttgcccagttttcataagttgggggatgggtcatacctggttgacgaaaatcggactgggcaacaaatggagggacccaaagtgaacttattccttatatataatatataagccttacaattagggacagagttagtatgacactaaaattaagattccaacgcaaatacaatttggtatttcttcaactggatttccggattgttggacaatgcaaaactattgatttagacttcaagctttaggctctgctcgtttcaaggtgttgggaaccctttctcttgtcacgcgaaacgaagcagtggattagtgcatgattaattcaatattagctaataaaacttgataatgaattactaagatattttaaagcaactttcctatagatttttttttttgaaaaaaaaacgcactgtttacctgatcaggaagcgtgcgcacaaaaatagaaagtaaaggttagggaaagtggagtaaagaacagttcctaagataatttgcatttattaattaggaacttcgaaattattctgattaagaaaaactggaattaagagtatagcttgtatgcattaatccatagagtaacatacctatgtcaggatatattatatccatatcacagaagccattacataaacttcagagatgtgtccatatgtagtatacaagttaaaaccaatggtataccctcatggtcactaggttgacagaactcaactatcttatagccatatgtctaacagtgttattatcttctagagaactttgacaagagatagacaacgaagaagcaaaacagagcaaaaaggaccacgtgcacaacatgattcgagccctgttggatgatgctcttgttcatccttcgcatgttatgcttcactccagcctgagcttttatgagggtcatttgctgtccacaaaaaggataacaaaaatcagagaataactaggatttatattattgttggagaaaacatgaagaaaatccactgttgcgattgcagtaacatcattcaactatagaatgatattacaacaactcatgaaagaaaatagattcaagactatatacaacaattgaactcagaacaaatggaactccaaacatggatatctgtatactttcacatgaagaagcatgtagaaatagtataggtaaatatctctgaagcatacatcctgatagttaggcataaggcatggataggctagacaaattcacaaaggaaaaggaaatgaagggttaaatgcatgccactatcaaggtaaaaaaagacatagccataaggccaacaaatatttatttaccagaggaaaacatgtcatgaccacaagcttaaaggaaaaggcaagacatagtaccagttggctgaggaaatcattctggaacttggcttcagcatttatctcctgggccacctggaaaaaatcaatcaagcctcacaaactgagcgcccagaaatgtgaacagaacccaagatcaacagcttatgaacaaaggaaaaaaaaaatcataacttgaaggattttcttataaagtcatactcgttactggttgaaatctggcataacatgtacacataatttatgggattgtacagcggcctaatacaaaaggtgcaattccatatgaaggttcaatgaaattacataatgctcataacaacaaagacaatattaagtaccatgtcactataggagccttagtttggacgtacaagaaggatttattttgctaaaagtaaatatctaaagaacctttataaattcttaactctccatgagttcgggatttacaacaatatttcttttagatgtttagttgtagagaaaaaaaatacttaggggatgaccaaactacggctcttacaattgataggtcactagtgccaagcaagcaaaagaaaataaaagagcagatggaacactgcaatgtaataattatgtaaactaataaatagatcaagacaatgtcctgatcacctaatcggagtttgacatcatatcagtgtcgaaaatgccatcacatcattgaaacaacctagacaacaaccattttgtaacttaacatatggtattgatattaacaacatatatcaaagaagcaggcaagcagcccttgctccttagtttgaagattatatcaagtataaaacaaactgacaagatgagacgcacaagaaacaatatagttgatcgatcaaattacgaatcaaacatttgagaagcacaaagtttatcttacagcactgcatattaacacctgaacatattgggagcaggtctaaagttcaaatgcacacacaaaccaatagacctctaacttgcaaataatggcaaaaagtccacaattgagcatacctaacagaaattaaaaaaaaacagaaagaaacaaggatggagagaaatggaaatcttacgcctttcagtaggcgaaccctcgagtgcagcccatcgatctcctcatcaagatcgccgtgcaccggatcgatccgcagctggatctcgtccgagctcgacgcattcctgcaatcaataccgaaagaaccccgacaaccccccaaagttatcagggactcgattcagttctccggagcaaagacgagggattcggacgccaccggcgcaagattggatcgaacgaaaattcgctggctgtgggtgcgggttttacctggatcgaagcggacccgagccgtgcagcgggttcgccatcgcgcttaccagcgcagatggggttcagctcgttccctcgcgacttagatggaacgacgaggcggcggcgcacgggaaggagggagggggtggcgcgcgcgcaacggcgacggacgacggcgggtggaggccggaggggaggatggaggagaggagaggacgggaaggggaggggaagacactagaaggaaggcttcaaaatgaataattatttttaggaaaaaaaatttctggttccttcctaattaatggagtaatacaaaattatcttaaggtgtgcttttatacttcacttgtccaacttttacttcctcagtttttatacacaagcttcccaaactattaaacagtgtattttttttacaaaaattttctatatataagttgctttaaaaaaatttatattaatttatttttaagttttttttgctaatattgaattaattatgcactgatccattgcttcgttttgcatggtaagagaaagggttcctaataacttgaaacgagcgcatcctaaagcttggagtctcgatcaaaagttttgcattgatcaacaatccagaaatccggttgaagatataccaaattgtgtttgcattggaaatccggttgaagaagtaccaaattgtgtttgcgttggaatcttaattgtaaagcctatgaattttatagatggtcttatggtttaattgtataatttgaccattagtttatttcatttcgtattatgttatcatcaactataaattagtataacatgaaagtattttaaaatatataaatctagtgttatcatagatattgatagtataattattagtcaaaaattgccaagtttgatttttttttaaaaaaaagggcgccctcttatttggggtagagggaatattaatttaacagtttgaaataaggaaaatattattactaaggtttatctcacataaactcttcttttaatttaaatcatacctaatgttaaccatgttataggagacgaaagcataagcaccaatagaatccgatgcaacaaaaaatctggtccaagaccactggtttcgaacttgaaccaactaaactgtacaaatgtccatactggtaggatgaatgaaagtacgcatttctcatatattattgatcgtgagccaataccacattcgaccaagtgaatatttcatagtagaatctgtggaatattagtattttctttacatattagtatttcctaataatcatgaaatgtagtctagcaacagtaagagtcccaggagaatttgtttcaactcgagattgatagagaaaacacctctttttcacccatacgcttcccgaattattaaacgtgtgtattttttgcaaaacttttctacagaagagtcgtttttaaaaaaatcatatcaatccttttttaaaactaggcattcaaaaaaaaatccttttttaaaactttaaaataattaatacttaaattattcatgcactgatagctcaccttgatgtatctccccaatattctctttctctttttcctcaaacacaaccagttcaaagcctcaaattaattttacattgttcaatagttcctgaattggaaactgagttcaggttctttacagtgaaacctattcatttggatttaagttatagatttgatacattatttttttttcaaaattcaaatcaaacaaatacctacttgtaacgtgtttgaatcttaatttccctattatattaattttccagttccaaaataagaaattaattattaccacctactatataggtggaataggtgtatactattcttttttaacttaaattagtatataaatgtttttagggaaaattagtacatgtaacttactccctccgtcccaaaataagtaatattttgcactgtttacgtctaaggtttgaccgttcgtcttatttaaaaaaattatgattaaattttttattgttattactccctccattccaaaatataaggcataaccacccctaacccaaagaccaacaaataattattatcatcttgtagtttggatcatcctaataaatacaatgcatgcatccaatagaattatagcaagtttaatagtatagcccactgctagctctaattcatttatagccaatctaatagctaattcatataatagttgcttactatactactccctccatctatttttgatagttatatttctaaatctgaaaattttatttttgataggcatatttcaatccaacaacctatcctcttaatgattttctcgaatttaatgcgtgactctctattcttccacacatgattggctacatgggcattgagaaatgtaaatattaatgaatcgcttgtttacgaggaatgactagtagcatgtttaaatggatgataagtagaattacttatccttggtctgtgtgccaagatgaaatatgactatcaaaagtagatggagggagtattaatttatggtcccacctatcatacacatattgtgtcttgtagtccgtggtgcagttggctacagatctgtagaccgatgctcttctctctcatcttttatctcattaaaatatatttatagctggctaatagtctgctattgtacctgctcttagagagcatgagagtgtacgatttaaaaaagtaataatttattggagaagtggttatagttaattgttgtcacgcccggaaattcactagtaattttcgaactaatttgtgcataaaatcctcgtccagaaatcagccgaggtacacaaactgacaatttaatatacaaatccatcataataataacgttacatacttacaaaagaaaagaaaaacaacagcggaataacggtctagcgatggcttcagctccactcccacaggcagctcaactggggtataagccaaacgtctgctccttctggatcctttctcttcaactgaggttgattgattattgcaaggatgagcatatgacatactcaacaagccacacagcaaatatgcaagtgcacaagaataccaaaggatggcataatataggctcatttgcaaaagcagcatttagcaaacatttaagagaagtaaaacagtagagtaattaatcatcaattttaatcaacactgaacagcaccccaatgctgcacaggcccaaccatcctaaacaaccatacccggctgtacagatctaactccaaaccaggagctaaacaaattattaccagttattgcatcaataattatttgtgagaggtgtgagactaatcacgaaaaacattgctcaacccgcccataaccgcgggcacggctattcgaatagttttactctggccaaaggtgtaccactgtacccacaagacacgattccacacatgttgccatgccccgaagtaccaccacggcactgcaaagggggaaatcgtgacaatacccttcgcacaacacaactcaccacagtgcaccattcctggatcataatcacccccttataaacaaggcatggactccccagcgaccccacggacttctcgccgcttctcagtttggcaccccgtaatgaaccatgctatacaaaaggtaaagtcgttgcccacgctggcttgtggttggcacggtaaatgtttcacaacaatagctcgcgaactggtccttaattgtcatgagcacgaccttcaaaaccatatactcacaacccaccattgacaagttttaattatcaattaattatcataacacgataaccatgagctacatttaaatctaaccataatttaaatctaaccataagaaatgatgtaatatgattcaccccattaatgagctaatgtttctaagcatggctaagcaattatatatatatagcatttagctgaaccaaaccaatatataaggttctagctaatcgaattataactcataggaaaataaagtcatcttcggccattaattaattgggaaaggctcaccacccgatgacattcgaaaataatgcataagttgaaataaaacattagctttaaacgggttcaacatgcttaaagggtcctttgggatctgtgtgacttgccttgagcttcctcaaacgcttctgaaccttcctcaacgaaaacgctctcctccaaaacgtcagaaacttaagcgaaagaacaaaatcaacaaaacagtacaaaaacaagcataaacagtacatgtggatatttttaacatgtaatgaatttagcaacttgaaccactcgaatccgagttacgatgatttagttatgaatttccgaagtttaatcgattttcatctaataaagaaaactaagaaaagggattaatgacgtcatcgctgacgtcatcgccggccatggcacggcttccacgcgacgaccggcaaaagagagctcggttgggctatccgagaacacctacacgtagaggacgacgacgcgaactcaccggtgcaaagaacaacgacggacggcgacgaacgacggccggcgacgaccacagcagcggcgcgacgcggctgaaggatcgccggcgacggcggcggctagggcaacgtggcggcggctctacgggcgacgatggagctcgggacttggggcaaacggaagaggacgactaggggatgctatttataggtatgggtggaggagatcggctcaggaacggatggatttggtgaaggaagttaggatttatccgagttcacccgaataaaaacggccgaaattcgtgagatagataacgaatttgatgagggtttcttcgggattaggtagaggagatagagaggaatccgttttttcaatcaattttgggagggaagcaacggatgcaccggatcgaacggagaaggcggcgttgcaacgcacggcatcgggcagaacaggggctctggaggaagaagatgacactgttgcgagagggaggtaaagcagactttaggctgggctgaggaagggagagagaagaggaaggaatgggccgaaaagggcccaagctgaggaggaggatttttattacttttccaaataaatcaatcaccaaaatgatctttgaattgttaaaaatacttccattgctcaaataatttcaggaaaaatcctgaaaatacttggacactcaaagtacttaacaaaattaaaatcagatcatttaatgattaatttaatatttaaataattgctgaactactctttgtaggattaaaattaagagttgagctccgaaaaatccgagaaaattccagagagtataattaacaatggagaatttaataaaacttaaatccagccatgctttatatttagaaaattttatttcccacatttaacttcacttgtaaattaatgaacatttaatataaattctaataataatttattaaataatttataaatcctgaaacgaaaatcaggacgtgacaattgtctatatgcatgcataccttatattatggaacatcttaaaaaaaatggttgtgccttatattatggaatggagggagtggatgataaaacatgaataatactttatgtgtgactatttttaattttttttaaaaaaattaaataagacagacagtcaaacgctggatacggatacccacaactgcatttatttcgaaactgaggtagtagatccttagatggatagccttttaatatatacctccattaaatatgtgtttcctaggtggcctgattttagtatggacgcagagacataatcggagacgtaatctagtagcaggcgtaagcgtaacccagacggactatatatagttggaacccacccacccgttgcgttgccgcccagccgaacagccagaaatccccatccccacaccccagccagccgtctcatcgccaactggttcagcgcccattttggccactccacacgatcccctccgctcccaggccgacggtggtagaggcagaaaatcggatggacaagccagcggcgacccggcggcgggggggggggggggggggggggg

SEQ ID NO: 75844 - DNA, 822 bp, Oryza sativa
catatgggtgctggattttgcaaccagaacctttgagttctctcaaaggtgcctttgaggtctcaggaatgaaaagaaaaaaaggccgggtcgttgcatcagcttgatcaagccgatgcatcgggcaattagtccccatcaccccaaccatatttcatcgcacttttaactacatttaatccaagaaaatacaagaacaataagaacacaaaaacataaacataaacaacacaagcaatgtgaaaggaggggagggcgctaccgcctcctcccctcccgccgaatctgacggaggggagggcaccactgccgctgcctcccctctcgtcgaatttgttggaggggagggtgccgctgccacctctgagtcgctgggccgccgcagcctccccttctgccggatttggcgaaggggagggcgccaccaccaggtaatgcggtggagagagagggagcaagagttagctgagagagggggagagagagagggataggggaggaggcggagaggataagggagaggggtaataaagaaatagagcaaggggtgatcaaaagggagagatattggtggaaacaagctgtgattcggcttagtcgggtggttttcttaataagtgccattatttcataaaactgacacctacattataaatatagttatcggtttttaaaaaatcaggacctatgatatattataggtgttgatttttatttagaaccgacacctatctctcaacaaaggtaccggttctagccgatggtgtgtcatggatgcgcgttttggatggaaaaagcaagataggtgacggttttagcatt

SEQ ID NO: 75845 - DNA, 1822 bp, Oryza sativa
tgcataagtgcttggaaaaaaaattgaatgacttgtctcataaaaaactttagaaaatacctcacatgatgatattctaatgaaaaaaatgcatacgagtgaactgtggaaatttgatgtttcaattggcataatactctgttgcacattttatgtttagatctattttttaaatttttttcaatattttagccattgggacttgacgtttcacgtggctgttggtgttgcaatcactattttttaaaagttgcatttctttgaagagttttatcaagaaaattgaaacatttgagccagtgcagaaactatttcctacatgtggtgaaagcacctgattcttaggataaattagccatccaatctttagccatgtgctgaactcttgttgggcctgaatatccattacagaacacactagaaacgggttgtgtcatgtgttaatcgcaataactaaattattaaattttgtcatattttttagcaattattgctgccatgttttaatagattcaggctactaataattatccaacaaaactaatctaaaaaaaggaagaaaatggtaaatgtcgatcagctaaaagtaatgacggctcgctgtgttcaccacctgtagcaatattttaactatactcccttcatctcaaattttaactaccattatggttcatatgtagtacgaatgaagcaatattttgggacggaattaaggagtatacaggtgcagtaccatgaatacacttcctttcttatcatgtgaaacctcgttccacttgttctctcttgataccaaaacaggtcgccctgtaaacatcatgccccaaccatcgacattacctcctacctgtaattaagggcgtcgcataacgatgaacacatacgacaaaattgattgctgcaacaactcatgctctgcaacttgtttcatggcctacctagttgcaacttgcaagtgaggaggtggatgtgtccttggccatgtaccgcatgtatcccatgtatcgaacaagtgaggaagaacatatccccctatgtgttcgatacatgggactgggaaccatcttcttcacacggaaaacggagcggtccattagcgattgattaattaagtattcgctattttttttaaaaaatagattaatttgattttttaagcaactttcgtataaaattttttttgcaaaaaaaaaggtacagtttgaaaagtgtgcgcgcaaaaaacgagaaaaataggttgggaacaccctgaaacgaatgctattcttccctctactttcctaactcaggccctatttacttcccaaaacataaattttcatgttgtcacaatgaatgtttgaacacatgtatggagtattaaatgtaggaaaaaacaattaccagaccctaatggggtttcctgacagaatctataatttgtttcattattatactacgtttaatactttaaatgtgtgtccgtatatccgatgtgaaaatcaaacctaaaaattttcccgaactaaacaaggcctcacctcattctttttacccgtgcacgcttttcaaactgctaaataatgatattttttttcaaatattttctacaggaaacttgctttaaaaacctatctatatatctatctatactaatcgggcactttgaaagagctctcactttaatcagaaaactccgaccgttggttaaatgagccgtagcatcagaacaatgaattacaatctaataatctataacgctgttggctaattaagtctttaaacgtgatgccgtgatgggctcttttcaaagcccatatactctccaaccatgctcttttat

SEQ ID NO: 75846 - DNA, 7888 bp, Oryza sativa
ctcgaaaaagtagggggactcacacgcaagaaatcttgccaacttgttttggggaggtgggggtggattctggttttgattatttgcctgctgattctgtgcctgctgcactaacagattgatcagttgtgtttgttgagccaaaatctgagctagcgttgggttctcttcattgttattggctccacttccacttccacttccagtgccagtgcgcgtgttcaccatctgacgacaagcagagacaacaaggaaagaacgacagagagacacccttagaacggagttattcaattaatttaaattctatattgctcttaactgtgtatgattacatttaagttgcattaacactacctcaccaactttcttacactctgacaagcaaaagaactagactcatgctgttacatcccacccatgatgtaagcaacaactaaaacccacacactcacaaacaaacttaagcaagcaatctaacacagcgaactacggcaacgatctaactaagcgactaattccgccttgcgtcggaacgaagcgatgaatcttcttcctctggagtagctggctctctttcttcaggatcttcctcttcttcctcatcactaatgatgtcgatgacaggctcaacacgatcgggcacagcttcacccatcacgcgaatcttcgaagctaactggagacgagggggcggacaggttctctttcttgcagtgaggcgaagctaggatgttggcggcggcgtttctcctttaagttcagctaattccttctgtaggcggtacaccttgctcttcaacttgcaaatcttgcctcgattccagttttccctgtcatgagctgctttgtctcgctccacacttactgcatccatagcactaagcatatgcaccgcatgcatcagagtggcactctcttcaccatcaggacaggtataggttccatagtcttgaccatgaggcttgtggggatgatactggaaagctgatgaatccaattcttcttcaaagtgttgacgcaactctccaatggccaccaaagctgcttcttgacaagcatggcagtacgatcttcctccagcttcgaacttaaaagacggaaggtcttcactatcactagccaacgtcacacgaacacgacatttctcctcgtcggggtcatgggaaatctggcgatactcgggagcaacttcataacctacttcaaaagccatcaacctcagctccctgacgaatcctaacacctcgatcaaatttcttggtgaatggcgaggcatctaaagaaacatagaagagaagaattattgcatatttttctaagttagctgcaccaactagacttaactgattttgaccaaagaggaaggaattaaaagagaagacacatacaaaaaccattttataaatatattttttttagaatttaactttttggacagagacaagtatatttttttttgacaaataactaaaataaaactaaaatacttatgatctattataagcacggtacagtgtcaccataaggaagatgagtagtactagtgctaacatgattaaatcgataccataataaatgtacagtgccgactaatcaatgaaatttggtaaagagaaagaaagaaacattttgagaagagcaaccttttgcttttaaaagaaaagaaattgagtttcaataaattttgtgcataaccttgcatgtgctgccaacttaattaatttgtaagagaatagagaagagcagttctatttttttcaaaaatattttgaaggctacttaaggtttaccatttagcttatcctaaagtcaaggtggctctgataccaacttgtcacgcccagaatttctatccaaaattccaaacgcttacatgtgtgttaagccctcgtccaggaatcaaccgaggcacacaatgacaatattgataatagagtacaaatatttaactatggaatattcgaaaataataaattattacagaggtggatagttcctctcaaacaaaaataacattctacgcagcggaaaataaaactatggcaaactacggaacagcgatggcgactctactccgcaggcaacttaaccaagaacaggcctagtcctccagatcatcaccttcactgaagtactcctcttctgatgaatgaatattgcaagaatgagcatataacatactcaacaagccacacagcaaatatgcaagtgcacaggataacaaaggatggcataatatagctcatttgcagaaaacagcatttaataaatatttaagagaatagtaaaacagttgaataattaatcaatattaaataaacaccatacaacacacccgtgttgcataggcccaaccacatttgaacaaccaaccccaattgaacaaattaaacctccaaaccaggaattagccattccagaccaggaattaaatcaattacaccttttcaccaataatgagtagtgtgagactaatcacgaaaaacattgctcaactcacccataaccgcgggtacggctattcgaatagttttaaactctgatcagaggtgtaccactgtacccacaagacacaaccccacatcatgtcaccatgtgcctcagtaccaccacgatacctcggaaaggagtcgtgacaatacccctcgcataacacaattcaccacagtgcaccgtacctggatcataatcacccccttataaacaaggcatggactccccagcgacccccatggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgatttaccatcgtgagctaccattaaatgtaaccataattaataataataatgtaacatagtttataattaatcccctttagttagctaatgtttctaagcatagctaagcaaacttacatatagcatttagctgaaccaatccaatatataaggttcaagctaatcaatttattacccaaggtatcaaggaatagggcattcaatgcaaattggctataacaaaggagtaggttcacaccacccggtgacattcgaaaataaatgcacagttgaaataaatagagaatttaaatataggatcaacatgctcaaagggttgtggttaggatctgtgtgacttgccttgggcttccacaaacgcttcggaaccttcctcaacggaaacgctctcctccggaacgtcggaaactaaagcaaataaacaaaatcaacaaaacagtacaaaaacaagcataaacagtacatgtggatatttttaacatgtagatcttgattttagaaaagtttagaaacttgaaccacctaaaacggatctacggttatttagttatgattttccgaagttttaatctattagaaaatcgagaaaaaggaaaaagagagagagatgacgtcagccctaaggatgatgacgtcagcccttgcgatgacgtcggcatgacgtcagcacgacggccggctcgggtcgacgagctcgccggcgttagggaggttggcggcggaaacggagaccatctacacgtagaggacaacgagacgaacccgttggtactcaccacgacgagaaacgatgcacgacggcggccggcgacgagaaggaagacggcggcggctcgggtcgacggcgacgagcgagctccggtggtcggcggcaggaaagaaggggcggccgagcttccttgcaccacggcgcacctcttggcgatgacggcaagcgacggcgacggcggagacggcgcggcggcgttgccgaagacggccggcgacggcggcggacttggagagcgtcgcggcggcgctaggaggcacgggaggactcgggagagggggcaaacggaagaggagatcaaggggaagctttatatgagctcggattgaagagatcgagctccaaacgggaggaatcgaatcgggaagaaatcgaactcggttttagggataaaagcaaaacgaactcgattcggacccaatcctcaacgattctctttgattattgggggaaaagaaagaggagaacgagaggaacaaaacccctcaaaatcccaaaggaattgggctcggatttgggcggaatcggagcgggaagcggcggctagggttcgggctcgcgcggcggcggccggaggtcggggacggacttgacaggtgggccccacctgtcggcctccgtgagagaggggcgggcggcggcggcttgggccggcgtgggccgcgcgcggggagagagagaaaagggagagttgggccgaaaacggcccaacggcctaagagggggatttttgaactttttcgaataaaacaatttgtgaaatgttgtttcaattattaaaaatacttcccttactcaaataattcccagaaaattctagaacatagaggagcaagcatagtatttaataaaattttatctagctcatttttatgttgaaaattttcctagaaaattagggtttagcttgtaggcttttaaaataatttctaaaaattccaattaaaccacaatttatatatttaagatttttagggtgtgacatacacgaagccaaagaacttgctaaaaagacagagcatgaactaagggaccggattacccaactccaggattcaaactttgaactgagtggctcatcaaaaggtaacctcaagatctgccccattaatttgtgttgttataatcgtatcctcaactatctggaatcaaaacagtgcaagctgccaagatagctcaactggagaaacgaattcaggccttagaaagtgtcacgtcctgataaattcatcccaaaataaaaatcatcttctaaaaggaataatagaattaattaaaattcgaaaagaaattggcaaacactaaaatacgtacaagaaaaattcaaatatggcccggagaatttttgttaaattctccttggtctaaaaggagccctcaaattttagtggaattttcagagcacaaataataattgaaaagaaataaacaaagttgaaaaggtttataaaaagaaaatcctaaaagaagtcttttccccctcctcctcccttcttgggccggctcggcccattccctccctctctctctctctttccccccggcccatcggctcctcccccgtgcgcgcgccgctgacaggcgggcccgcccgccgctctcgctgacgggtggggcccacctgtcatcgccttcctcccgccgcgcccgccgcccgcccgtgccctagcgccgccgccgccgctgaatccgccgcatcccgctttccccgcgcgccttaatgaggggggaattactccccgcgtttccctctcccgattcccccccttttccctctctctctccctcggattcgtccggattcatcccgcgaagttcgccggcgtcttcaatggcggccgaaatccccgcggccggtttccttcctcctcggccgccttctctcccttccgacgctataaaatcgttgcccgagctccgctcttccgtttccgccgctcgccgctcgctctcgccgtcgatttcgtgcccgcgccgtgctccgctctctccgccatcgccgccgagctccgttccgccgccgccgccgctccggacttcctccttactcggcgacacctccgtccgcttcgccgagtggtcgccgaccccgtccgccgctccgcttcgcccgtcgaccgccggagcaccgtcgtcatcgtcatcccgagccgcgccgccgtcttcctccgctctgtccgccgtttccaccgccttcgccgtcttggggtgagccgtggaccgctccgttcgtttcccccttccctcctctctctcgggtgccgctccgccgcgccgttggtcgccggcggcgaccatcggggcgcgggcgcgccgctcccgtcggccgtgccggcgaggccgccttcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctcccccggctgacgcaataaataggattttttaattgaaaattaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttagtagtgtaaaagcccttttcttttccgttggtcgtgtagacgctgcagcttcggaagatccgcttttcgtggaagtcgaagccggcgtttgggaaagcgagcaaggcaagtcacatcatccttgagcatattgaaatcccagtttacaaaattattttaatttaaattaatgcattatcgctttatttaaattcccgcgttatcactgttttatttagccatgcctatttacctttgttatgaccttacttttattgttattgttattattaccttgttcaccctagaataaacaaaaccccaactagtgggtactctattcctggttccactagtatgaatttaggtagatgcttcgctgattaattaggcaaccttaggtggttttacaactttagactttgggaattctcatatcatttggacactatggaatggttggcttatgttggaattggacacacacctctcttcctctttcaaaacccctaaaacctgtttttggtggggtttgggtgcatgccagttgtgggaagtagcaccccggccactataaggattaagctcgggcctctgttgcaaagcactaccgtacttccacatgtctaatgggtaaggcttagtttgtggctcagtctaatcataaacaaaagtacacggattggagatggatgaagtcgggtgtcgatggacatactccaggacaaatgaaggctacacgagctgcggcccggtagtcgagatgtcatacggcagagggttggtgccctgctgctaggggctcagttctgcctgcctgtcccgggtatcccggccgtaggtgggattgggtcggtactcttgtttatggctaggatgggttgggaactatgtcacgtcttccgtccgtataccgtggtggtatgtggcacgtgtttgcacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttataaaatggctttgggcaactaagtgacttttaaatgctgtttactgcaaaccttaaaccctatattattatccccttgtactcctttgcattaattgtgcatctccggtgtggcttgctgagtactgtggttgtactcattcttgctcaatccttcccctcttcagtaagagaagctttggagaagatgtcttaggtggagtcctggcttataccc

SEQ ID NO: 75847 - DNA, 3126 bp, Oryza sativa
aaacgaactcgattcggacccaatcctcaacgattctctttgattcttgggggaaaagaaagaggagaacgagaggaacaaaacccctcaaaatcccaaaggaattgggctcggatttgggcgcaatcggagcgggaagcggcggctagggttcgggttcgcgcggcggcggccggaggtcggggacggacctgacaggtgggccccacctgtcggcctccgtgagagaggggcgggcggcggcggcttgggccggcgtgggccgcgcgtggggagagagagaaaagggagagttgggccgaaaacggcccaacggcctaagagggggatttttgaactttttcgaataaaacaatttgtgaaatgttgtttcaattattaaaaatacttcccttactcaaataattcccagaaaattctagaaaatagaggagcaagcatagtatttaataaaattttatctagctcatttttatgttgaaaattttcctagaaaattagggtttagcttgtaggcttttaaaataatttctaaaaattccaattaaaccacaatttatatatttaagatttttagggtgtgacaaacctaccccccttaaacagaatctcgtcctcgagattcagaagaactagcgaacagatgaggatgagctgacttcaattcatcttctcgctcccaagtggcttcttcttccgaatgattactccattgaaccttgcagaaccgtataacacgattcctggttttcctctcacttacttccaaaattctaactggcttctcaacataagttaaatcttcttgaagctctatacgatcaggatctgcttcctccgtaggtactcgtaaacatttcttcaactgagacacatggaacacgtcatgtattcccgccattgacggaggcaactctaactgataagctacttcacctcttcgactcacgatcttaaaaggtcctacaaaacgcggtgctaatttccctttggtttggaaacgatgaacacctcgtaacggcgtgacccgaaggtatacataatctccttcttcgaaaaccaaatctctgcgacgattgtcggcatagctcttctgacgcgactgggcaacgcgcaacctttcttggataatcttcactttttcttccgcctctcgcaatatgtcagtcccaaaaacttgacgttcaccggtttgatcccaaaggagcggcgtacggcactttcgaccatataatgcttcattcggagacatttgcaaactagcttgataactatggttatatgagaattccgcatacggcaaattcttatcccaacttccaccaaaatctagaacacaagctctcaacatatcttctaaaatttggtttactctttccgtctgaccatctgtttgagggtgataagcagtactgaaattcaaacgggtacccaattctgattgtaacttctgccaaaacttcgaagtaaactggcttcctctatctgacactatcttcttaggaacaccatgcaaacataccactctggccatgtataactctgcaagcttattccccgtgtaagttgttttgaccggtatgaaatgagcgactttggtcaacctatcaaccactacccaaatagaatcatgtcctgccgacgttctgggtagaccggttataaaatccattcctatttcttcccacttccactctggaatcttcaatggttgtaacagaccggctggcttctgatgttctgctttgacccgctgacatacatcacatagagccacatattctgctatctcacgtcgcatactggcccaccagaattgtagctttaagtcttgatacatcttagtgcttccagggtgaatggaatacaaagtttcatgtgcttctttcatgatagtatccttcaactccttattctctgggacacaaattctttctcctaaccacacagttccttgctcatcttctacaaaaccgatggctttaccccttctcatgttcttctttatttcctggatatcaggatcattcacttgagcttctctaacttgatcaaacagagtaggtttagcttctaatgcggccacaaaacctttactgactattcccaagttcaacttttcaaattcttggcacaactcccaaggtaaacgttgaccttctgacatattacagtagcttttcctgctaagagcatcggctacaacatttgccttccccgggtgataatggatttccatatcatagtctttaatcaactctaaccatcttcgctgacgcatattcaaatcaggttgagtgaaaatgtacttcaaacttttatgatccgtatatatttctgtacggttaccgaaaagataatgacgccaaatcttcaatgcatgcaccacagctgccaactctaggtcatgcgttgggtagttattctcatgaggacgcaattgcctagatgcataagcaaccacctttccttcttgcatcaacacacaacccaaaccgagtcgggatgcatcacaatacacttggaaacctttcctcgaatcaggcaaaattaacacaggcgcagtcactagccttttcttcagtacttggaaacttcgttcacaatcctccgtccacttgtacttcacttccttctgaagtagacgagtcattggtctggcgatctttgaaaagttctcaataaacctgcggtaatactgtcacgtcccaaaacgactctaaaatacatcctcgaaattatgcaaagaataagtaaaatccatgtgaaagcctccaacaattaaaatgtgcaaatgtaaaagtcaaataaggcttggaggatttttgtatatttcctaaaagcctaaaatgcgtaaataaattttagtggaattttcagagcacaaataataattgagaagaaataaacaaagttaaaaaggttttataaaaagaaaatccctaaaagaagtcctctttcccccccttcctctcttgggccggctcggcccaactctccctccctctctctcctctcccccgcggcccatcggccttcccccgcgcgcgcgccgctgacaggtgggcccgccccgccaccctcgctgacgggtggggacccacctgtcatcgcctacctcgcgcc

SEQ ID NO: 75848 - DNA, 719 bp, Oryza sativa
tgaggtgagagaggaaacaagccaggaaagaatagaccagaactagagacaggaccttaaaggaactaactcttcttattgatgtattgtttgttttgcttattctgcaagttgcttaagcaaacaacctagcatggttacatcacaccccactgatgcaaaccacgcgctacacacacaagcaaggaaacacacaactaacgactctaccctagagggcggcttaggttctgcgactggttctccaagatcttcactccttcttcacagctggcttcactgcttcctacacttcgctagcggatcctgcagtcttccggagcttcggcaaacaattggcgacatcttcttcttcgcaaagctgaccatctagtactagttgaaatttgaaggaagaaaagagtaaaccttttgcaaatagcattaggggaaggagaaaaagaggaactttcgcaaatagttttatttataaaatatgtccttaggttttatccacttggcttatcctacagtcgagatggctctgataccagcttgtcacgaccgggaaaattgccttttcccgaacgctagtgcattaatccccgtcccaggaaaagccggggtacaccacacaaacatgatataaaagacacatctttattatatcgataatatgtacattatcaccaaagcgccctaagcctgacaatcaaaaataaacagcagcgactagcggg

SEQ ID NO: 75849 - DNA, 11957 bp, Oryza sativa
taggccggtctgaccgccgtgtgttgggcggtcagaccgccggttgaaggccggtcagaccggcggtatgtggccggtctgaccgacaggcccgagtccgattctgttgcgtcgggtttcgaggtttccttgctttggaaggcatgtttcgggtttcctttggtttttaccccgagttggacatggagaagggcctgtagagggcaagaccaacccctatataagggacaaggctggttcattgttaaaatcaatctactatcaatcaatcgaatcattctttttatattgcttttagttttctcttagtttgtccatctttgtcggtttgcgccgtaaaccgtccgctaccgctgcgagagtgcgacatctctttgtaggtttgtcttgaaaaccttccgtttgcccacgagacgggtagttatctagaaatcggctccgctagccggtttagttatcaaaacccatctaggtttagctctttgctagatcgaggtggttggcgactttagaatcaccgcaaggcttaaggtgctacgatcgtgcttgtcaacttgtcaaaaaagttgccaacacgatttttggcgactccaatggggaagagatccgttcatcgtcaactcaacttcgacttcgccatgacgaagccatcatctaagacggaggtggagccatctcatgtgataccggtcacattagatgactttgaaggagaggatcgcaaagatgtccaggaatacatcaccgagctcacacgggaggcgttgatgaggttgactactaggactcgtcaaggcgtgatcatcaagcccgggccacgtcctaagctcgctcccgacgtggtaagtaatgacgaggtatcacaatctatcgaccaacaaattgcaaatacaatagattcatctatggctaattttaaagatagattagatgtgatgtttaaggaaaaagttgatgggtttttaaggagtaggctaggctcttttatggatgattacacattaaaagataaagcctataccactgctgatcaacctcctatagatccaatagggtccaaaaccaacggagcggcgttcgtgaccggttcgatcgggcctgacggccggtcagaccgcgacacagccgtcggtcagaccggccagacggccggtcagaccgggtattatgccgtcggtccgaccggccagatggccggtccgaccgggtattatcccaccggtcagaccggccctcaggctggtccgaccatgcaacatgacgccggtcagaccgggccctgggccggtcagaccggcgcaattgtgccgatacagggaattgatccaatgactaatgctagttattcgtaccactttagaacatttgatccccctgtatctactgccaccactagtcctcaaattcccccacatatccctaatgcctacaatgatgtttctagaggatatcctcccgatactagtcaaggccaatataatcatattgcgccacaaaccaaacctattaggccaccaaacccaccaccaaatccacaaggacctaataacatggagaacatgattagtgatattatgaggactaaattcgggatcgaaactaggaatcgtgataggccttacaaaaaaccatatccggattattatgataatgtgtcgttccctagaaattatagagttcccgaatttacaaaatttagtggtgaggatggtaagaccacatgggagcatataggtcaatttttagcgcaatgtggtgaggctaatagtgatacttttaaattgcgcttgttttctttatctttatccggtaatgcttttatatggtttacttctttaccggcaaattcaattcatacttgggctcaattagaggaacaatttcatgattatttctatactggagaaactgagcttaggttatgtgatttaacatcggttaagcaaaaattgtcacgaccggaattaacccaatgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacaacggaagactagggcgacgaccacaggcgcttgacgacaggcacgagctagacaccaaagccttcatcttccagggcctcctcttctgggtttgggaaaaattgagcaagactgagtacaaccactgtactcaacaagacacacccacaagtgcagaataaatgcaagggggtacaaggaagccataatatagggggttaggatttgcagtaaacagcattaaaagacacttagttgctcaaagttattttgtaaacatgatcctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggtttttaagaattaaaacgctaacttgggtacattgctcggcttgcccctaaccgagggcgcggctattcgaataggttttactctgatcagaggtgtacatctttacccataagacacgtcttcctcacgtgtaaccacgtgccacataccaccacggcatatggacggaagacatgacatagtttccaacccatcctagccatagacaagagtaccgacccaaccccacctacggccggaacccccgggacaggtaggcaggactgagcccctagcagcaggacaccggtactgtgccatgacatctcgactaccgggccgcagctcgtgtagccttcatttgtcctagagatgtccatcgaccgccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagtgggaggtgtgaatccaattccacaataatccaaccattccatagtgtccaggtgatatgaatattcccaaagtctagagttgtaaaaccacctaatgttgcctaattaattagcgaagcatctacctaaaatcatactagtggtaccatgagtagagtgtccactagttggggttttgtttattctagggtgaacaaggaaataataacaatagcaataataaggtcataacaaaggtaagtaggcatggctaaataaaacagtgataatgcgggaatttaagtaaagcgacaatgcaataatttaaatcaaaataactttataaactgggattcaatatgctcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaatttaaaaatggatttattgcgtcagccgggggagggggcgcgcggaccgggtccacgggagtgggacccacgcggcagtctcacggcccacggtggaccgggtgcacccggctcacaccggccggcgccgtgggccccacgcgtcagccgcacccgagggcgcgggcggctgacggccgggccccacgcggcagccgctaggcgtgcctgaagacggcctcggcggtgcggccggcgggaggtggcgcgcccgcgcccctatggtcgccggcggcggccataggcacggcggagcggcggccgagggaagggagggaaagggggaaacgaagcggcggtccacggctcaccccgggtcgacggtgacgatggaaacggcgaccggagcggaggaaggcggcggcgcggctcgggtggacggggtcgacggtgctccggcggtcggcgaccgaaacggagaggtggacgaggtcggtgaggatgcggcgaagccgaaggaggcggcgccgaggtgggaggtggtccggggcgacgacggcggtggaccggagctcggcggcgacggcggagagagagagcgacggcgcgagctcgattccggcgggggaagagggcggtgagtggcggaaacggcggtggggagctcggggagggtttatatagggttgggagtgagagagggcggccggaggagggggaaatgggcgcgggagacctggccgccattaatggcgccggcgaggttaggggagaggtttccaaatgaatccgagggagagagggagggaaaaatggggggaaagggggatgggatcccggggaataattccccccactttattgcgcgcggggacggcgggaggcggcgggattcgcggcggcggcggcgctagggcgcgggcgaggcggcgggagcggcaggaggaaggggatgacgggtgggccccacccgtcagcgaggttggtgggcgggcccgcccgtcagcggcgcgcgcgcagggagaggccggatgggccgcggggaggaggagggagagggagggagctgggccgaaccggcccaagagggagagggggagggaaaggggactttttagggtttttctttttataaaatcattttaactttgtttatttcttaataattattatttgtgctctgaaaattccagtaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgcgacaaaaatataataaatctgttgttgattatattaagagatttagagatgttagaaaccgatgttatactttgaatataactgatagagatttggccgggcttgcttttaatggttttgttgctcctcttagagagaaactagatggccaataatttcttgatgttagtcaacttatgcaaagggctctggctcaggaatgccgggttaaggataataaaaaatttgctagaccattcaacaaaaagcctaatgttaatgtagttgattactctgatgctagtgatagtgaagaggagggtgatcatgatatttatgttgccgaatggtcatggaccaacaaaaataaaccttttgtttgttctaatttaatgccgactcctcgtaaagatcggcaaagtgaagttaagtatagttttgatgtggccaagtgtgataagatttttgattatcttttacaagagaaacaaattagattacctaaaggccatgtcataccatcacaagaagagttaaaacgtcgggcatattgtaagtggcatgattctcattctcactctactaatgattgcaatgtgtttcaacgacaggttcaatcggccatagatgaaggacgattgaaattcaccgatggctccaagatgaagcttgatcatgatccttttccagtaaatacaattaatttcaataataagaaggtgttgattcggccggagcaagccgaatctactaagggaaaggaagtggtcattggtgagccaaggcctaagatgatggtgccaaagaagccggaggttggtgtttggaaggagaataagggtgaagcttcgacttctaaggctcctaggaaaaccaaagtgacctttgatatgcttttggagaagtatgagaagcaaggtggtgagaggaatcacgacaaatggaaaagaccaagatcacctcctaaggggcgatttggtcattcactaagacggttgcgttcacctccatactttcatccacaagacatgtcattgggttcttatccaatgccgccgccgggttattcttatccttacttcatgtcatggggggcaacgccgccaatgtacaaccatatgcctccaatgcaattcaaccaagggtggggacgaccacggaggccaatccatgagcgcttatcttcaccaaacaaaagccaattttatggtaaaaatcgggttaatgaagaaaagagggaaggaaagcgcaccaaggtggaggaaaggacttcggaggtgattactatcaaaataggatcccatgatgtgcctataccttctggagatggagttgaaaagtccccaaacaaaaaatccgaagccggtaccagctcatcgcagtcggccggtctgaccacggccatgtagccggtctgaccgggcaatcaggccggtctgaccgccgactagacagcggtccgaccgaggcttcaggccggtctgaccggcgcgtctggccggtctgaccggtggtctacgaccggtctgaccggtggtctacgaccggtctgactgggctccagcgccggtttgatgagagggctacaaagggcgatgtgagggtttcatcgtcttcgagcaaggttaatagaggacattatttacctcctggaacagagccaaatcctaggtggatgcctaaagatttaacggctacacaaaagagaaggttgcaacgtcttcggacccaagaactaagagagaaaaaggcgaaagaacaaagggataaaaagttcaatgagttgcgaccaccaccggtatggaggcctaagtccatagagaaggcaaaaccgattgatgttgaggagaaggaagaacaatcggttgacgaaggaaaatcgtctccataggaagacatggatatcaacatggtgtgtatgttgcctatggagttttgtgctatggatgaagccgaggttgctcaattctcattaggtcctaaagacacggttttttagaagcccgatgaatcaaaccgtcacatgaagcttctctacctcaaaggccatgttgatgggaagccggtctctaggatgctattggatataggtgctgctgtgaacttgatgtcgtactcgttattcaagaagttggggcacgaggatgatgagttgaagaagactaacatgattctcaatggcttcaacggttaaccaacggaggcgaggggtatcgtttcagcggagctcaccgtgggaaacaagacgctaccaaccgctttcttcatcgtcgatgtgcaaggtaactacaatgttattttgggtcgttgttcgattcatgccaattgttgtgtgccttctacctgcatcaatgtttaatccaatgggacggcgatgatgttgaaattgtgcaagcggatacatcggcagaggttgcgatggccgatgctacttttgagtggcgccatgggaatatctaatacttatcggggagggatttttctagctatgattttattagtatctccgatggcaaatttgtacctatctctgtaaagccggctagtgtagcacggctaagccatataaacttgtataatgagtaaagaggctagtttagagtggttaaaaaaagggtgcaagaatatcggtctacaaagaacgatattggagaaactgttagagattttgatgaggtagagaagcttggacaagggtttacatcggccgatccattagaggaagtagacataggtgatggaattaaaccaaggccgacttttgtaaacaaaaacatgaagccgattataaggttaaggtaatcgagttacttaaagagtatgttgattgctttgcatgggaataccatgagatgccgggtcttagccgtgagcttgttgagcctcggcttccaattaaaccgggttttaggccttataagcaaccacctcgtcgttttaatcctttattatatgaccgagtcaaagaagagattgatcggttattgaaggcggggtttattaggccatgtcgttatgcggagtgggtttctagcatagtcccggtggagaagaaggggagtggtaagattagagtttgcatagattttagagatttaaataaagctactcctaaagatgagtatcctatgcctatagccgacatgatgattaatgatgcctcgggtcataaggtgattagctttttagatggtaatgccggttacaatcaaatctttgtggcggaggaggatatgtacaagacggcttttaggtgcccgggatttgttggtttgtttgagtgggttgtcatgacttttaggttgaagaatgccggtgcaatatatcaaagggcaatgaatttgatcttccatgatttgctaggtattatcttagagatctatattgatgatattattgtcaaatcggatggtatggaaggccatatagccgatttgagattagcttttgagaggatgcgccggtatggtttgaagatgaacccacttaaatgtgcttttggtgtgtcggcggggaggttcttaggattcatggtgcatgagagaggagttgagattgatcctaagaagatagaaaaaattcatgatttcaaagcgccgacatgcaagaaagaggtccaaaagttgctaggtaaggtgaattatttgaggaggtttatttctaacctagcgggtaaaatcgatgcttttttttctatacttcgtttgaaaaaagaagccgatttcacttggggggcaaaacaacaagaggcgtttgaagagttgaagaagtatttatctactccacctgttgtgcgagcgcctaaagccggaaagccttttcggttatatattgcctccgaggacaaagtcattggtcccgttttgacgcaagaggaagatggcaaggaatatatcattacatatttgagccgccgtcttttggatgccgaaacaaggtatgtttttatagagagactttgtctatgcttatactatgcttgtaccaagttgaggcattatttgttgtctagtacatgcatagttacttgtcaagccgatgttattaaacacatgttgcaaaggccaattctaaatgggagaattggcaagtgggcatatgctttgatagaatatgatttgacttatgaatcattaaaaattataaagggccaaattgtatgtgattttatagtggaccatcatatagatgttgcttatgagggagaggtttgcttagttgaagttataccttggaagatttattttgatggttcttcttgcaaagaaggtcaaggcataggggtcgttttaatttcacctaatggcatgtgttatgaggtatcggttcgtttggaatattattgcacaaataatcaagccgaatacaatgctttattgttcggcttacaagtgatagggatgtttggagctaaatatgtggaggcctttggtgactcggaattggtggtgcaacaagtcgccggaatctacaaatgcttggatggatcactaaataggtacctcgattcatgtttagatattattgccaattttgataattttgctattagatatattgctaggtgtgataattctagagcaaatggcttggcgcaacaagcagaggttataatgtaaaaagggggttatttctgatattagaagagccggtgcttgattttaaatttttgtgcgaaattggcaaagttggggaccagaggcggtctgaccggcgttgcacggccggtctgaccggtgaccaggggcggtctgaccggccgcatgccgccggtctgaccggcgtccctgagaggtctgatcggccctgtgtggccggtctgaccggttctaggcagggtgctggagggcacgtttcaagtaattttgaggccgaattaattgtgaattcggacgtttgtgcccaagatacagaagaggattggagaattcctttgattcaatatttgaaagatcccacacataaggttgatcgaaagattcgacggcaagcattcaaatatacattgcttgatggagatttatatcgccgaaacatagatggtgtcttgttgaagtgcttagatgaagatcaatctaaagtggctaagggagaagtacatgaagaaatttgtggaactcgtcaatcggaccacaagatgaattggttgcttagaagagcggggttttattggccgaggatgattgatgattgcttcaaatatatatagggaatgcgaggcttgtcaacggttcggcaatgttcaattggcgcccgccgccgtattgaaccatataatcaaaccatggccgttccgaggatgggctttggatttcattggtcaaatttatccttcgtcatcaaaagggcataggttcgtgctagtcgctacggattacttcaccaagtgggccgaagccgtgtctttgaagaatatgactcatacggaggtaattgactttattttgaagcatattattcatagattcggtattccgcaaacattaactacggaccaaggtgcttcttttatgtctaaggaagtgaagagttttaccgaatcttatgatattaaattgttgagttcttcttcttactacgctcaggctaatggacaagccgagtcgagtaataagacattgttaaagctagtaaaaaagaagattgaggaacacctgaagaggtggcatgaggtgctttccgaagcgtagtgggcgcataggatatctaaacatggtgccactaaagtcactccttttgagttggtttatggttaagaagccgttttaccggtagaggtgaatcttggttctcttcgttatatcaagcaagatgatttgtcaagtgaagattacaagacattgatgggagacaaccttgatgaagttatcgacaagcgcttgaaggcgttggaagagatagagaaagagaagaagagggtggccaaggcgtacaacaagagggtgaaagcaaaattgtttcaagttggagacttggtttggaagacaattttgcctttgggtactcgatccaaggagttcggtaagtggtctcctagttggaaaggtccttattgagttagtggcattgttcgaggaaacgcatactttttggagacactacaaggggagcgttttcaacgagcaatcaatggaaaatacttgaagaaatacttcccgagtatttggcaagacgcttaggaggtactatggccggtaattggattatcgtcctaagaccaaaaacatgttctatgcttttagattcacgttgttcatcaaaaaggcaggggggcatgtgtttacacccaaatttggcacctaggcttaaaataggaaatattgccaaaatttggaagtctaccggtttccttggaggtaggccggtctgaccgccgtgtgttgggcggtcagaccggcggtatgtggccagtctgaccggtaggcccgagtccgattctgttgcgtcgggtttcgaggtttccttgctcgggaaagcatgtttcgggtttcctttggtttttaccccgagttggacgtggagaagggcctgtagaaggcaagaccaacccctatataagggacaaggctggttcattgtaaaaatcaatctactatcaatcaatcgaatcgttcttttcatattgcttttagttttctcttagtttgtccatctttgttggtttgcgccataaaccgtccgctgccgctgcgagagtgcgacatctctttgtaggtttgtcttgaaaaccttccgtttgcctacgagacgggtagttatctagaaatcggctccgctagccggtttagttattaaaacccatctagatttagctctttgctagatcgaggtggttggcgactcttggatcaccgcaaagcttaagggtgctatgatcgtgc

SEQ ID NO: 75850 - DNA, 13329 bp, Oryza sativa
  unsure (1)..(13329): unsure at all n locations
ctttcggcttaagaaacgcaggagcaactttcgccaggctggtgtacaaggtccttggcaagcagttggggcggaatatggaagcttacatcgacgacatcgtcgtaaaaagtcgcaaggctttcgaccatgcgatcgacctgcagaagacattcgacagcttgcgcacagcaggcataaggctgaatccggagaagtgcgttttcggcgtccgcgcagacaagttgttgggtttccttgtttttgaaagaggcatcgaggcgaatcccgagaaaatcgatgccatccagcaaatgaagcctccgtcaagcgtacatgaagtacaaaagcttgcaggctgaattgcagcacttagtcgattcctctcaaaggcagccgaaagaggtttgcccttcttgaagaccctccggggcgcaggaaagtttaattggacaccagagtgccaagcagcattcgacgagctaaagcaacacttgcaaagcccgccagctctgataagcccacccctaggaagcgaactgctattatacttagcagcttcgccggtggcagtcagtgctgccctcgtccaagaaacaaagttcggacaaaaaccggtctacttcgtctccgaagcactgcaaggagcgaagacaaggtacattgaaatggaaaagctcgcttacgccctagtgatggcttcgcgcaagcttaagcactacttccaggcccacaaagtcatagtgccatcacagtaccccttgggcgaaatactccgaggcaaggaagtcactggccggctcagcaagtgggcggcagagctatccctgttcgacttacattttgttgcacgctccgccatcaagtctcaagtgctagtcgacttcgtagctgaatggacaccggtacttgcccccgaccccgagcccgccgaacaattctgggtgatgtgctctgacggctcgtggtcgcacaagggagcaggcattgcggcagttctattttcgccgaatggtgtgccgattcggtacgtagcaagactgcagttcgacacaaccaacaatgcagcagaatacgaagccgttctcctgggcctaagaaaggcgaaagcactgggagtccggcgcctgctaattcgaactgactccaagttggtagcaggccatgttgacaaatcctttgaggcaaaagaagagggaatgaagaggtatctggaggctgttcggtccatggaaaaatgcttcaccggcataacggtcgaacacttgcctagagaccagaacgaggaagcagacgccttggcgaaatccgctgcttgtggtggcccacattcacctggcatctttttcgaagtcctacatgctccaagtgtgcccatggacagctccgaagtcatggcaatcgaccaggagaaactgggcgaagacccatatgactggcgaaccctatttgtgaaacaccttgaaactggctggcttccggtagacgaagcagaagcgaagcgtttgcaactcagagccatgaagtataagatggtctcgggtcagctttaccgctccggggtatttcaacccttacttcattgcatctcttttgccgaaggcgaagaaatggcaaaagagatacaccagggactatgtggtgcgcaccaggttgcaagaacagtggcctccaaagtatttagacaaggagtttattggcccactgtgttgaaagtctatgttgagcaaataaagaagtgcgaaagttgccagcatcatggccgaagccaagccgcgccccagtatgatttgcagcccattgcgccaatatggcccttcgccagatggggactggacatcatcgggccattcccggtggcgcgaaacgggtataaattcacaattgtagctgtggaatatttctctcgatggattgaagccgaaccccttggggcaatcacttcggcagcagtacagaagtttgtatggaaaaacattgtttgccgtttcagagtgccaaaagagttcattactgacaacggcaagcagtttgactctgataagttcagagaaatgtgcgaagggcttaacctggaaatcaggtttgcgtcgatcgcacacccgcagtcaaatagggcagccgaacgtacaaatggcaagatcctagaagcactaaagaaaagactcgagggggcagcaaaaggcaaatggccagaggaattgctattggttctctgggccttcggacgacccccacaagaccaaccaagtttagtccgtttatgcttctttatgggatgaggcaatgaccccagcagagctaggggctaactcaccaaggtgatgttctctgggggcgaagagggacgcgaagtatcgctcgaactcttggaaggagtaagggtcgaggcgcttgagcacatgcacaagtacgccacaagcacttcggcaacttacaacaaaaaagctgatgcctggtcatctcatcctaaggaagaaggcgaacccagtagcggttggcaagcttgaatcaaagtgggaaggaccatacctcatcaaacacaagtccaggacgggatcttttcgcatagcgacactcggaggcgaggagttcgaccattcctagaacgccgcctctctcaagcgcttctatgtctagaatgggtggcacccaaattgccaaattgaaaaaatgtacatactgtcatgtaagcccttcggcactatgaaagcctttcggcaagaaaaaaaaagaagaaagagagaaaaaagaaaaaaaaactaaatgtagggctattattcaccatggaggcccgaaccagtataaaatctctttgtccgccttctttttatttttcgtgtgattgataatttgtggaaaaaccccaaggcaaacgcctgatcagcgaaaaaggccaggggggcgaaatgaatcggccgaagcattgctcgccgaacgttgaaaccgcaacagcttgtctcggaaaataaatagccgaacgatcagcataaaagcaaaagcgtttctctcgacacagaacgctacagatcgaaaacgaacgacgaaaagctaaaaagtcagtacacctatttcgctaatatatgcaaaggggccagcatgttctgacctaacaaaagcacaaaatgtgacgatgcaaacaatagcgaaaaggaaataaaacacgtctttattaacttcgaaaaaaataatcgaagaatagaagtttcacaacacgatacaattcaccttacaagtaaattacatctttgtccccataatcactatccctccctaaggaatgatcaggcgaactaggttcatcatcactactaataccgtacacaaccttaagaggagtagggggcgaaacacagactaaactgtaacgacgctgaaagatcgtttcctggcgtttagtcttctgatggtttcgccaaaagcgagccatatcctccaaatgtcttgaatgaacaagatcgtaatcttctaaggttcgcccggggtgcgcccgcagccagtcggcaaccttgaaagccttatagttgcgaccgtttatctccatttcgcgataaacaggccgaaatggacatcgcactttcggcagacccttcactgccacaaatttctcgttttgacttcgccagctcccggaagagggccggatgcacgactttcggcgaaccccctgatggacagtgcagaaaaagcaaaacacagcttacatagtaagaataggcggaagaagggggaggtatggcataatgcgagatgagcgaaataataatatgccaaagacttcgatcatcaaaaagtaattaagattgtcatatattccaaatgtacaaaaaagcctttttttaaggtttggcggtagcctgccgaatgtacatcattcgcctctccaggcaaacgcaaaagagggaggaaaactacaaaaatctaaggaaagggcagagggcctcacacctctaggtgatcctgggcagcgcctccaacctcttcgcccaccgcgccctcttcttcgcaccgatctgccgcctccgccttcgccagttgctccagaaggcgcgccttggcagcggaccggccgtctttctgccagaactgttttcgccacgcgcgaagagcgggcgaaatgttctgcgcactaatctcccagtcccccttcgcataggtagggaactcggcaatgtgctcgcagccgaactgctgcaaaaggcctaaggtgaaggccgccgatacacgtgcacagcaatcgccgtacacggtggcgcagtccgaaaccaatccgccagcctgctgggtccactcggagaagtcgaaggctgaggcatcctcggcagggacccctcgcaccttcgtgcctatgtcggtaagggcgaggcggagcgtttggcaagccattctcgcggattcggtggtcttcgccatctcccgcgaaaaccgctgcgactcctccgtggcgctcgcttcggccctgctagccttctggcgaagagcctccatcttcggctcagtaaggttgtagtaatcgatgagcaccgccgaatgggccttctccttctccagttcggccttgaggcgatcaacctcggccctggcctctttccccttatctaattcggactgaaggcgtttgacttcagtcttcgcctccttgaaggtgtgggccagggcctccacctccaagttcttgcggcttatttcatcatccttggcccaaagacggtttttgaaaccgtcaaaacgggcccgcacggttcgctccatcgaacagtgagccgcaagaatctagatgaaagataggagcaggcgaaaagaacaaaaggttaattgtgagacgtaaaaaaaagagggaagaggaaaacgaagaaggaagaaaaggcatactcgaaccgccaaacttttaatggtggaacacccctcgtcgaactcattaagttcggtgaacaggctcggggtgccggcaggcaagacaaggttgctcacaccctccacaaagggaataaggtccgcccgagtctcgaaatcaccaggggtaaagtggggcgccgcaagggaatactccgaggcagatgcttcggcggccgcacacttccccttcgccttgaccagcggcgaaatagctggctcacgcatagggctcccgaaaaccatcgccgcggccgacacgatccgtttggcggaggcggaagccctggcggcggcactaccgcctgcaccagcaacgccgagcggagcaaggggagcagtcgagaggtccaaactgcggccagcaggcgaggtcggagtctcgtcagaagactcatcgtcgctgaaaacgcgggcgatgtcgacgagtcctttctttttggagatcttcttcaccggacctcccttcgccaccgtgcccgaggagaacgcaactagagccttcgctccttccaaatccttccgtcgaacgggggagctgttcgactccaccccagtctcgttgtgaccgggacttggggtaggagtgtagctaggggtgtcgacgcggtcttcgatcgcctcgttcacggccttatcggccatggcctcctcctcttcctcctcctcgccgtcgcgttcttcggcatcgtcctcgtcgtcggcgtcggagtccgacgaagcaggaacccttcgcttcctaggggcaagcttcacttgtccgcgcattcgttttcacgaaggccctacatcgtcgtcagctttgtgggtgtttacccgaggaggcaattcgccgttgtaaacccggttcgcccgtccagccgcttgtcgtgttaacaactggctatactcgacgaccgacacgtcgccgatcatcctacgggcctcgttttcagcctggtcgagggtcaacgctgcaaaagtgtgtagatatgttaacagtcagacaaggcaagataacaaagcacaacagtgtatagcaagagaacagtcttactgttcatcccctcaggaagaaccaggtttggcaaaccgtcaacctcttcgccttgatcaactctgacttgccatgactgggagaggggaaagatacgaagcatacagaattcctccaccaagtcaaggcagctaaggcgggagcaaaccttccacagaagaacgaaccgcgcctccatagcgccgtccacggcgatcttgggtttctggttaggcgcgatcgccctacgtcggcaatagagggctttcgccgagtcagtgccagcctcaaaggggatggtgtgatagaaccacctagccatccattggcggtcccacttcgacatgccagcgttcaccggccagagatcggaccgctcgggacgaacgttaaagttcacgctcccgaacactgtcttcttcgtcccagccggggtaatcaccttcttcgagttcacggtgacgaaaaatatggcgccgaagagctcggcgttaggctcaaacccggaagtccggcacgcccagtcgaagatagcgatctaaacaagcgccgacggactcagctgtggaagttccacctggaagaggcgaaggatctccggcaacaacacgttgcagggaaaccgtagccctgcctcaaaaaagacggcgaataccaccgtccgattgtcgataggtttcggcaccacggctttccctggggcgaaagcctgccccgcgaccaacgccccagagctgaccagcttcgccagctcgacgtcgtctacaagagagacccccaaaaaggcggtgctgtcgtcatcgactcggccgggatccggccctttcgccgaagcagggtttggcttgcgagaggccatggtgaatggtgcgtttgcggtggcgaagaaaaagaatgggcgaaacgcttgaggggtcgagagatgctgtggaagaaagagacggaggaagagagcgcacgcggtaaaatggcaagtgtggcggtgaaaaggaaagagcggtgggaatatatagctcacccgggcgaccgttcgcctacccaccaataataaagcgccacgtgtcgcaagggtaggcgaaacggtaaattcccaccgaccgagcggcacagtcaaaagcccacgaagggaaagcccaatactgttcggttcggcccgggaaaagaaaataataataaccaccaatcgcaggaggcgaagtgcggcaaaataataatagccgcacaagtaacaaacttcattcgcaggaataatataggtttcagcaggagcatcggtcaaaagggggtgccgcataccataccacatggtttgcacggtctcggccaaagctccaatctcacccttgcccgtgaggggcttgttggcggatggcatgaggcccttcgaccaaatctgccgaaacccgtggcgaaggctatggagcaagaacggcgtgaggcgaagagtcgtacgagtgccttgccaggccagaggcgtctcaggcgaagggttcaaggcaaagactatctgccgaaggaagacgacttcgccatggcaagttcgccctcgcgagggccgaagaagcctttccggcccatcaagcctaggggctatagggccggcgatcaccagacggcccatcaggggcccatgagcccctataacattatgtacccctgtaaatgtccctttcgttaggataatcatgtaaattcccctgtataacctaaaccctagtagtaagaacctgtaatggggctataaatagtcccctagggccatgtaatggggggagaaaaaaaggaagaaattcaagattcaatacacttcgtttccttccaaccactgttgagtaaccacgtctttcgacgtatgcagttgtcatttcgataacacttaaccataaactttgtttcaaataattcgtggtactgccattgctctgctttgtacatttgagaacttagcacttgttgcacccaagtactttcatcacgtgcaccttgttggtatcgctgattttgagcgccactcatacctgtcattgcaaacacaaaaacaataacaaacaatgaaggttatccctaataatctgctacgcggtgtagtggtgcccctcaacaactcagccaaatggagcaccttaccaagctcttacaagtgtcttaccagcaatgctgaggacggtacaaccggtggctggttcgtgacaccttgaaggacgtgatgtggcgattgcaaggatcaaagcggtgctgaccagaagtatatatgtgtagcttgggaggcacaatatatagtagcaaaaaaacgcaattgtgttaatcagaaaatgcaaagttgaataatagttcaaagtactagtcaatgtgctggcctagcctagactcaactctagctcaagcaagcacccgacaccactaaagactagatatgaatcaatgcacaactctgcactcagataacatactcaaaggatgaatgatttttttttctttcttggtgcggctttttttaagcacctttctgccttcttttttctttttttaggtgtggcttttttctcttttttttctttgcacctttctgccttttctttctttctttattcttttttttactttttttttcaataaaaactgaccactgacctcgaatagggactcaaatgtaaatatgaatattacagggactcaaacgcaaagtgcaaaactaaaattggatcatctcaaaaatggattgctcatatcatgtaggttccgtttttataaaaatatctcaaatccgctacttaacaattctataaagagggaaatacggacagctacggatagatctgatacggagtctctcctcatgcgcacacagtactccccacacgcgcacagtacacatgcacagtacggcaactctaaaaccatttgataaaaatttctccaaatcacaaaaacggaaacccgacgacgagacgattcaatttttcaagatcccggcaacaactaacgagatgaaaaactgaacccaaaactgacgtacaactcacacacttgagtgatgtaccctagacctaagtgatgaacagatgcaatactcaaaactaaaaattaaatctaaaactaaaccagtactcgacacgacgatgcaacctagaattcaacaaagtttagagtcgggttcttgacggaataatctaagcaaaacccgactctaaacgatgacggctactgaataaatgtgattagggacgtcctagggttgccctagggtgcacaccctcttgggctaagcccacaacacaattacaaggcccaaaacccaagtcagattcggactggatgagatatatggcttgttttgtagattcccggcagctcggtaggaattttgacatgggaccaaaaccatctgaaagtagactccataagctttctaacaagtactcatgggccccaaaattccttctagatcagcggctaggtccgtttgaagttgatgctgtcacgaggcccgaatccgaatccaaaacgtgtggaactttatctcttgtcttctatggaccaaaagtgacgtggtgaaatgaaagaagacttggagaaggtcttgatatggtccccaatcaacttctttgatcatccatgaattctttacgctcggtctcttttccttcgcccaagcaagtacctctgcaaacaaaaacacataaaactcattgtgtagcaacgtttgttcaaatatatagcatgtaaatctaatgtagaacatatgcacctttggttgattaatacataaggtagtcatagttatatccgagctagttgtgtcctcatcaggcgagcgccatcttaccggtcccaccggctccgacgacgcccgccaccttcagcccccactcctcgccgccgacgtccgtcgcccacctggcgacctcatccgtcgccgcgacttcgacgtcggcgccgaaccgcggtggcggccgcctggtggtgatggacgtcgacgagcatctccggcggctgctccgcctgctcgtaggatggtggcagaggccgtacctggtgcgccgccgccgctgtctcgcctcctgcgcgcgttcccggaacttggataccttgccggcgatgagtatggcgtcggcgttgtcggcggcggcgagggcgatctcgtccaagaagtcgtcgacgtcgtaggacagctcgcgcacctccttcatccagcacttgtccgccatggtcgtctcctccagctgcgacagcttgcggaggaatccatggctctcttcgatgtcgtctctgaacgagtggatcccgtcgtaggccgcttccatgtgaccaccatcaccagcctgtggcggcgaatcgagcttccggagaagagagcccatggcccccgtccaagcactgaaccccatctccatggctgcggctgcctgcctcaagcaaagcacaccaaaaatacgtgcgacgaaaggatacagataccgctggttggtttgacttcttcttacgaaacttttcagaatttaagttacgagaaaattcaagaaataccatcgacacaccaaaatccaatacatgtcatcaatgagtgcgagttatataaaatatcattgtacaagcgattttatactagaaatgtcatcgctgttagggttacatccatcccgcgtcgtttaatgcaccacttaaaaccctaacagtgattatatttctgggataaagtcgcttgtatgagaactcgtatttgttgatggtatttttttttgaaatttggtatttgtcaattgtatttcttgaatttttctttttataagttatcttatggtagatagtgtactactccctccgtcttaaaatatatcaacttttaacaattaggatttgttccaaaatatagcaacttctccatcaacattctcttcccaacaatcgcaaccctccaccattcacttttcctacctacctctccttctcaaccgatcacaactcctttttatttagttctacctactttctttgtccaactctataaactttttatattctaggcggagggagcagttgaaagcgaagcgcttaggatgactttataacaaactatgtcagctcagcccaatatcttgtgcttcctccgtcaaaaaaaagacgaaccctggatttctgtgtccaacgtttaactgtccgtcttatatgaatttttttataattagtattttcattgttgttagatgataaaacatgattaagagcaagtacaatagcaagctattagccagctgtaaacatattttaataagataaaggatgagagagaagagcagcaggctacatatctgtaggtagctgcagcgcggactccaagacaagatgtgtgtatgacaggtgggaccatatattaatagtatagtaagtaccttttgtatgaattgactattagattggctatagatatattggagctaatagtgggctatactattaaacttgctctcatactttatgcgtgacttgtctttttaattttttccatatttttttcaaataagacggacgatcaaacattggatacggaaactcagggtttgtctttttttggacgggggagtacgtgttttcctaacttttctacgattaaaggtcagggtgagcatctatatttttgctgatttttcgttaannnaataaancntnaattnaatttttttcttgagagcaaatactagctagttcaacaaaggtttccgtaattaagcttattataacaccttcccaaaaaaagaaaagcttattatcacaccttactgtcacaactcaacagcactcaactattgtaaaaaaaatccctatgtcgctaacaacagcaaccggtatattcatatatcgtaagacacacggcgcacacatcggtacatcaaataattaggaatatttgtcaacatacaagacgaatatattaagaagccagaagattgagatagcaccacacaacaagctaccggctctaacaacaacaacgtctaattatttttctttcttgcgtgtgtcgacactttgctcagaacccagacactttcttttgcataatataatctcgatcacattatatatcaaagaaacgagttgtgctgtgtacatccgttgtgaaagtagaggccggattttaatccattttctgaaaaaaaattgaaagaaacgagttattactcagtcttaattaattattttttttttgggatttgtaatccagctactacgcgtcttggcgaactcaaggagctcaaaggcgaagcggactacgttcatttgtggatagcatagctgaaggacgaactttgcactgctacacaaaaagattttactggacgccggctccgtttggttccaggtgggccataagtcgcgccgcctagaaaaactggaggaccggctccgggccggcgcccgcacgggaagatgcattatctcgtgcgggcgtcttaacccaaccgcacaggataatgcgattatcccgtgcggttgaattaagaggcccgcacgggataatgcatcttcctgtgcaggccgtttaatccgactgcgtggcattttctgtctcctaaacttacaaaaattaggggggtttcgacctgacatgatccatataaaaggtgtaatgcttgttcaactccttcatttgcttctatttttgtcggttcttatcggtgcaatatgaagaaatttgcacttttataaatggagtagtgtaggcactttttgtgtattgtgtcatttttgagctaactagaaaaatgcctgtgcgttgcaacgggtgaaagctattttaatcttattattgttcactctgaaatcactactggagaaacgactattaacgaccagaaatttggtcgttaaaagtccaaatgtggtcgttaaaggtcattaacgactacagaagtgtggtcgtcagtggtcgttaaaggctttgtcgttaatagtattaacgtccgaccgatttttttccagtcgttaattttattaacgacggtgttcttctgccatcgttgttttcattaacgacggtgatatcctgccatagttaatctcattaacgaccgtgataatatgccatcgtttttcatttttcttttaacgaccgtgcttttccgtcgtcgctatttttattaacgaccgtgaaactataccattgttattttatagactaccgagaaactgtagcctcctaatttttttagtgaccatgataatgcatcatataattattcacgatggcataatgtgttaccattagcaatacatcaataacactcacggatcagtttaaacaaccacaccttgtaatatattgattcccacagttgtcctgtagcagccacgtgtttactcggtgcaaatacaaaataataatgttcactgcatccaactagataaattattcagacagcaccaacatgatgcctaattaa

SEQ ID NO: 75851 - DNA, 2048 bp, Oryza sativa
tatgtgccctggaagttcatggtgaactgctggcacaaatcctcccaagagtggaccgacgcgggtggcaagttcattagccaaccccgcgcctgacctttcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaatgctcgacagccggcaccgccaaccggggacacggggggctggcccccgtgcccggaccaaagtggcgctccggacgaggaagcgccctctgttgcgtgggcagcacgacgaccattgcgccggcgctcgacattgaggcgggcatccggccccccacgcacgtcttcttgggttggaggcgttgacgagggaatggcggacgaacggcgggtaacggccgctgctcgccgcgctctccgcctcgacgatgcggagccggtggtagcagcgccagaggccttggtgacggaggaccgcctgccggcgcctaggcgctgctgtgctgtcatgaccaagtcggccacatcatccagccaacgtcgggctggagtctctggatcggggacgacgggcgggtgacgcaggaacgcgcccgcagcctggagcgcgccctggggcgtgctgccatcgccatagacgaggaggcgacgctccccgtctcgcagtccttctccatcgcccgcaagcggcgaagtcgcggatctttcgaccctctcgagcgcctcctcccgctcaagacttcggcgagagggggacggtggagtacgagcccgacggcgcgggttctgctccccgtcgtcaccgctagcactcggagagaggttatgcgccatcgcccgttcggccattgggctgagcgggtgaagcttggcgcacacgaaagaggacgagggcttagaaagacacacgcgccccctacctggcgcgccagatgatggagcgtggggctcctcaccgggaggccgcgcaggcccccctttgccggttcggccgggggcgctagtgaggttctttgccctcgatctgtggaatattcgcgagagagcaaatgcacaagacacgggcgatgtagacaggttcgggccgctgagaagcgtaataccctactcctgtgttctagtggatctgtgtgtgaaggaactacagaaagttggagagctaaagagttcaggtattctcagtgtcgcctgagagttcccctccttcggtgggcaaggtcctccttttatatctcaaggggataccacatgcaccacttctacctactcttcttttgggtggggacccaccctatcttgaccaaaacttggctcgcgccttcgcctggaagctaaatcacagcttgtccttgagtgaggcccagcgtcatcactcgcctgacacaggggatctccctgtcattccttcattaatgggtgaagatttgcaatggctgctgtccgaatgaccctccgatgggatgggtcatatctacctccactccgccggaagcagatgcaacgtgggagctcggttgtctgccgatgacgtgaccggcgtcagaccagtcacagaccggtcattcttgtccaccacgtgtcagtttagcacgccgcacgtctgcccttcttcatacaatgacttccttgcaatggttgcgatgaagcctggaatgtatctggccgggactgacgtgccaactccaggagttaacacgccggctccggctagggacgagagcatggaggctctcatcatttcgatgggacggggcgaggcgtgtgacaggccgcctgttgccacctaacccgcgatctgaccggtcacacactgcgaccggtcacggaccggataagcgtgcgctgcgctgcatcaaatgcgtcgtggcgcgctcgtctaaaccgcaataaatgcggttaggtgagccccgctgtgctcacctaacctacacacgtggcgccaaaatcacagggggt

SEQ ID NO: 75852 - DNA, 771 bp, Oryza sativa
atccaaaagtttataattgcagaaactttatacttacaaacattctgctttaaacactttatacttcgaaacattataaacacaagaaattagcaggggatggaaacaaaacatgttaattaaaaaaaaaacctatcgggcgattagtaagtttatacaccttgcttggtttaattgatccatggtatcggatagaataccagttaaagagaaacagggaaatagactagtaaaatcattatcacaaaaaaaagtataccttcattttgtttattgcagaatctgaagactgttgtacttcaactctgttactttcagattctgccgagctgttatctttgcctgcagagtgctcaccagtggcatccttgcttggaacataatttgaaattgaacaatttgccttgctacagtccgaatcttcacgagaactaataccatgttcctcaaaatcatccatactgcccgagtcacgtaatggaattttttatctgcgcaacagttacatagacaccttgagctcctgaccaactgatttattagaaatcattgatacaagcagatagtggcaaaggaaatcaaaaaggttatgcaaaaaagcgaaacaatggaattcagaaaagcgcaaaaaaaagatactattcatccaggagattttattctgtccaagatgtctgttctctatgtgatgaaggtactctctccaccccttggttttcagacacatgtatgaagcatttttggtgacttggtgtactgagaattttttat

SEQ ID NO: 75853 - DNA, 675 bp, Oryza sativa
tcctgcagcccttacctcctgaagatcaaatgctgacatgtaatccggacgtcctgactgtaagtgccactatgtttgtttagtatttggttgaatatgaagtttgtgctgctttgtggggtctgatggaaaatccccctttctgcgtcagatggacataactgatgacatggagtttttgtgatagcaactgaaggcctctggtaaattttgaacaaaaaataactgacaataattattatttgatcattttgatgtcactagtactctttgtgatgctgttttctttctcctgctgatgcatatatagtttcatttatagttgcatacctactgtactatgttttttccatgcaggtgcaacatgacaaatcaaaatgtggttgatcacacacatgaccgtcttttggtgagtccttttcttttgctcagtttgtcttcttggcaggacaagagatctcctactgtaatagcaaaaatattttgtgtcaaattctaggaaatgacttcactcaggcaatataaagcatccgattttttaaaaaagaaaaaaacaagtgctaataagtacactgtcatctgctttgtgattgttcgattcttttgttgttaaaactgctgttccttttgccttgatcaatattgctgggactaatatcttgcatgtttacgtca

SEQ ID NO: 75854 - DNA, 522 bp, Oryza sativa
aactgaagatttatagtgcagtaagttttttttttctttgagtaacaagtttatagggcagtattacttgcactgtgccaaaacttgcctttctttcggagattttctagaaaaaaaatattatgggtacagcataaaaactgcagagaaaacaccctttgtttcgaatatagtgattacctacgtttagaactgtacattgtcccgtgtaagaggaaactactccctccttctctaaatgtttgacgatgttgacttttttaaacatgtttgaccatttgccttattcaaaaaattttgtgaaatatgtaaaactatatgtatacataaaagtatatttaacaatgaatcaaatggtaggaaaagaattaatagttgcttaaaatatttgaataaaacgaacagtcaaacatgtttaaaaaaatcaacggcgtcaaacatttagagatggagggagcatatgtcagagactctcctctcttttccatctctctccaagctcgccgagcgtgaggtagagct

SEQ ID NO: 75855 - DNA, 6090 bp, Oryza sativa
tccgccaaagggaaacccgaagaagtttctttcagcttgattcttgcattggcctattcaaataatacaaataattatggtgggtaactgaaaatcaaatgacataattacataaaaggcagtgattacacaaacaaatcagggagatgattcaaaataaactcctcctgtaagacaggcatattccacaggttatcatgacccaaggcataatagatgatttctctaataatgtttggcagtacaaccagcattagtacaatcgataattcaatatagattaagcccaccagctgtcaatctatggctgacagggcaacccaataggcctaacatacccatcacacagtttaataaatatatataaattttctaatacgccacatagtttatgtaatggagattaccatggtcacctccaagaaaacaaattggtatcatcttgatctgtttattggttgcatctcaagagaaaaaaaaagaaacaatatttactaataaaccacggaagttacaactacaatgaaatcaatatatggatttatcatatttgacatggataggatataattgcaatgtagaacagagaatatacttttgagaatacctacttcacatgaataaacaactttcatccaggtaaaactaaaaggcagtttgaaaaagaaccacgcacaattgtcactatatgagaataaataagattgaccgaccttatgactataaatgtctgatgaagccacaccaatttcggaaggatcatgacttctttggttcactaactgttgagtacttttggcaccagtttctctttgctgctcaaattccctgtggtaagaaagcattaataagagtcggaaccaataattcaaaataatctcattgttgcatagtaactcaacctgaagccagttttagttgtaaggagttgtgctgtgacctgcagtggtacttgttaaagaataacttaaaggaaaatcagaaggcaataaaaacaaggggcaattgcgtttttgaccctattttaaggtctaactaccaatttgaccctactttcttaagtttgctctttggaccctcttttttgaaaatgaacgttacgtctggccctattccgttaagccaacataacggtgttaattcagagaaaaatggcttttatgccctcactcatttgactcaactttttcaaagtttttgcttgtctaatttcgtgtatttttatctaaaaatgtgatattttttttattacgataagtgacaaatttaacttaggtttgagggatttgacgagtttttaatagatttaactttttttttgacaaaattcacttagatttcacttaatccctccagcaccaacagcatgcagtcctcctgaccggctccgtctacctccagccaggcaagaacaaagagaggccagagagaaacggagagcagcagcaacagcaaaaacaaagcagcagccaaacacctgctggcgagctcccgcaccatcctcgacccgcgccgcgcgcctgcttcggcgccccgcggcggcggcgagctcccgcgccgcgcgcctccctcgcgcccggcggcggcgagctcctgcgcctcccttcttccatgcggagcactgctgtgctgccctctgctcaccggcgccgagagagatggggttgaggcgaatggatagggttgagtcctcaagggtatttttgtccgtttgaataataatttgaattttttttcttttcctaaatgaaaccctaacggtataatagaaatagggtcagacggcagcttcattttttaaaagcaaggtcaaatgagcaaactaaaaaaagtagggtcagattggtagttaggctctgaaatagggtcaaataagcaattgtccctaaaaacaaagaactgttaagatcactttctcaacaacatcagactagattatgataatactgtgttaaaaccatacatgtaatattgtcccaaattcacaaccacgaagaggaagtgctattgagacaggcttcagtgcttctgcaaattcggcaagattcacgtcaagctctccaagaatactagatcgagaagtaccctggtttttcaagaaacagcgaaaaagggtaaacattacttaatgaatcatgtgtccgatgtgcttatgtttgatagatgatgatataggagaagggaaaacaatgtctagaacacaccatggccacgacaatcttatagagtttgtcatcatatgtcttggtcctagaatcctgaagaagccgtgttgcttcatatatagggtctggccatttgcaacttccattcctcacatttgctttatttgtctttgcagatacctttcccgtatcagcagaaatgaaggacaaaaatagcttgtcccaccctgttgatggaatctacaaaagaaacaagaacacatgtcaagattattcaagcatggatgaaacaaatattgaacaaacaccaagaaagaacataaatgacttcaacaaaaatgtattgcaacttacatttgtagcgtggaattgtagccggaagactaccttgactttcgctttttcgatcttccatttaggtacccttgacattgtgccagtatcaaggcaattcccagaaaggggaaactttataatttaaacatatctcagttctagaagggtcagatttcttttccctgcaaagcaaacagcaaagaataaataaagtccttaaacaacattcatgcaaaaacaaatgtgaaaatgaacttttcatgcaggtgaggtcgtgaggtacaaaaggaaaaatactggactttggtcctgcttcatataagttacacttcccacaatgggattgatcctataatagctttcaaaaacatcaatgcacccaactatcattaaagcatatctaatttcctaatgaaggcaaaagatatgcacagatacatataagttcacaaatatccattatcccgtgtaacaaggaattttcatggctataatgtatagctggttcagcggcatagaaaccagtaggcaataatgctatatcccacaaaggagatgaagtgataattgctgttcaggaaggggagggggcacatattcctctgcaacaaacctttttgttgagttcgcaaatgaaactgatacaaggttcagtataatggaaatatatcctggaagaactcagataacagaaatacaagcacgacacactgttgcatgtgctaccgaattcgctaaagggatcattcatacttaatcaacaatttaacacacctcatacaatgtacaaggctaccagtttctaaaacgtaaaaaaatagtgaaaaaatggcacatgtaaggacagactgacaaaaaaattaactttttagctagttagtgacttagttcagatccaataaaaagcagaagagacacaagcataaataagattccacaattatctgcaaagttcccactttccacaaaacagaatcctaacactacgctacccataaagagtctaaatgcaagaattctaaaaggctgcattcaaaaaaaaaacaatctaccattctgcttcccacggaagtaaacaaaatctcagcattacctccaaaaggcctccatctttccactaaagattaatacggtaccatatccaaaggccccatgaataatagaggccatcagcactgtacaaacaaccaaccaaaagcatatccaactaaccgaaaaggctctgaaatttaatcaagaagcaaaccccagccaactcagatccaccagaccctctaaaaaaagctccaataccttgcgatttaccagcaaagacccgcacccgcgcaccaagtacaagatttaatgctaaaaacgtataatgcaccgcaatcaaaccccctgatccacttaaggacgtagctgaccgaagattgagctgttagtacagggaaatttcatcagcattggcaagatttcaccacaaagttcacaagacttggccccagacatctataattaagagtagctaagctccttcgctgtaaatcaagatccccaagaacatccaccagcattggctgaacaatcccaaaaggaaaaaagaaaaaacaatcacaccaactaaagcaccgaatctaaccactaacaacaaccccatgacccccacacaaattgagaaggccgtaaaattagtccaaaaaacttgcacctttctgcactaaacagtttcacccccaacaactcccaagtagtacgcatacatctgtaaccaaaattcacttccttgatgcaaaatgctctggtatatatatttcactgattaaatcgattaaatgcagtcagatccatccaaaaaaaaaacccgggcttgcgcgaaaattccccggagacggcgaaccgtggggtggaaagaatcaagatttgggcgggaatctccccggatctactaaagtaaaggagggatcgagcgctactgttcatccattcctctccccttatcccctcctccccccattgcaagaatccccacgagcagcagcagcagcaacaacaacaacaacaacaatccggggggagaaggagaagtgccccccaccccaccgacaccaccaccgggcaaaaggacggagatggcattgggcacgaacctctcgctccactgacgccgacgccgaactcgccggagagtggccccccgctccctctcctccgcgtccacgccgccgccgccgccgcagcggcagcggacaagaagacgtacggcggccgcggtcgccccacgcgtcgcgacgccgcacccgtgactccggcgaggaagagagagtggtggtgggctactggagcgggtgatctagctgcagctgcttgctgctgctgctgtagtagttgctagtgagagagagaagagaaagatgtagagagagaaagagtgaggagagagagagaggtgaggtgaggtggtttggggttttgattagggaggaaatgaacgagggaggggagggagctttgcttaccgggcagggaacgacacccgccacagcataatcatgcctgtttgtgtgtttggtcgcttatattaatcaattcattaccccaatcaacatttttctttcagtacatcccctaattaaggctttaatctattgagatatgatagactgatatgcattgttcttgggtttctaaccgctgcagttttttattgaatttctaactcattaaacagtctacattatcatctacattatgaaatctagaaaataaactagagtcagaaactagaaaaacctagcttctctatattctcagaagctagctactccctccgtttcaagttataagacgttttgaccagggtttataattccgacaggcccttccgtttcgagcactggcggaatttggaatttcgtgaaattcggtggaaaaccggtaaattccgaacaaatttcataaaccaaaatttggatacaaattccctgagtttgccgacaagttctcgaaaaccgatcggttttggcgaaattccaatcgaaatcatcgaaatttcgatcagtaatttataatagaggtaatttactgaaattatttctttcctgatgtaagtttcagtaaatatacacaatacaacattttttttgaaaatctatatcccaatatgttctatgaatatcatagtatttataagattttatttgactttttttctttttttatcaattcaaatttgaatttggatgaaactccttgaaatctcagacggtttctactttcgagcctcgtcgaaatgttgaaatttcgcgaaatccgaccggatttcgtcggaatcgtaaaccctggttttgactgcttaaagtttgaccaagtttatagaaaaaagtagtaacattttcaacccaagaaaaacttattataaaaatatattcaattattgatttttatgacactatttagtattataaatattattatatttgtctataaacttagtcaaacttgaaccagttaccaaagtcaaaacgttttataacatgaaatagagatggagggagtatcaaacagggtgcttaagaaaaattaatgaagcaacccaaaagataaaaaa

SEQ ID NO: 75856 - DNA, 3434 bp, Oryza sativa
cgcggcgggcgcgaaggtcgccggcgacggcgacgccgctccgtgcggtcgcgcaagagagaaaagaagagaggctagggttcggtcggccggaggctggggtcggggttttgtccccccgatctcggcgcccggccgtcggatctaaaccctagccgatcggacggcgacggcggctgggccgaaagcggcccaagaggggcgcgcgcgcggcggtttcccagcccaggcccacgttgcggcctagggggtaaaaagggggagcgcccgcgcggggccgaccgggaaaagtccatttgaggtccctcgggggccgaaaataaagaaaagagaacagtagcaatttttcctttaaattttgttaattttcatgcaaatttcaatagaatttgaatagatttttgcatgttttacctctgtttaaatttgaaccaacgggagaatttttacagagagtaaattacagagttttgctactgttcatatgaattttatatagtttttccgttgcaaatagataaaattgatgaaaattagtgtttctaaaattaaatttcaaaccaacgggagaatttaattttaggaacattaattatgtgctatgatgttgtaattttctgaccaacgttgataattgcaatgttatagttatggttatatgtgttatgtctatttctgcccaacggtgatgtaggcttaatgcataatattttaatgttaattttgttctcaccgcacatgattatttcaggtggctactccttgatgggttgcattaaagatattctgaccctaaaaggagataactacgcagaatggaaaagaaaactcgaccttgcttttatcttgggagatgtggactgggtgttgactaccccatgtcctatagaacctgctgaacttattagaggtgaaaatgagtcagatgctgattggcaaaagagacagagggacaatgctcctctcgtcatgtcgtatgacattgaacaaaagaaatggtccttagccaacaagaaatgtttggctgtggtaaagaatacgattgagccaaccatattgggctcaatcccagagtgtgacgctgtctcagagtaccttgaaagaataaagagccagtttactggctcttcaaagacttatgctacacagctgatcaagcagcttgtgacagaaaggtaccatggaggtggtgttagagaccacatacttagaatgagcaacatggcttccaagttgaagccaatggatttgggcataacagatgactttctggtccatctggttatggcctcattgccaaagcaatttgacaattttattgtcaactacaacataagtccagagaaatggaactttgagaagctcattgccaattgtgtgcaagaggaggagagaatcaaagagtcaaatggttgttcaattaactatgttaaagataacaaaaaaaagaaccacaagtcgtctcccacctcaaaagctaaacagtctcagcatctgcctcagcaacaacagttcgctgttgagaaagatcagtgtctccactgcaagaagacaggacattacaagaaagactgtcctgacttcttgaaaatgatcatggcaaggaaaggtgagaacattattacatttgtaaatgaatctcattatattggttactctagatacacatggtggattgattctggagcaactattcatgcttgtaattgtttaaaggcattccgttcaacgaggactacgcaaagaagagaaagctccattagagttgccaatggagttgaagaaaaagttgaagctgttggagatcttcctctagagctcgcgaatggcttcacacttttacttcgagatgtcttttatgttccttcttagcaaagaaacttaataagtgtatcaaagttggattttgatggatatgattgccactttggaagtggcaaatgtgaactatggtataataatgcatgtattggtcttgttgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcacaggaattttagagatcattcatacagatatttgtggttcatttcctgtgaaaagtgtggatggctatgactcgttcataacattcacagatcattacttccgctatggttatatttatccaattaaagagcgatcagaagcattggataaatttaagatattcaaagctgaagttgaaaatcaacatgatataaagattaaagtagtaagatctaaccgtgggggggagtactatgtcgacatacaccttatgggcaagtccatggaccttttgcaaggttcttgctagagaatggaatagtagcccagtattcaacaccaggcgaacctcaacagaatggggtagctgaaaggcgcaaccgtacccttatggatatggtgcgcagcatgatgagctactccacactaccactgggtttatggatggaggcgttaaaaaccgccattcatattctcaatagagttccaagcaaatcgatgcccaaaacaccgtatgagctatggacaggaagagtaccctccctagctcacctccgtgtgtgggggagtcctgcagaggccaaagtatttaacccaaatattgggaagttggatcccaaaacagtcagctgccattttattggctatcctgaaagatcaaaaggctatcgtttctactgtccaaacagttatacaaagtttgtagaaacgagacatgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatacctgtcattgatgtaccagcacctgttgttacctctcctgtggcaacaatgaatgaaaatgaggaacctgttatacaggattcaacagaaatggttgccacaccagaggaggagctgcaacagcctcaaatagataatgtgccagtacaggagactcaacaagagcctcaggtacaggatgtgccaaatgtgcaggcccctagaaggtctgaaagagtcaaaagatcggctatccgtgatgactataaagtttataatatagaagagttgcatatggaggatgatcccacctcatatgaagaggccatgagaagcgctcgctcatctgaatggttggaagccatg

SEQ ID NO: 75857 - DNA, 2293 bp, Oryza sativa
ttagatgtatagaaatactatatatatagaaaatatttgaattcaaattcaaatttgaaacgggtatataaacttttgacttataaactttaggtctataaacttaggtgtataaactttagatgtatagaaatactatatatataaaaaatatttgaattcaaattcaaatttgaatcggatatataaacttttgatctctaaactttagatgtgtaaacttgatgtgtataaatttactaaaataagaaagtaatgcggtgccaaaaaagaaaaagggaggagggaggggatcgatcgctacccccgtctccagaggatcgatcgcccattagggtttatcgattacggacggaaccactcccattaacgttatcgttatcttgatctaaccaaacgccaccccagttgcaagctgctcctcacaccgatttctcccggccgcgtcaccaaccaacgtggcgtcgtcgatctcctccgcgcatccgccggacctccctcaccaatctgctctgtccgtgtcaccaacgacggccgcgtcaagtacttgcgccgccgacgccggatcggcgggaatcgtgctcgaatgggccaggggcaaacggcgccggccggctcttctcctcgtcctcccggtctagccaaaggtgccaccctaatcatctcctatgacggacaacggtgccacacctcctctgatccaagctgacttgacctgttgagattgccccaatgtcaccgccgtggtcactgctgggatgggaagcacgggtcacgacgcggaggtcacctgggccaacttcgacggctcgtctttggcgtcgccttcttcgtttatcaggtactgcttgccagcctcccactccctcccaattgccaaccgccttgcagcgcatagtatctgcttgctgcccttcgaaagtaggagtagtgttctgtacatgtatcgagttaagttagaaccttggctgctattttgcctcttgtagaaatttgatattataccattgcaaaaagggaaaaaagttggttttgctaaaactgtcattgtggagatgggtttcgctaaattatccttttcaaccggtgcatcattgctaaaatgctatctcggacgaaaataccctttaacttcttccaagcttctcccttgtttgctcgccggtgacgaccagaaaaggggtggcacgggatggaggcaacgagccggtgagcagtggcacgcacgatctgcgacgccggtttggctcaacgccaagccgccgtcgaccacgagtcccaccgccttgctatcccgcgcctcaccggatcgccggctcctacacaacgacctgctgcacactaccgcacgcatcctgacgaattcaccccaaacaccctgctcgactccgacatactcctccggcgctaccaagatttgcaaactagtacaagcgtgtatccatctcagggacagagaaagcaagcacaaccgttcttattgatcccactgtttacacccaaatttggcacctagagataaaataggagaaattgccaaaatttgaaagtctgctggttttcctctgtggggccgatctgaccgtcgtgtgtgggccggtcagaccgctggttgatggccggtcaaaccggcggtatgtggccggtctgatcggcaaagtccgagtccgggtctgtttcgccgggtcttgaagtttccttactcgggaaggcatgtttcaggtttcctctggattctatcccgagttggacgtggaggagggcttgtagagggcaagaccaacccctgtataagggatatggccggttcaattgtaactaaccaatctacaatcaatcgaatcatttttcatattgcttttagttttctcttagtttgtccatctttgtcgatttgtgccgtaaaccatccgctgacgctgcgagagtgcgacacctctttatagatttgtcctgaaaaccttccgttttgcccacgagacgggtagttacctagaaatcggcttcgctagccggtttagttatcaaaacctatcttggtctagtttttgctagattgaggtggttgacaactctaggatcaccacaaggcattaggtgttgtgatcgtggttgtcaacttgtcacaaaaagttaccaatacgattttttgacacctctttgtaggtttatcctgaaaaccttccatttttcccacgagacgggtagttacctagaaatcggcttcgctagccgtttagttattaaaacccatcttgatctagtttttgctagattgaggtggttggcgact

SEQ ID NO: 75858 - DNA, 9032 bp, Oryza sativa
tttttccagactttttaggtcattaaaatgcaaattaattttatttttttctactatggctactcatggagttgctattcgaaaattaatcaacttgtgtggactggttttcgttgcggttagagtgtaattgggaaatggttttgtttttacctactataatatgtgctttggattaagaaactgcgtatgctgccatgttgtccccctgggttacgtgtcattaatatgatgccatctccttttaccttcgttgtactgaaacatacagaacacttgttttggcaggtataatagtagattttctgttagcatatataggagtagtacactagatgcatgagaaaaagcaatatttttataaataccatattgttttgtcttctctgttgatttttgcaggacttctatggttggaattgatttcaggactccattcaaaaaatgtgtggcataaatggaatgatttatggtagttgcagagtcactaacaagtaacacccccccccccccccccgccgcggcccccctccttcaaatctgaacttgattggttgacatcgatgaggggagtacactttatttgtctttttagaatgattctttgctccttttttaaaagagtccaaatcagccaatccatatcatttgtatgaatccaatacagacgcatgaagtaaagttgtttagtgactcaccagcccaggttattttgagccccggaggatttgcactgtcattactttatatgtttagtacactatatattgatgaagaattggagactagatagttaatttacattctgacattaaacattgcatcacaacattgcaatgattttagtttccatacatgctacatttcacattgttaaatgccaggtcgatcaacacattggagaaataagaaatatatgtgacaatttgcgcttgaggcaagctcatttttgtacccatgtcattgttgcctgcagtagagtgacttcacatggacctaataggcaaaataagctgacaagacttatcatcttctgttggaaacatggaatattgagcaaatggcatgatacttctgttaccatgtttaaagacacttgcattacctctgttatgtaatcttgatgatgataactatttgtatattcatgttttggcaaaaacaagtcatcgttgtagtgtatgttttgatcaaaattgtggtgtatattttgcaaaaatatgtcactgtatcgattggtaatttgttgattatgtgtgctcattttaggttatatacgcactgttaattttattaagtacatttctgttcgagtggtgataactatgatttttatcaaaaccatcagaacccgtattatgccattatgttatgtccttctagtctgaactaactgatcaaaaaaaaaatcatatttgatattcatcacaagtatatctatcttgggcacgccctatttgaagtcacgtatatatgcttttcactttctgcgatgtctttttgatcgatcgcactaaacacattactcgcgcacgtgtcgcagctcgtgatcctttctacttacctgtcaagaccgcattctagagttatttgaagagagctacacagcatatcgagccaaacactctacacatcagctccaactccaactccaacataaagcggccttacaagttgcagttggagctggacccctgccataacatatattgaaccaaagggtaaggagaagaacaaaccaagcatacctagtaaaagaattagggtgtatttcgttgcaagccacactttgccacagtttgccatgcctaaagttaggcaaatttgacaggtgtttggttgtagccacagttgtggcaagattcccctccaataaattaggtcccacgtgtcaatggctcaaaaaagtgtggcaaggttctattaggcttagtagttgtggctaacaatttgatcacttcaccttagacaaagtgtggcaacttttattggcaagtaatggcaaagtatggccgagaaccaaaacatccccttactgctactcctggggagaaagtagtaaacagaaaaatagaaacagctgaatttcagagtagccagcatgcgacatttagaaaaacacatccaatatttcagtatcaacacaaacttaaaatgctgccatcagacctacaccagtgaccataataagagtcaaagttaattagtcgctgcctgctaatttgggctactcagttgcgcaagcatcatcattaatcataaacaacaaacagattaaactagcaactaggacgcgaccacgtctgatgttgtgatgaatttttaaccatctgaacaagatgatggccccttggcatggtccctggcatggtcaaagtagaagaaatcttcttgcaccgcacccctgaaattagagaccaagaggccattgttgaagacgctctcgatgctattggtcaaaacgtgcttccggcgtgccatcttctcgaagtctgtgtcgcacccatggtagttcccatcagccgggtgaatgatattaatgcctttatactcacagtagaagcaccggaccttctctgcaatgaatgagaggaagattaagcgaacattcaagagacaactgttgcaaagcaagcacatgtgtaagctagaacatgcaggtggacttcttttctgggtgtgtgtgtggggggggggggggggggtaccagttgcagttcagttactagcaacattccttggcaaatgagactagttaaagacatgtcaaaccaaaagcaccgatcaccgataagcgaatgagagacgcaccagcatttgttggtggcacgacaacagggtagcaattgttcttcctggcacggtcgctttcttcattgtgatttacgcactctgcaaagaaaagggttggcaacacacccacagcacttggcccagtagggctcgccaagaagttaatgtgggaatagtgaaatttgttgtgcgatcttggccagttaatcctgctaagctctgggccattgcggtccgcgacactttcgttcgcaccacagatgacatggatcacatactgagggccctgcaaacatacaaaacagttcaattttgtaagcacaaaaaaaaaaaaaaaaaaaaaaaaactagtgatgagaacacagaatcagagaaaaaagtgagccataccccgttctccagaacatagctttccaatgcggccttcgccttgctgtggaaagagctcatgtcagcccagaagcgcttggtagcatcagggaactggtcaatggtccgttctgccgccaggctcaaacgtaccagctccggtggcatcccaagtgacggtggtggttcatgtaacagtgactcgatgacggaatgcacatcctctcgggagaatctgcgatactccatcggcagcatagcacgagtgcgctcagatatgaggaactcttgtagtccatcagcgctcgggtgctgagcagcaatggccatcacgctgtacagctgcaagcgcttagccataacatccatgaagcggcacagctcggagtcagacagcattgtacgttcttggttcaggagtgcttgctgcagtacgctcatggcagtggcaaagtccccgttggcgtagaggaggcacctgatggcttggagttcagagaggttgtagtccccggcaaaggcaatgaggccagcgacgaggccagcaacggaatagcgctcagcacggaccagcgcccacctgccaatcatgtccaagtctaggtgctgctccttggggaccgggaacgcggcgtcgtaccagatggtgttgaggatgatgttggagacggggtcgagtgggccgtagcagtggccggccatgacaacgctgcggtggtaacggccgcggagaaggtgttgaggtaggagagcgagtgcctcgaggtagaagccgtggattttgtcgacgagcacgcattgcagagacttggtgcatcgttcgagtgttctctcgtccttgacggtgacaccttgcggggcgagtggggagaaggtggcggcagcgtcggcgagctcgggtggcaaccttggaggcacaagagccatcagttgttgagtacaaatttggtcattggttccttcttctaggagaaggtagctgaggtggtccacgtctgagcaggtgagacgacccttcctagacaagagatgggcgatcttgtgggctttggaagagagcgagagcatcgccgtggccaatctgtccgggtcggggtgacccgaggcccctgcggcgcaccggagggcggtcttggtggtgcaggagccgatgtcgaacgcgctcgtgcaacgttctgcctccacgaggtggacggcggcgaggaggtcccccttggcggcgcgcaggaagtgcatcgcctccatagtgggcagatagcggaagtaggaggtcatgaaccccacgagggctttgagagacccccgcgccatcgtcttcaagcactgccgcatctcaacctaataaacatgttcgctagaatcctcaccggtgctgaggtgccagatggcgttggcgacgatgttggagacgggatccagggggccgaagcacaaaccgccgtcgaggatggcggccagcagcgccggcttctcttccaccgggaggcgctcaatcgcccttgtgtagaacccaatgatgcatcgtttcagcaccgatttgtcgcctccgccgccggcatcgggcaccggctgaccggggccaactcgtttgctggccataggacggcgtccgcggcgagagattggcggatttggattcggggggtttcggtttgcctacggatttgggaagaggcccttttctccagtttgtatgggcgacgaatccgcaagtgtgctttgtgtgtgcctgttgatgagccgagctcgagctggacctagacttgagccgagcctctacaatggtggtccagcttgggattgggctcagcttgagtttcgtggagtatttgctcagcttggggtgtgattggttggtgggatatacccggatagaacatggccgccgctttttggaggttgtttggttgctgggcgaaagtgggatagggcggcccggaggggaatattcccctcagatgctggatagagggatccggccgatttggccggatgcagccgcccgaggctcgggcgagccgggcgagcgagtcatgtgactcgcgtcacccctcaccacgacgacgcgagcgagacggcggatagggtggccggcgcgggcgccggcgcgggcgacgagagaggaggcgagcacggcggttgtcgggggtgacgagcgcggcgaccggcgagagagaaggagagctcggcaaccggtgtgggcgacaagagaggaggcgagctcggcggccggtgtgggtgacgagcgcggcggtcggcgagagagaaggggagctcagcagccgccgcgggcgacaagagaggagacgagctcgacagccgctacgacgacgacgacaacgatgcggacggcgagcgccgcgtcggcgtgaggaggtggcggcggccaccgccagcgggaggaggcggctggcgggaggaagcgacggtgagaggaggcgagcggcgggaagaggcggcggcgacgagccccagatccggccgtgtttttttttcttttttcttttctctttttttcttttttctacgtgtatttataatggaaatagtggtgtaaaattgtattatgtattaatttgatggagtatattcaccatctcaagtggagaggtgaccacacactaaaaaattggatcaccaaatccaccttcgtccctacaaccaaataaaaaactggattgccatattcacacaaccaaataaaaaactggaccgccatatccaacaaaatatggaccaccatatcccatccaaccttgaccaggaaccaaacaaacccttgatgaaccgatattgtcgtttcgtggagtatttgctccatatcctccatctgctactaaaaatacaaatacgatttctcgcaaaaaaaactttttctattacattattattgtttaaaggcccctcgtttgttctatttttttgagttctaaattattacatttattaattcggaattgctaaacttcagttgacagaaaacatacctccaaatcttgcaaattttggttcactagatatgcttcgcgattcgtgctccagctgctgcttctccagcgctggcgacaccctaggatgttgagttgtgatccaaattcatttgcacttaataaatgacaacttctgccgtagcaaagcggaagcccatcgccggaggcttgggccttgaagctggcccattgggttgtgcacctagagacgcccaggggtgcgggtgtggagcccccgcggtacggatcgtcttcccttttagggttccacctcatatatatatatctcttgtaagccgccgtgcgacgttgtaacctcaccccgatatagtgaagatattttgttggctagcgcccatggttttttctctcctaatttggaagggttttccacgttaaaatctcgtgtcttctgttattgatctattattctttatcgtttgtttgcctatcgtttcctaacataggaccctacgggctagggtctcgtggtagggtgggggtgggaggggtgggagggggaggaggaagaggaggagttcgctggttttagagggatggccgtgggaggcggcagcccagcggtgggcggtagatcgggcaggcggcggcggcggagccacgggatggaggagggtagtgggccggcgttggtggcaggggcaagcaagcatttggttaggaggcagcgggcgatggttgcggatccggcagatccggcagcggatagctgccggagacggggaaggcggcgggcggtggttgcggattcggcggcggggagccaccggagatggggaagacagcagggcgggggcacctcgccatcgccgccttgaggagaaagagacgggggagggggagagaggatggggagggggctcgccggtgccgttgactctttccggccaaccgacgaggcgagtggcggcacgatggggtggtggcggagggggatcgcgcgagggacaggaggagtggtggcagtgtgatctggacgggggaggaggagaggagttagggttaaggggtctacacgaatcttgaagcatatccaatggtccaaaatttgaaagataggaggtggattttctgtcaacagatatgtagacaatcccttattaattttacttcctaaaatattcaatttatccttatagtatgcatataatccttatggctttgccacttgtttctccccgtagcttccatccatgctcgatctaagggagtggtagacaaaattagaacaagttaaaaagatcaggatcgagagaaaaataaaccgcaaccaagaaacacggttagggcatgttcaatggtagagatgagtatggtctcttaaacaatacaagattatttagagaccatgtctttacaatagttgagacgacaaaggttccaatcattaactcaaaaaatatttatttttttaatattctttccattcttttaccctcatacaaccatatttctatattatattatagtgattaagagtcgttgttaagctattgttatgcatgacaacgatgttttgtctctccttttttctttcttccatgtcaacaagtattcttaattagcaatgtattgacaaccatcgtacatgtccttaatagtttggtcctagctgctaagtgaccgaatgttattccgttaattcggccaccacccttggttaaccgaataaactaaattcggccaaataggcccaatacaatatacagaagacatcagcctaactagcagaaccctaggcatgcactgcatggggattcctaatcagcgcgtacgcgcgaggagcggaaccggcatgcactccccacaccggcacgtggcccgtacgtcaagtacgaatctattaatagtgtgattagcgttaataatagtgttattaaggaatttgtataataaaaaaataaataataattgagttgaaaattttaaaatatcagttaaaagtattcatagtttaagttgaaagttttcaaatttagacttgaaagttttcaaatttaactaaaagttttcaaattttgagttgaaagttttaaatttgagttcaaagtttgcaaatttagagttgaaagtttttaaaatttaactgaaagttttaaaattttgacttgaaagttttcaagtttgtcttgaaagtttttaatttgagttaaaagtttttaaattttaagttgaaagttttcaaattcatgttgaaacttttaaatttggatataaagttttaagtttcaggtagagttttttttaaaaattctaattgaaagtgcaacggaatgaaaaaggaaaaaaaatacaacgtgattagtctaattctgatacggattaaaaagcgaaaaattagactaatcatgacgtgcgtttcctattaccgtgctaatcgcgttttttttcctcgaactccgattttgaccaccgcgctaacgacacgtggatccggtcagtggcggatgcagctttaaaaaaagaaggagcaaaaatattcactcgataaaaacaatcgaacacaatacgtaccacgtactatatttatattgcaattgcataagaagcatagtacattcaataatttaagggcaacaaagaaattcaggatggtacctttcattttaaaagaaagaaatgacctttccaccatttataattcatcacacaccaagctgataacagaaaacctgtcaatttgcaaacacaagtccattgataagacatgggagatagtgaaataatcatcaaatctctttaaaaattggttgatatataactatataaggagatgcacctctaataaatcactaggcaaatctattattcaccgttcgtccataaacttcatgatataccttagaaattaggataaaa

SEQ ID NO: 75859 - DNA, 634 bp, Oryza sativa
atcggtctctgcatttatgctttcaggtcaccatggttttatacgaggttcttcggttgtacccgccggcgatcgtcttcagccggaagacgtacaaggagatggagatcgggggcgtcgtgtaccccagaggcgtgatcctcgaactgcctgtgctgtttatccaccacgaccgcgaaatctggggcagagacgtgcacgagttcaggccggagaggttcgccgaggggatctccagggcgtccaacgaccgcggcgcgttcctcccgtttggctgggggccgcgggtctgcatcggccagaacttcgcgctgctcgaggctaagatggccttgtgcatgatcctccagcgcttcgagttcgagctcgctgcgtcctacacccacgcaccgcacaccgtcatgacgttgcatcccatgcacggcgcgcagatgaagcttaggatgatctaatctggtcgtgatattcggtcacgtaacatacttattgtttcttgtgacttgcgtacggtgtacctatgaaatgccctatgaaatgatgctttcttcacttgtatggatgttggaaataaaaattcaaggagatatgggcttttgattggcccaagtatttactcattgaacaatgaaatcta

SEQ ID NO: 75860 - DNA, 631 bp, Oryza sativa
ttcctgcagcccccgcagccagcgcgcgtgcccgagccgcgccactcaatctgccgcgcctcccgttgcaagccgcgcgcgcgtgccgagtggccgaccgcctggtcgccgccgtcgtcagcgcctgcccgcgcctgtcgcccgtgtcgccgctccgctccacaccgccccgccgtcatcgccgtcgtcatcgcctcggccccgccactccgcgctcaagtcgccaagggacggaggcagagccctcctccctctgccgcgacgcccccgctcccctcctcctttttccaaagaagaaaggggcgagccccctttctctccctccttttccctttttcctcccgccggcatcatcctccctccgccctgtcgccgattggacgcgagcgccgagcgccagctcgcgccttgaccgcccaaagtcggtttccaaaccgacattgccgcccttaaaacccaagcctccccctttcccttcctctcccattcgcctccactccatcgttgccgctgctttccgagctctgtctcgcctccgccgttcatcgccaagcgccgggagagccggtgcgttcgtggacgcggaaggggactacgggcgctcgtcttcctcctcttccccggcccaagg

SEQ ID NO: 75861 - DNA, 620 bp, Oryza sativa
atttgccttttcctaatttacaatcaccttatctagaagccacctcagcatcatataccttttaaatttatggattaatacaaaccaactaactagcaaaaataggccaaatttctagttagggtgtaacaagtacctcctgcatcctctaaagtggaagcaccagacctgatcattgacattggcgcctttcagcctctgcgtgtatatataccttccaggcatcacaatgtactgtctcgacccaatctgcgacagaagaaaaataatcaaaatagctccctcgttattattcacagcgctcatacaaaacaaaacacagagaaaccctcctcagatgcactcctgcatatttcagaaatgcacgcgaacaattctctgtaagactagtattgtatcattcgaaaacactgtaattctctgcgccgttttcttaatggtgtgtcctgtacatactaataatcggcgtgcgcgcattcctattggcgcgtgaatcctaagcttcttatgcagcatagagtaagcaacacaagcctgaaatcaaatgctcacttcaccgcaagaagcaacgcaactagcgccaaatgcctgtgtaatgatattatttagggctgcaggaa

SEQ ID NO: 75862 - DNA, 617 bp, Oryza sativa
cccatgctccccatgtcgttgtcccgctcctgcaagggatagacctatgttagccacgtcttttctgtttgagatccttccaaatcctccccccatcttaatttcttcccatctctccggcggcgccggcgccattcgccttttctcccaaacgctcaccggctggcagcccccagcctccccgcctgctcgttcggccggtctcggcctcccccttcgttgatctccaacctgagcaccgtcgaccacgccgacgccggcgacgcctcgcccgcgtacaaggtaccaggtactgcatctgcatgcatactgcacacacgtgtcttgctgaattcctccaccgtggcaatgcggcggaggtcgcgctgtgacctcacctcacctccggctacgtggcgccgtcacgtggagtgattcactaccgcaatcagtgacgtcagtagtatcagataggatttcggagttattctgtgggacaggatggtcactaatttccggttttggttttaggatatcattttctttttagtgttggagaacaggagaaggcaatcattgattgttacttttttagtaattggttagtatatctgcactgcactctgcacacacgtact

SEQ ID NO: 75863 - DNA, 1017 bp, Oryza sativa
  unsure (1)..(1017): unsure at all n locations
cgcgaagatggccaacgtcattaccgcgttgggcgtgaggtgcgccatctggagatcataaaactccagaatatccatgaagaaattagagaatggcgggaccagccctgccattgcgaaagaaaggaagaagaccggaccgcccgggtagtgtggcgccgggcgtccctcgccccgcgcaaccacctcccgccggtggcagattccggcatgaatcgcgcggcagcccggcctgcctctcgctcacgatgcgggaaggcggcagcacgctaccgtcgagcggagcggagccccgtgccatgacgccggcggaggaggagcttgagagcgagtgagtgcggcaagggtagggcgcangaaacgaagagttagagctcaagtggcgaaggcaaggggaagaatggcgagaggaaggaaacgaatctcttcctcggcgtctttatacccttgccaacgctattcccggctcctcgtttcccgcgcccactacctcgccccctcgtttcttgcgcccgcgcctccactaaccccacttgcccgtttgcggcgcgcgcggcagatgtgcggccgtggcggttgagatgggacagatcgagcgcgcgttaaatacgctcgccgaccgagaaaagcgccatcatcatgtctacaggcgaaatgaaccggctcgtcccgattcgcgcgctgctcgagtaatgtagcggtctcgaagaggccactcattattgtcagtcggttttcccttgccgatgcgcgcgatttgcgaccgctgggtttctgcccgcctgtagggaccggccccacctgtcaccgggcctaaggagtggcgtcacgcccgagcgcttccctcgaagggggcaatcgccctggcgtaacgccgggggctactgtcggtgacatggggccgagggtatcgtgactagaggcttgggtagccgcggtcacccacatggcctgaccccctcgggggggtcgggcccgagggtgacgtggccacccctccctctgtctccccgaggg

SEQ ID NO: 75864 - DNA, 14454 bp, Oryza sativa
  unsure (1)..(14454): unsure at all n locations
taatgggtggttccgcccctggtggacgtatgcgcgcataagctatctggcgtgtatgcgctaactagcaaaaccgcactgcatccccttagtcctcctcactccttatcccgatcggccgatcccctcattcgccaccctcaggcaccgccttagcgtcaacccaccatgtgctcctcctcgtgcttgatgtcatccttgcctccttggctctgcaacacctgtcacaccctgacttttgtgtcttccgttttttttagcctgtttgtgaaaattcacatttgatttgttcgtcttaaatagcttaatgaaaacttcattaaatcaaaatggtttaatatgattaattaattaattacatcgttggctttgttgtttttcattggagttaattggatttaatttttttaaaagtggagctcaatacctaatcaaaattccacccaaattcaattcctaatatcctaaattctccttaaaaatttcaaatattccagaaaagtctccagacttttcccttattcctttttccttcctttctctccctttaccacttctcttcttcttcttcttcttcttcttcttcttcttctcctcctcctcctcttcttcccttttctgttttcttccacctttttcctttggccatggagccaaagctacctctctccctttccagcccgtcccggggaggccaagccccgagcccgggcatcctaaataggcccaataccattcaaagcaatctcaaccatccaattcccttgatcgagtcctagcgatgggatctacgaaatcccatccatctcagccctagatctatccacatcatcaccatgtcatccatctcatccccacgtggcatccacatcagccggtccatcatacaccgagtccaccgtgagccataccactgactaatgggcccacatatattctctttcacaaaagtaattaaatttctgaaattaaatatccagagaatattattgggatattctttttcttatccaaagattttctccaaattcaaacttcaggaggtcacaacttttctgtccgaactccgattcaaccagtcttctttcttaattcttctaaaattgagatatacctcctggttacatttgttgttttgtttgatgttaattagttagtcttttctttttttttatttgtttctcgtttgtcatcatgtagacgttggaccaaaggtgttgttcgttgcagaagacgcagtgtagggacagtttttggatgcaaggcaagtgcactctttgaacgtattgaacctagtttataaaatattttgttttgaacatgcatgattttatttataacttcttgatgacctaatcgttataatatcccgtatttgattaatattgactcactatgatacctctatcttgggctcaactcaagatagagtagctatgcttagccactctctaggttgttttataagcaaaatctaattttgattaatcatatacttatagttatttttatatgaactatgtgattgtgtgatatcttcccgttttatgtgttgcgccgtgtaataaacaataggtggataaaatgatttggactaggctgatgggtggttctgtgtgtgaacctagttaggtgatgatgtatatgtgtgatcattatcaagtatggtccctgtgtgagtctactatcaagctatgtgctatttagttgctcaaagggtcaacttcgtgttcttaagccgttaccttatattgtgtgctattatagttttggcaagttgtcttgtcaatttaggacttcacttcataagccattaatccgagcctaacatgcaaccacattgttctcatggaaagaaactggctcaataagattccgagtcttggcactgtctgcccaggtggctagatgataggcgttaatgttagacataggtacttttttgtctgtgtgagggaaactgtctcatgggggaaggtagtgttaagacggagtttcttgttccagactccacacacaacctgaacatagttttccaatgcggccttcgccttgctgtggaaagagctcatgtcagcccagaagcgcttggtagcaccagggaactggtcaatggtgcgttagccaccagccccaaacgtaccagctccgatggcatcccaagcgacggtggaggttcctgtaacagcgactcgatgacggaacgcacatcctctcgggagaatctgcgagactccctcggcagcatagcacgagcacgctcagacacgaggaaatcaagtagtccatcagcgctcgggtgctgagccgcgatggccatcacgctgtacagctccaagcgcttattagccataacatccatcaagcggcacagctcggagtcagacagcattctagttcttggttcaggagtgcttgctgcagtacgctcatggcagtggcaaagtccccgttggcgtagaggaggcaccggatggcttggagttcagagaggttgtagtccccggcaaaggcaatgaggccagcgacgaggccagcaacggaatagcgctcagcacggaccagcgcccacctgccaatcatgtccaagtctaggtgctgctccttggggaccgggaacgcggcatcgtaccagatggtgttgaggatgatgttggagacggggtcgagtgggccgtagcagtggccggccatgacaacgctgcggtggtaacggccgcggagaaggtgttgaggtaggagagcgagtgcctcgaggtagaagccgtggattttgtcgacgagcacgctttggagagacttggtgcatcgttcgagtgttctctcgtccttgacggtgacacctaatgaggcaagtggggagaaggcggcgagctcgggtggcaaccgtggagggacgagaaccaatatctgtcgttgagtacaaatttggtcattgctttcttttctaggagcaagtggcggagatgctcgacggctgagcaggtgagacgatccgccgtcctagagaggagatgggaggcgatcttgtacgccttggagaagagcgagagcatctccgaggccactctgctcgggtcgcggtgacccgcggcccccgcggcgcaccggagggcagtcctggcggtgcatgagccgatgtcgaacgcgcacgacatgcaacgttctgcctcgacgaggtggacagcggcgaggaggtccccctcagcggcgcacaggaagtttagcgcctctagtgtgggtaggtagcggaagcaggaggtcatgaaccccacgagggccttgagtgacccccgcgccttagtcttcaagcctcgccgcatctcaatctcatccacatctgcaccggaatcctcaccggtggtgaggtgcctgatggcgttggtgatgatgttggagacgggatccagggggccgaagcagaagccgccgtcaaggacggcgggcagcagctccggcttctcgtccacgggggaggcgctcaattgcagcgctgtagaacccaacgatgcgtcgtctcagcaccgatttgtcgcttccgcctccaccgccggcagagctcacatcgggcaccggccgatggggcgaactcgtttgctagccattggacggcggcgtctacaatggcggagtcaggatctcagtacgcttagggctcaaatcgaagtaatatccatgataattcatatgctgaagtacaaagtacagaaaaaataaaagagcaaaatcaaaactaattcaattaagagatatatatatatatatatatcaatggaaaaactcgtgtctatcacttcttaccatcttcgcaataaggctaccaaggtcagagcagcttgagaaatccaaatcagatctcccgtcacagataaatgtgtcagttggtctctaatgactgtacaatcatatttagaaaagtgacataaatcttagcaagttcaataagcttatcttcatcataattggcgaaagaattccctagatcaaggcaaacaatgcatctcaatagctgagtaaacctttcagcacgatggtttaaatcaacaataatttgatcaagtaccacattaaatatttcattgctgaaatgatcaacctgttaacatggacccaacaacaaatactcccttgtagcagcatccctaatgtttacatccaattgttcgattggagtgagaatcccagggtcagcaacaatcacatttggagcaagcacaacattattttgccaattgttactagcctcggttcctgctgtttctaggggttggatggactcactgcaccggacttggtagaaaataatggtattaatgttcaggtcctcttcatctaggaaatcaaacaaatttctaattgactaattgctatgaaatgcagaataagaatgcaggtcgaaggttagagaggagactcacctggatttgaggaatcaggctcttctggctgctgccgtcggcccatcgccggctcgatgccaatgcgcgccaccgccgcccccttccaccgatgtgatcgatgctgcgagaggagagggaaggacgaggcagcgtgatgcaacgctcgtgtgaatggtggtgcgtgaatcgtgataggcggcagggggagaggagaggatgtgggagacaaagtgttggcttctgggctgtgacctatgatgggctgctcggccatgggtgtttgcgaaagtaataagttcatttcaggtctctcaatttatcaccgagtttgaaatttggtcccttcactacaaggtataacacatctcgcaacatacaaaacctggtcacatttagttccaaggtagtattactctctattttggctgacgtggtggctgaatcagtgtgaaacccatatgtcagggcgttttggtctttaaaaacaaataaaatttggtcgatcccatgtcagtgacacaacctctccttctcctccctctgtttcaacgttctccaacccggaggacacatgctgccgacgagacgggcggtgaccagactccctccaacccgaagctccacaccgcaccggccatgaaccacaagggagccaccgcctccaccagcgccactgccgccaattattattgctcgcactccatcggcgtcgctgccaacgcatctcggataagatcgatgctgcctcctccccctctccaccaggggaaacacaagcgaggccaactccgacgtggtgctcctcttggagcgtgtaaagccgacccactacaggggcataacattctgaaaattcctgacaataaaaatcactaaaatttcgaacattttaatacttttgcatcatgttggttgttaagattgcgattgcctaccaaaccatgaattgtcaaaatgaggaatcaaattaaagatatactcccagcaataattatgacttacaattatatttattattaatcatttgtgcacaagacatgaagccaaataaagtacaagttaattaataattcttgtgatacaaattacaaataaaatattaaatacttggattatgtgatgtgtgtcatgacatctaagtgcatatgaaataaccattcaaataagtggatctctatctatgaaatagtttcactaggaataattaatttgatattacatatattatatgagttccaaatattaaattataatgagctgtatagaggtcaaaccaatttaaaaaggacaacccatccacatgaaatgaaatgatgatcaccactataatgatcctatttgtaaatgagtatttcattggaatatgtaagttaatatttggaacatttcatcaagtcccttgtgacataaaatcaactcatgtaaaatagttggtcacactaataaattgagcaaatatatcactatatttataatggacttttggataaaatctagattttggacactaaatattaatttgggtagcttggtaaattttcatattaatgccttcatttttccattcttccttctcttctttttcttttctttttctaggcgcactgttcattatccgccatctgttcgagttggtcccccaccctagccgtgccgctccagccgctgtgcgaaccgcacacgtgcaaccatgcgccgcattgcgcccgaccaagccagcccgtccgcacccgcgcctctcccacgcccgcattgagccccgcgcccccgcaccgaatcgcgcgcgtgcatcgcgcttagccaagaccccgtgccgcgccaatgtcccgtcgtcctgccacaccacggccgccgtaccccaacccccctccagctcacctgccagctagggcatcttgccgaacgccctacccgacgccattatgccctctcgccccccctcctccctccccccccatttctaaccctctctggctcagcctcatccctctcaaccctctccctcactcgcaccctcctgtccctcccacttcacgcgagcaatcgccgggccgcgccgcacgcccggcgtcgagcacgtggagtgcgtgcgccgtgctgtcatcatgtgactccatcaaccgaagccggtggcggggtagggtggaggcatccacacgagctcgctgccactgaggaaggagaccgaagaccgttggattccaaggaccgcacgtcgaacacctccggcagccaccgtcgtcgttcgcccctgcgttgaccgcaccacaaccgtgcgccaccacccttcgctgttgctccacttcggggtaagccctcgcgccctgagcacctcctagtgacctagtagctggcggcctcctcaatttggggtgcgtgccaccgtggctatgccatccccggccgccaccatgccgccgttgagctcaccgtgggcaaggcatcccgggggctatcccctttccatctagttagcaaaaccgaaaccccagccgtcgtagatgctcccgcgcccatcaatttggccggagaccgtccctttcgccctagccacacggtagccttgatgttaccaaagatgatttttagtcccggttatttcaaccgggactaaaaatatccatcattagccttgattgagcatcccggttgcacaatcaggatgcaaaagggttgctaactgggactaatgtccctttccccagcggtgtattttgcttacgatgacagacctgatcagtgacgctcacccgttcatcatcaaccagaggcaatacatttgtgcatcaccatttaaatcatttatgcatgactcatacgtgctactggaatgatggtttgttgtttcacatatcagcagcaatgcacgggatgcacttcatgcaccggccacttcgaatcagcagctagcgacgtacgcaaaagtcttggttctccgttatttagtcccacatcggggagcctggcgcacgggcgcggggtcataagagcgacagtccggatgtgaggcgtgccgaaacgaagggcacacccggcggtaggcatatgtagcgatcccaaaaacaaatataaccggaagaaatcaagcccaccgcagttgcgacatgcgtgcgagcgtgtgacacatacgcttggcaaaaaactatcatttttttttctaaaactggcttgaccagaattatgagcgtccagtacagtctggtagcataccacgaaaaaaccatcattttttttctaaaactggtttgaccagaattatgagcgtcgagtacagtctggtagcataccaccagttggttttagtttgacttacagaatttgaattcgtagttcaaaactctgacacctaacataacgttttggctagcttagagtttggatccgtattgtcgtaactcgtaagaggatgtttggttggtgttacattttaatttggacctgtttagttcacaaacaaaattttttaacgctatcatatcgaatgtttggacacatatatggagtattaaatatagacagttctccaggaaattacgagatgaatcttttaaatgtaattacgtcatgatttaacaatgtggtgctacagtaaacatttgctaatgacgaattaattaggcttaataaattcgtctcacagtttcttcccgaaatctatagtttgttttattattagactatatttaatattttaaatgtatatctgtatatccgatgtggcatgcaggggcaaagttaaatcataacttggctaacatagagtttggatccgtattgtcgtaactcgtaagaggatgtttggttggtgttacattctaatttggacctgtttagttcacaaacaaaatttttcacgctatcatatcaaatgtttagacacatatatggagtattaaatatagacagttcaccaagaaattacgagatgaatcttttaaacgtaattgcgtcatgatttaacaatgtggtgctccagtaaacatttgctaatgacgaattaattaggcttaataaattcgtctcacagtttcttaccgaaatctataatttgttttgttattagactatatttaatattttaaatgtatgtccgtatatccgatgtgacatggaggggcaaagttttttttctaactaaacaagcccctggtcacacttgagatatgttttgagtagctgtgtcacatactctcggcatagtagaaaaaactggaccggacactgaaccgcttaagctcttggttcactgggtcaccggttggaccgataggtcgaacggttcaattgttgaaccggaaagtatatctatcatacataattttacttaaacaaggtgaccaacttagcttggtggtgtggttgatgctcttatagcccatcagccaaggatcaatccccattgtcgaagagtaatcctctctagcgggcggtcgtgagaccccccccctttgtgagttcggccgggggaaatggcgcgatgatcaagggtcaacttccgcttggccatctaatcactagatcacttgcgtggctgtgtgggagatcaaggattatacaggttcgggccgctctcgagcgtaataccctacttctgtgtgtgggattatggtgaattcttacaagaggttttgagctccagagggaaacctagctgtccttcctcccgagctcaagttgtctgagagtcgtcccttttttcggtagacaaggtcctccttttatagttcaaaaggataccacatgcaccgtttgcacctacccctccaagggaggggggcccacatggccctattcataccgctatcctttgcttcaaccggaagcaacatggtcgcctggcttcaagtggggcccggcgccgccccccgcctgacacgggagacatccctatcattccctattaattgtatgaagactttggcggctcaccacgcgcatgcggcgtccctggcagcgtgccgatgggacagggcatacccgcccccactccgcctgacacagggcagatcgtgggggcactgcccccgtcccgtcgcctgtgaccggtcacaggccggtcatgctcgattgacatgggtcaatcgagcggcgccgcacgtccctccacgccgcggttggggcgccgcgtattgaaggcgtggagcagcgcctttcgcctcgcccgctctccccgccacgtggtggtcaggcgagggcctcggggtagcacaccccgaaagcccgaggggtgcgacgtggcaccccaaggccccctggccacctcagcgctaaccgaggggcggggggaggcgaggtcgcatgggggccccccaaaactgnccactaagaatgcggaagaacacttccccttctactgtgcgtaccctcgggcccatttcaccgacacccatgtgacgcaccattttcccattttatggaataaaagggatcggtccccatgtgacgcaccatttttcctattttaaggaataaaaggtaattgggccacaataatccaagtgggcattagcgaaccggcagttcaatatagccttgttcatccggttcacaccggatcgattgcatgagcggtccttaaagcaaaccgaaccggtgggagtgctggttccggtttctttcggttggaccgccggtccggtccggttttttataccacgactcttagccatagaataactggaacgaacagtatatattcatctgccgtagaaacggataaacagagcagccacaagaaacacagagcggcaagaacagaatatatatatatatatatatatatatatatatatatatatgtatatatgtatatatatatatatatatatgtgcgccttggattattaatccgactcacataccaagtcaaccaaaaccaatcagcagcagcagctaatttaatttaatcgatcaacctccactactgtttcctagcgataaccacattactcctccggagcctcgtctccaggtactcgaccacgtcgccgacggccgggagcaccttcctggcggcgtcgagctcgccgaaccgctccgcccacgccgccagcagcggcgtcctggcggcgtcgagcaccctggtccccgtgagcgcctcgttcgccctcgtccgcgggatcaccgaccccagcgtgacgtcgacgagccccggggcgtcgccgccgaagaagggcttcccctccgcggcggcgagggccccctccagcgcccccaccgcggcggccatccgcgccatcccctccgccctctccccctccgtgctccccaggtacgccggcctccacgacgccacgaactcgtcgtcgacgtgggcggcccagaagcgggcggcggcgcgggcgagggggtcgtcggcgggggggaggagcggggcgccgccgccgccggggaaggggaaggcgtcgtcgatgtactcgaggatgacccgggactcgcagacggggcggccgcggtggatgaggacggggaccttggcgtggacggggttggcggcgaggaggaggtcggtcttgcggtcgaggtcgacggcgacgaggtcgtaggtgaggcctcgcagggcgagggcgagctccaccctggtgacgaacgggctagggttcgtgctgccgagcagcttcagctcgtgatccggtgatcctcctcctccggcggcggcggcggccatcgtcgtcgcgcctctgccgatcgagcgatcacgtgttgggcggattggatttttagttatagacgggtgctggatcgagatggttgttctggagtgggaagtccgcgggtggattgcgtcatccgtgatgtcaggacaggcgaatgtatcttccaatgcgtcactgtcgtcatcatcatcatcttacaggaatgctgcaatgcacgtggtgcattttggctttgtgcaatctccgtttgttatcttaaaatggttagaggttgaatggctctcaaaatggttaggggattgggcctctaggggtttgaaatcacaatgttctaacttctaaactgagggtgtgtttagttcacaccaaaattagaagtttggttgaaattagaacgatgtgatagaaaaattgaaagttcatgtgtctacaaaagttttgatgtgatgaaaaagttggaaatttgaagaaaaagtttggaactaaacaaggcatgagaactgagatttggaaagggaaaggtccattctacaacgttcaactcttaaaccgagtccaattagcatataaacggtgaaggaaaatgttcattttaacccctcatcctatcatcgagtttaaactatgtttttaaaccataataccaaatataatgcgtccctcatctttcaaaaacagtataaatatagtcccaagtagtaggcattttttttggccgcagacgtggcaccagaaacaaaaaccaataataaaatatcttacgagccccacatgcgggtgatacaatgttttcttcctcctctctcaccctctcccctctcttccccatctctgtccaggtctccagctcgtagaatggaccgggtggtggccggcaacaggcggggaggagatgggtgacggccccaacatctacgagctcgaccaccacgaggaggtccagcgacctccgctcccgcctcgccgccgcatagtggatgatgcattgctgaaatcagtacatcttggtcctagctaacgtgttcctctacataatggatgacacattgctgaaatctgaatcagtttgtgtactctgcataatgcaagtggagaacagattattcaatcacgaatacagtaatcacccaaaaaaatttgtaaaaccaatcaactggccgaaaatttgtttgaaacaaaaaatcaatcatcccaaattagttcctaactaggagaaaaccaaaataatcaaagattaagaaagcgcagtggcggttcacaggaaattcggagcaaaaaactgaatcatctgactgttcttgatgcaacgacgatgctacttgccttcaaattcatactactaaacgatttttcatgggctcatggcgccatccttttatttttacttacggattaaaaaacaagtgctttaaaaaatttatcacagggatttagggcacgagcagctagcaaaaatagattttcgctcgtggtcattaagcaaccgccaacgaaaattgagtatctaaagagctatctttgcaaaattattatcgccttactataaatgggccatggcccaccacccattacccacccgccggcatcaccttgacctaggagacgagcccctatagcttcggaaacagcgggtggtcgtcgacaaggatgtagttgcaggcgagcatcatgaacgcatcgttcaaatgttgacggtggttcttggaggacgagcaatgggagcggaggtccctgacctccccgcggcgatagagctcggtgaagttattgctgccggtcagctcttctccaccaaccgtcgcccttctaccaaccagcaaccgccccccgtcagttttgcacgccggagaactggagagatggggaagagagaggagaatgtgagagacgaggaagaagatgtttcatccccataaggttttttattatttgcttctacttctgatgccgtgtcagccaaaaccacctatacaatacttcctccgttccaaaaaaatcttaacatagacaaaacatgcccctcctaggttgagttatttttgggacggagggagtaccgccttgggactatatttgtaccggctttaaaaaatgaggggcatgttttgtctggtttcgtggttcaaggaaacttattcaaattcgacgtcaaggtgagagacctagagtaaacttattcaaacggtgaaagacacgtgaaagtccaagaaatacgaactgggccggcctgctaacacactcgcaggccctcttgcatcctttgcaagtacacagctacggcaatcgcgaaaccgccaccgcggtgtctcatcgtcctcgccgccgcctcgtcagtcgtcgccgccactgcgccaccccgccgcgcacggcaggtcgtcgctgtggcttggacggcgaactctctcgacgtttccaccgttctcgttcggggcctacgggccgagggggcttaggtagaatgaagccaatgcgcactcgggatcatggtgcggccgaggtgttcgacgaaatgcctccccggctggggtggggggggggggggggtcagtccgtcccagagcggcgcgttgcagcgacggagtgattcggggagacatccagggcgctgctgctccgccggtgccggtcccttgacgcccttgtcgcattcctgcgtgcctactacgcaccgtcctacctgtcggctgaggacgccatgcggatgatcgacgagcacgccgggatcccactctgctcatagctgcagctcatccttgcgctcagtacctcatcactgatttgatgctatgctgcccagtgccattgtccaaagcacctagtatgtagtacatgtttatctcctctaatcgatttcatccagtttagattatggagttggctgatctaatcaatgacagcgacttggttccatgttcttcctcttctcctgcaattaggtggctgctatggctgtgagattgaagggtttaatctggtgcaccctgacaccgaagatttctatgggcacctggctcaacatgaaggtgatgcctatttctgtaagagaattcctgctcaagagttcagcaatccattatatgaggattgtgtactctttgagccttgaacactaaatattgtgtagcttttcgtagataacttactctggtagggatcatgatgagattgacttctcttttggctattctgctctggttcgacattctgtacagattttagttctccctttgatttcacaatgtctgtcaatagcgtgtttaagatacagtgatctagcttagtagtagattcttgtaaaatatgcaaatataaatgacttggatgaataagaattatattgttcgtgtacattcgttgcaacatggtaatatgttcttattcatgttgttggttacttt

SEQ ID NO: 75865 - DNA, 1769 bp, Oryza sativa
ttggatttttagataatgaaatgaggattggatttttagataatgaaatgaggattggatgcctaacaaacactatgagactgcaagtttcttggagacaacttttactgctagcaattgtcaaaatgacattgacctatcttttggctgttttaggtcagtttggagatttataacctgaagtcatctgtattgtaggtgattgtaaatattgtagaagcccatgtagaggcacaaactactttatttttggcttttggaaatctaatttgaccttatggagaaagttaggccatccttagcttataatattgctattgtagtccaatgcatgttcaaaagtagcatcagtatactaaacagaacagatacttattctactgctttgtatttttcaggtaagatccaccttggactagtccatgctatatggctacaacaacgcaggcattgcagtagttctctgatagggaaaccaacttattagttctattctgttaatgttcttcagagttcaaataccttaatgaagagctttcttataaagagggagaatttttactattcattttgttattattcatgtcaactatggaggtgatgaggaaaatataccctggccaggatataggatgaacctgtcccacttttttatctttagtgtacctctccaaccactaccaaggctaacatggtggcctagtatatatcagaccaggaaatgggggaggagtgttctaaggaaatacacctagtacaggtaccaacaaaaatgtgttagtgggcccatatgtcagtgaaaggtgggttctatactttaaagggtgctaaacactagagggaagaacaaacttagtgtttgtactgtggcacttctttgcattggtacattgagtacaacattgtgcatgccatgtaagcccttttcaatgatcaaagcacacctcaagttcatttcattggaaaatgatcattaaatcttcagcatttaatttgtcaatatttttatcatgcatatctgtctttcatagttattgatgcatgtgtaactgattatgataacttgcaatctgtttagtttaaaaacttacaatttcttatgcacaagatgtttggcagggtgcgccaggctggtgagcacgcaagttaacaacacaactgctatattttcaaacatatctttcaggtaagtatctgtcagagtgcttagtgcttaattaattcacatgatgtagaattaattgaacgcctttttcttcttatatatgtgatcctttttttttgtaggcatcaactctgctgactgcctgatcagctctaccaaaatatggatctgcaaacgcaaatgtcatatgttggcagttcttttaaagaaaaacagatgtgcaggaaaattgtgagcaaactcgtaaggtaaatagcagtctctgcttctccggtaaatgtagttgattttctcatggaaatatggcaaaatgatgtttacattgttttacgctggaggtctagtctccagctttaataaaatcaaatggtgcattcttctaatgagatggattgttttccatctccagattcacatatactacattaagcttttagctcaatgctttctcgttcccaaactgtttatgcttttatgtatttcaccatatatactccaaatccttaagaaggtgattgtgttggggacccaatgaaggctttttgtgattctatgaagttttagtaatacacttggtacgaattataatgtagttcatgacata

SEQ ID NO: 75866 - DNA, 1190 bp, Oryza sativa
ctaggcgatttattacccaaggttgacaaagaacagatatcaagtaaacatggcacaagcgagcagataggtaatacccagatcccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgacggattctacacgctggcacgcaaaatgaggaaaaactctaataaaaaccaaggaaacagtacataaaaactaaacaaacatgtagagctcaattttagatgaattttgcaagttgaacggctcaattcggagttcgaatgaattagatatgaattttagaagttttgagccatttaaatgaatttctagaattattaacgaattatgacgcaaatattatttatttttccaaaggaaaagagggttgctgacatcatcaaaggggaggggcggcgccggcaagcgggccctaccggtcagtggcacaagggcgccggtccaccgtggaccgggaccaccgaggcggtccaccgccggtccacgggaaccgacggcccggattggccccagccgatcggacggccacggggcgcgcggctggggcacggtcacggctcaaagccggccagccgagtgatggcgcacggcagcgcggccaccggcgacgacggccgacgacggcgcgggaagcggcagcgcatgcgggcggtggcggcgcacgctagggagcggcggcacgggctcctcgggaagacggcgcgatggagctccggcgacgggcgtcgctcatgaaggggcggacgggctcggcctcggtttgaggaaaatcaaggaggggctagggaggtgagaactggtgcgaggtaaatggaaacgactgccgaccacgacaatacgaggaggagctcaccggcgacgagggaggtggagctcgggcggatttccggcgaagagggccagtggccgaggatctccccgtccctgtggagccgagggaggcgacgacgcgggtcggcgaggaccgaagcggcgttgcgacgcggctggaggtggccatggtgagggagaaaggtggtgcgcctggcggcggcgttcccgaggcgaaatgggaaaatggagtagggaccggggt

SEQ ID NO: 75867 - DNA, 4571 bp, Oryza sativa
caaaccgcttgtctctccagaagaaagcacgtcaaccacaccctgcaatcattaaataacactatgatcaaataaccagtatgttgaatcatagatgggagacaatgtcaatagttgtggaaatatgttataccatttacctggtatagctcagcccgaatctttttttggttctcaggttttgagtaccaatcgagcctcatagactcgattttgatgtacatggcaacaacccattgttggaaaagtcgtcctccaaacaaaatgatgtttagaagtccccttctaaactgcagcctgaagcaatagtactccctcgctgtgacaaacttgtcctttttccctttgccagatttactactatcgtcattatcatcttcattgtctagataattgtcaacaacctcgttctctgcgtccaaacttacatattaatatacataaacaatgcataaggacataaagtttagaaattattcgataaaagccacgagtgtacgtacccggaagatcatcaaaagtgctttcttcgttggtacgtacatcacctaaagttgatgtctcacaatgttcatccatttccacatcacacggaatctggttgggatcgttgtatggcattttcaggttccactcagtctcccattagggttaaataaaggatacgctaaagggtcataacaaccatggtatacttggatgtaacagggcttatcaccttttgcatgtaccaagacatgtctatcaaaagttctcattggattatccccctctaaccaaattgcagcaacctgggatgcggtgggtgcattatatcttcgttgggatgcggtgggtgcattatatcttcgttggtcaggtgttacattagtgttgagctcaatcatgtagtcatctatattgggcatggatccaactctgctgaaggtttgtacgtacgggttttgcgccaaaatacatagaatgacccgaacaaggttgatatcaaggtcaggagacctgcgaaccctatgggctagtgcatcagcatcttttgtataataaaagtaaagctgcatatggcgcggcccttgagaacctggaaccaaattatccaggcgatggtacaacgcaccatgcacacgaaatgtatacacaccagttcctgctgcagtgctgacttgttggtcaagggtaactccaaggctcgtgaatgagaaatgggagttgaaataccgtatgtgctttctgaaatattttgcatcattatgcacttggctggtaaacaaccgtattaactcggcaaggatttttggaacatgtacatttattttctcttgcctgcaacagaatccaggagactcatactgaaaccttatcgcgtcgcaaaactgacaatcaggtactttctttaaaatgtggtgtgtcttgggcagttttttgtatacacggtcgtgtggatcattggcttcaatactattaacacccttaacatccacacgatatgactcgtacccatcatttatagaggaaaaatgtttggtattaaaatttgatgatgcatagataataaggataaagtgaacaatattggtaacttactttgctggaattgcatatctaactcatcaacattatctgcgatgtcatggatttctgcggtcacaccatgatctaattcacagtaggttattgtaaatgagatcaaatggttcatgggttaataaataataaaatgatatctcacaactcaccttcatcgacaaaatcaattagtggaggttcaaataatccactatcgaattcaacgtaagtgtcatctgggatatgcacttttgcatcttgcacatggatagtttcttcttgcgtaactccatctggtcagaaaaggtattatttattaaattatatgtaattataagaaatatcaggcacacttataaacaatacccgacacactcaaccgtgtttacctatggtaggggagtctttatcttcttcaatgatcactggtttcctcttgcattgtcgtttgtaggtaacatttctatgaagccagtccgttggatcatctatgttgccatttttattatcagtaacactcgatgcttgcaaaatggtagaatacgtagtcccaaatgatgaccctaggacaaaataattgttagaacaatatataaagatatagtgttgtttgtgatagtaaactttaccaataataggggtggttgcatcaaaatttgctaagatagcattgtttgactcagccttcttccttgcgcgatattcacgttgcttccggtttctatcttctctttgtttctcgcgcttttcgtctcgacagatgttgccaccatcactttgcatggaactggaaattgttaccggttgcattgggatgtttgataatacacttatgtcaacattgttcatctcatccatcttccatttgcgatattcatgttgttttctgttcctttcttctcgttgttcatttgacattttagttggctgggaattgccagtttcatgatttacagaaacacaagcagttggctccgttggttttgccggtgtgattgggttgtgagcatcttctataacggaattctttcttgcgcggtattcacgttgctttatgttcctttctgctatgtgtttgtcaggtattggcacttctgaaattaggagtatgttgtaattgacatatacatgtacatattacaaaagaaaactatataaacagatagttcaatgtaccatgatatggattatttgcttctacctttttccttgcacggtattcacgttttttgctgctagtttctcccttcttgttttctacctcattacaaggtgttgtttgccttacatttaatctgttagttatatctccgaatacaaagcggccttcgacaggtgatccatttgcatccatacctagtcagtaaattatgctattattgagtgcccttgcatgtatattaaataacacttatgataattaaaacattattttccaccgaaacaagaaagtaatggaaaacatcagccacgtgcaaggcattataatgacaaggtttatatatacacgtacgcacgtcacacacaagaaggacgcacatgaaatgaatagatatttttatcaaaaccgttgtaaaatgttatgcatgacatatgcaagaaaaaatatgtgtattgtatagaatatatcgtgagacaccaatagtgcctttggttcacataattattaaaatatttgggatgtcaattattttgtaggaataactatatcggtaaatagaaggtgtaaaagaataattaatatttgagggaacagagaatcaagagaataattacataataattagtggaaaatagcatgctgatgaaatcaaaactcattcagctaccatactgtctagtctcaattttttgccaaaaagaaaaaactaaaggcatttcatcacttctgctcctttctatacatgtttataattaaagctaccacaaaagaaatgctccatatatttacaaaatatgtccactcataattgttttcagtgttcatgtacgagggaataacagattaaatgtcacgcccggaatttctatccaaaattccaaacgcttacatgtgtgttaagccctcgtccaggaatcaaccgaggcacacaatgacaatattgataatagagtataaatatttaactatagaatattcgcaaataataaattattacagaggtggatagttcctctcaaagaaaaacattctacgcagcggaaaaaaaaaactataacaaactacggaacagctatggcaactccactccacaggcatcttaaccgagaacaagcctaatcctccagatcatcaccttcactgagaaactcctcttctgatgaatgaatattgcaagaatgagcatataacatactcaacaagccacacagcaaatatgcaagtgcacaagataacaaaggatggcataatatagttcatttgcagaaaacagcttttttaataatatttaagagaataataaaacagttgtataattgatcaatattaaataaacaccatacaacacacccgtgttgcataggcccaaccccatttgaacaaccaaccccagttgaacaaatgaaaccctccaaaccaggaattaaccattccaaaccaggaattaaattaattaacacattattaccattaatgagtagtgtgagactaatcacgaaaaacattgctcaactcacccataaccgcgggtacggctattcgaatagattaaactttgatcagagatgtaccactgtacccacaagacacaaccccacatcatgttaccatgtgcctcaataccaccacggtacctcggaaaggaattgtgacaatacccctcgcataacacaattcaccacagtgcacctttcctggatcataatcaccccctttaaaacaaggtatggactccccagcgacccccatggacttctcgccacttctcagtctggcacactataatgaatcatgctatacaaaagataaagccgttgcccacgctggcttgtggttggcacgataa

SEQ ID NO: 75868 - DNA, 1134 bp, Oryza sativa
atgcacgttggtaatctgacgcgtggtggacaagaatgaccggtctgacactggtcgcgtcagcaacgagcaccacgatcccacgttgcgcccgtctccgccgggagtggaggtaggtgtgggctgtcccatcgaagtgtgattcgacggcaaccatatcaatctccgttcgtaaagagaaggaaagtccagtttggaaagggaagggtgcgtgtggtatccccttgaagtataaaaggaggaccttgcccacagagtagagggttgattctggcgagattgagagcctagaacaagggagagtttggctcacactttgtagctcattcatacacaaatccacaaaaacacaggagtagggtattacgcttggcagcggcccgaacctgtatacatcgccgtgtctcgcgttcccttgctagcagacaatctttccacatacagagagagcttgagatctcaccctaagcccccggccgaaccggcaaaggggggcctgtgcggtctcccggtgaggagccccgcgctccgtcatctggcgcgccaggtagggggctcagcgtgtgtcttctgagctcttgcgctctttcgtgtgcaccaagcctttcctgttcagcctcatggctgagcaagcaaaggtgcccgacctctctcccagtgtgagtggcgacgacggggagccgaacccacgccgtcgagctcgtactccaccgcctcctccacgccaaagtcctgggcgggagaaggcacccaagagggctgaagggtccgcgacttcggcatccacaggagctgggaaagggcggcgagatggggagcgtcgcctcctcgtctatggtgacggcagcacgccccagggcgcgctccaagctgcgggcgcgctcctacgtcacccgcctgtcgcccatgacccggagtctccagcccaacgatggctggacgacgtggccaaattggtcatgacggcgcggcagcgcctagacgctggtgggcgatcctccgccaccaagacctctggtgctgctaccaccggctccgcgtcgtcaagacggagggcacgacgagcggcagccgctgttcgccgttcggctgccactccttcatcgactccttcgacccgggaagatctgcgtg

SEQ ID NO: 75869 - DNA, 20787 bp, Oryza sativa
cccccccccccccccccccccccgcatgcgcgtcgccgcgatgcaccgtcgcccgcgtcgccggccgccgtcgtcttctcgccggccgccgccgtcggaggccgcttgccgccgccgccctcgccctaaccggccggccggcttgaagccgagccgagccaggccgccttcctcctttccccgtgagccgccgcccggtgggccccgcctgccagtacccctccctctccccttgtgccgctgaccagtggggcccgcatgtcggcgccgccccaccccttgctgacgtcagccctggggcaatattgcgcaataaatcgattaagggtttttcttttatagtaaaaacacagagaatcttctaaaaatcataactaattcatccgagctccgattaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgttccgtcgatccgcagtttctcgaagacgttgctgaggtctcatcagttcgagagcaaggcaagtcatgcaatacaattgatcatattgtacccaatttacaaatatcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcatagctttggtttagtgccaccgtaatggtgttggttaattaaaatacattacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggtgcacgggaacgtgtcgtggggctgtgtcttgtgggtacagttgtacacctctgatcagagtaaaactattcgaatagccgtgcccgcggttatgggcggtcgaccagattcaccgtgattagtctcacccctagtttagcttaatgaactgattagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggtccgtgaatttctgggcgtgacagttgacttgttaaaataaagatgttaacagaaaaaaataaaagaaaaatatttttagaagtgggccaacatgagaaggcccataaacccagcccattagttctcccctaaaacctagagagaggggaaccgaatcccacctcccctcatagtgccgccacccctctccctggccggtgcctccttcctcctctcctcctgtgttcgcatctctcccatctacagcaaattgctctccctagatctccaccttcatagcttggatcaagaagcgaagtagaaaaacggaacgatgaggagaggagtagaaggaggggttagaccggagtctcccctattgtctcctcacaagttctctaaagaaaccctaggtgaggcttatccccttgttgtatcagtttttctagcatggctttagtgcattaattcgtggttagggaaggctagagaaggagtttgggtatttgtggttcggtttgttgaagttctgcatgtgggcagatttgcagtgcttcagtgtttcgatgttttggggctctaaatgttgttttcttcaaaagtgtataactaggaagttgtatatatgttcggatatatcttctgaccaaagggcgcgatttttatctcaagtggtttaggagatataatttttttagtatgactgttgtttttgtgtcataatctggatagtagtagattgaactatttttggaggggctaaacagtagaatcagcccggctgcctatagacaaagttgtagaggtttttcttagctttccatattggtaaagtacaacctgattgggcgcgtagaactccagttatggttgttttagtgtggacagtctgaaattctggacagattctaaagcttgctttcaagcgcaaattagaccatttaaatagcacaataaaaatatgctttctacatgaaagttgtaggtattgctctgtagattttcaaaatttatacattttccgtcatagccttttcatatttcgagatataaaggtttgaagcagcagtcttgtgtataatccaagtggtgttccttgttattgagttttgatgggatggggcagtaggttcacctttttattgttttatacgcatgtttgaatgtgtttgctaaggttttgtttgtgattaggtggtggtccatcagctcgtgcatgataccaatccttcgttgaaggcaagtgtatgacgaactaattgtgtgattcatggattgtttactctatctatttatttctgatatatttcaacgtgataagtaactgcttgtattcatattattgttcatgccatttagatttcaagttgatcttatgtgtacgatcttattcttgttttaatattctggattctgattctgcttaaataattcaaattccctgcttgccatggatgtgtttcaatttggttctttgattccggtttcaattattcaagtaccatgtgtagtcatggtactgcaatttggttctttattcaagttcccgtggataagcgctgatcacgcttactcggctttgccggcaaatgttaggatgtattcactattgtccggaatggaaactactatttcaattcatgtctgcagggatgggaactactatctcctttgacttggtgtttggaaatgtgtttcctatcaaagaaagaaaatcttctgttcatgctttattgtcaatgatgtgtatatgtgttttctagttccatattgtacttgctgattatttttatactcttgtgttttatttggttttaggtacgcattgagaccgacatgcatgggcgggaagtagcacccttatattcacatctacttgcacactatcaaactatattgcttaggtccataatgacacttaaattatatcctggtttggtcttataataatcttttagatttctaatagttttttctccatggattataaggatggatcgtattatgggaatgatattgttattagtttaacttataattgcctgttgtggatgtccgtatttgcaggggtgactctgccgaaatttctaataattttggaagttagtggtttgagtgtttttttggtgtggcactctaggtacgtggttacctggggtgttacacttactctctcccttatcattcccataacaataaagtacactaggtcctcttgtaattcatcttatgctttggtgtgtgtgaatgagggagaggagaggggtatttataggtggagagttgccttgggagagtggagatgctccaagcatcctatgagcatattccttctagcttcatctcctcttgacaagtgtcctctctatgacggtttccaccggtagaaaaggacacaaccgtcattgggatgaggagtacaatcgtcataccgaatatgggctggattgggccagctgcgggttccgccgatccaggggttcggccgaaccctgattggctcccctggcccacatctttcttcaggatgctgacatgtgggccccacttcatgatgctccatgttttggtccaaataattgcacattttatatgttgtagcttaaaaccatgtgagttcatgagagcaaaatatgtttccattctttatgctcattctctcccaactttggtggttgatcacctgcatacaaatatacaccaccactcgtggaaattgttagaaataaatcctaccactatgttggaagtttcacatttgtggttttatacaggtattgacgacgttattttggcacttaacagccgtcaacaggcgccgtggagctccaggcggcgtgtctcccctctttgcgttgtctgccgcgttcatcggcatcagcacttgatgccttgagctgaccaactcagtggctgctggcaggggaagagaggtgaggaagatgatgaatcagtctgacatgtcactggtggagaaatgatttgtgctcccgattggtaaccctctgtaaccccggtttttcaactaggactatgaatccgggactaaagaccactatctttagtcccgattcaaatacccgggactaaagatcgatttttagtcctggtcaaccaggactaaagataaaatcgtctttagcccggattaatgttaccaaccgggagtaagggattttttttcttttttgttttttttgcttccactgctgtttttctatttccatctcgagcacaatcgcacaaaaatcacatgcataaatcatttacaaatcacgcacaacacacctaaatcatccacaaaaatcatttacaaatcatacacaacacatgcccatccacaatccacaaatcatccccaaatcaacaaaaaaatctacacatcaattcacaaaataaaaaaaagctccacaggaccacaaccaccacccgaccacctcccctcccggatccggtggaggagagtccgccgccaccctcgcaccgccctagtgccaccgccgccaccccgccggctagctcgccctgccgcctccccctcccagatctggcggaggggaggccgtcgccccgccgcttccccggccgcctcccctcccagatttggcagaggggaggccgccacccctcgccactttcccggccgctcggctcgccccgccgcctcccctccaggaccggcggaggggaggccgcccccgccgccccgccgcttcccttcccctcccactgccggctgttgctaagagggagggagagggagagggagcggcttgatatcgagagagggagaaaaatctctccgcagagagttgagagaggacaatgcggagagatttttctaagtgttgattatataatctggttggtaacagggcggggagaatgacgcagagagggctgatccggatttttcttttgtcccggttggtattaccaacggggactaaaaatagtataagcatgacaccagcctgacaatttgtcccggttggtaaaaaagtaccccgggctttttgaaccaggactaaagatttagtcccagttcttactcaatccaggagtatagtggattttggctgaccgggcaaagatggtttctccagtagtgagtgggacattaattattttcaaatatattttattgacttagatatgattgacacatcagcgccacattggcgaaaccacaatgtttcaaacttcgaacggttttaaaaattgaggggtgtattatacccggttttgaagtaaggggtgtatttcagacaaatgctatatagttgagggtaaaatggaccgaataaaatatgtttgtccgtcgctaatgacgtgcttaatgaatttacgttgcacaattaacaaaaataatccatataaatcgagggtacatttgcaacatttttttttggttttatttgccttttcagtttttttttttggtgttgccatatttctttgacggttgcactgttctccactttttttttcggtcaaatacgatgcagcgctgcacgcttctctcctgctgggcagacgacgcctgcaggctgacggcttttgtcagcggcccaacggcgtcgtcaccatcaccttgcgtccgtccatccggaacagtgcactagagcagttgaacagtgcggggttcctaaccacacagcctagcgctgcgaaccacaactagcgaactagccttatcatttccgttagatgtttggatcaataatgaccgcaaattcatagctgttactgcagctgaccctggaggcctggacgccccatgtcttggaaaaccgtgcacgctttgtatataatcacatgaagcccccgcgtcctgctagacccttctcacagcgccagattttgaagcttgcagcagatcgagatattcgagttgggtcgccagctaggtgcacttcaccacttccccttttctcatccacagatcgagttcgattaatttatctttattagttttattttgtttcaaagctaggaggaggcgctctccagttaaaatggttagtcttttgttttagttagtttctaacggcaaaacacccaacttatttgtcaaataattttcatttccgctggttatcaaaagagagaaaatacgactatacgagcatttgcgaatttaccacttttttttcaattttgcaagcatgccgctcgaacaacagttcaagttgaattttcgcaatgttctagtgacagtcttgcaataacgattcaaaacagtggcaaatttataattaccccaaaataagatgttgaagattcagcaggtttagtgttggccgaacgacagcgattcctcatagtaagaggaacataggtcatttacatataggccttggtagaatctctattgttagatttttttttctaaaaggtatatggaatttttatattgatagtattgatgtctaattcggaatttttgttgggatgatgattatatcattgttcacgtgaaaaatcatgtacgttgctttcttatggtctagcgagaattgttaagcaattaggagtccgactttcaccccaagttagcatgtgagggttttaaaaggatttcttatatgactccttatgtatttacaaaagtgaacgaacataaaaatagacttaaatacgaacggcatatcaaagtatcacagaaaccatctttaatttttgagcactgctcccgtccagcaaacggtaccccaggtaccggtaaccccaggtacaaaacttaatctgaccattgaattagagcggggcacgatcgggattgaacttaatgtagacccccgtttttataacggaatcactcatattaatagtaccatttccctggatcaagtagtctggtactcacggttacattgttgaattatcaagtgcgcatacaaagattgtttagcgcgaattattacatcataggcccgcgggcagtcttagatcataggactaaacggtccacaatacaaacaataacagaaataggtaaggcagcagattataggcagcggctatgccattgccacaggcaacgaccataactaagacctacagagcgccgtcatcctccgcatcctcctgaagataagcatagggatcctcctcgacttcattgccatccactgattaaattttgtaatagcaagagtgagtaccaaccgtactcagcaagccatcataacaacagtgcatatgatagtgtcggtgatatgggaccgggagtatcatggccagaggcttgaggcagacacaatcgcccacgtggcctggcaccttcggggacgtcgggcccgagggtgaggtgtccgccctcctcctgattccccccgagggggggtcgggttgcgcttgccccgaccccgagggccgaggcaccccgaccccttaaggaagtctgcgccacatatatgggataagtgagcacagctgtgctcacctaacagcatttattgcggtctggtcaagcgtgtcacgctgcatgcagcgcaatacagcgcgctcttttatccggtctgtgaccagtcacagaccggtcagatcaacggttaggtggcgactggcggtctgacgcacgcctcgccccgtcccgtcaagacgagtgcctctaggcacacgtctccagccggagctagcgtgttacctcttagagatggcacgttagccctggttagatgaataccaggcttcatcctaaccattacaggcaaggtgttacacgaagaagggcaaacatgcacgttgttaatctgacgcgtggtggacaagaatgaccggtctgacactggtcgcgtcagcaacgagcagccacgatcccacgttgcgcccgtctccgccgggagtggaggtaggtgtgggctgtcccatcgaagtgtgattcggacggcaaccatatcaatctccgttcgtaaagagaaggaaagtccagtttggaaagggaagggtgcgtgtggtatccccttgaagtataaaaggaggaccttgcccacagagtagagggttgattctggcgagattgagagcctagaacaagggagagtttggctcacactttgtagctcattcatacacaaatccacaaaaacacaggagtagggtattacgcttggcagcggcccgaacctgtatacatcgccgtgtctcgcgttcccttgctagcagacaatctttccacatacagagagagcttgagatctcaccctaagcccccggccgaaccggcaaaggggggcctgcgcggtctcccggtgaggagccacgagctccgtcatctggcgcgccaggtagggggctcagcgtgtgttttctgagctctcagactcttccgtgggcgccaagtttcccttgttcagcctaatggccgagcgagcaaaggcgcacgacctctctccgagtgtgagcggcgacgacggggagctgaatccacgccgtcgagctcgtactcccccatctcctccgcgcccaagccctaagcagggggaggcgcttgagaaggtcgacaagtccatggcatcaccagtcgcaggtggtgcaggaggacggcaagatggggagcgccgcctcctcgtctacggcgacggcagcacgcctcagggtgcgcttcaggctgctggcgcgctcctacgacatccgcctgtcgtccatgacccggagtctccagcccaacgatggctggaagatgtggccaacttggtcatgacggcacagcagcgcctgggtgctggtggacggtccgccaccaccaagacctccggtgccgctaccaccggctccgtgtcgtcaaggcggagggcgcggcgagcggcggcggctgcacgtcattcggctgctactccctcgtcgacaccttcgactcgggaggatcagcatggggagccggatgcccgcctcaacatcgagcgccggcgtaatagccggcgtaccccccgtgcaacggagggtgcctcctcgtccagagtgtcacctcgacatggacgtgaggaccagccctccgtgcctccggctggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctgatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccttgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaagaggaagcgtggacatggaactcctccagttccggagtggcagcttcggccgcccccggatccgccgctcagacagggcggcgtgacaggaggaggaagaagaggtcggaccgttccggcgatgagggtcatgtcctcgccgtcgagggcgctccgcgggccacccgaaaggggaggcctgcgagcgacaaaaagaaagaggctggtactcccagcaaggagcgccccgccggcaggtggtgctccgtccacaacacctccctccacgatctcgcggactgtcgcgcagtcaaaaatttggctgagcgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgacgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcatcgatggaggagcggccctcaacatcctttcccccgcggcttttgatgccatcaaggccccggggatggtgctccgaccgtcccagccgattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccatggcgatcttaaggtcgcgctcgcttgcatggagcagcgtgccgaccgcctcgctgctgcatccaagcccgagggtggtgacgagaggcctggcccctctgcccccaccgccccgaggcagcggatcgctacatgcgacgaggtcccggtcaaggaggttgccttgggcgacggcccatccaagaccacacggatcggtggtctcctggatggcaaataggaagacgcgctcgtctccttcctgcgggcaaacgctgacgtcttcgcatggagaccagcggacatgcccggggttcccagggaggtgattgagcaccgtctcgccgtgcggccgggcgcgaggccggtccggcagaaagtgcggcggcaggccccggaacgtcaagtcttcatccgcgaggaggtggcgagacttctggaggccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtatgtcgatgacttggttgtaaaaacgcgcaaccaagaaactttactttcagatctagcggaaacttttgagaacctccgctctgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagcagaacatgccctcactcggttaaaggcatatctcagctctcccccggttctagtcgctccagagccaaatgagtccctgctactttacttagcagcgaccccccaagtagttagtgcagcgttggttgtggagcgcgatgaggacaatcctcatttcgtgcacccccattctgtgctaacttggcccgggagcaagcagggaggagaggcccccgagtcaaacggtggcctaaggcccctgacgaccggagacggccctctgcccgctcgtcagacggtgctgggtgcccccgaccctcaggaaggccccgaggccactgcgggaaggccgcacttaacgccctctgaccccgaggctaaccctgtgctgactcgacccgggaaagagcagggagaagaggcccccgagccgaacggaggccagaggcccctgacgaccggagttggccctttgcccgcttgtccgacgatgccaggagcccccgacccccaggacggccccgaggccactgagggaaggccgcccctttcatcctccgaccccaaggtcatcggtacagaagacaagtgcgccccgaaaggccacttgaacgaagaacgccccggggatacggcccctagcagagaggatcggccccaccgaagggtgcagcggcctgtctactttgttagtgaggccctccgggacgccaggacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatagagctttctgagttcgatctgcactttgaaccacgccacgctatcaagagccaggccctcgccgattttgtggcagagtggaccccggctccagagaccgtctcaatgcccgaggccagcacgaacccctcacagctgcctcacgccgcccactgggtgatgcaattcgacggttctctgtctcttcagggcgccggtgcaggggtcacgttgacctctccaaacggagacgtcctcagatacttggtccgtctcgactttcgagcgactaacaatatggcagagtacgagggactccttgccggactcagagtggcagctggactggggatccgccgcctcttggtgttaggcgactcccagctagtcgttaaccaggtctgtaaggagtaccggtgctctgacccgcagatggatgcctacgtgcgccaagtacggcgtatggagcgccattttgacgggatagagcttcggcatgtgcccagacgggataatgtgattgccgacgaactctcacggctcgcgtcctcgcgagcccagaccccaccgggcgcctttgaagaaaggcttacccagccgtcggcgcgacccgatcccttaggggagacggatgtgcctgaccggcccccgaggcccgtcggagtccaggcctcgggacccgaagggagcgcttcaagctcccttagattgattgcttggatctctgagatccaaacatacctcacagataagactctacctgaggaccgcgaagggagtgaacgcgtacaacgcatttccaaacgctacgtgctggtagaagggaccctctatcggcgcgcggctaacggaatcctcctgaagtgcattcctcaggaacaaggcgttgagcttcttgcagacatccatgagggcgagtgcggagcccattccgcctcacgtaccctggttggcaaggcctttcgtcaaggattttattggccgacagctctcaatgacgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagaggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctaaaggggggggggtcgggtgtcagattttggctcgggccaaccccacacccccctcgggtgtgcaggattggccgggggctaccacacatgcacatatattccctttttccttatttcagcatttcaatagaagcagtttcaattttctaaaggttgtgtctgtgccgtttttccttctgaagaatcttaacttgaaataaggtcactcgtgctcaaccttgccctagggggctcagttcggtcagctaaaatcgccaaacggggcccagaaccgagccgtgccccggggcgtggtgaactccgggggggaaccggcaaaaacccacaatcgggtcacccatacccctcggtcaccacgttcccggcctggccagtctcgacatgtggatctccccgggcactggccccgacccgagccattcgaggactgggacttgggcacgagcccttatttcaagctaaggcgcaaaaggaccatggcacagatcatcctcatcgcatatgtatagcaaaataaaactaacacaaaaatttttcatcatttcatttctgattgcagattaagttaatttgtacaaaaaagaggtatgaaggccttagaagaaagaaaaagaaaaaaagattggcgggggcctgggggctcattccaatgcgcccgggtcgccggcctcgtcgccgccgtcatcctcatcgctggcgtcgctctcctcgtcggagctgggggcgaacgcgagcagaggggccgacccctcgaagccgtcgacgatatggtcggcagcatcccggacgcgcgcgcgcgcgtcgtcctcggttccgggagggaactcctccagcgccatccagggagagaagtcggggtcccgggcctggtagctcgccagcacgagttcgaccgccccctgggcgaggtccctcgaggatgacttgatggtcttctcgagctcctcggggagtcgttcgaggacccaggccatcctgttgaggtgcggagcgaggccttccaggttgctagggcgcgtcctcgtctggcctttccagaggcccgcttgccgaccggcgcgatccatgcgggagaccgagtcccaaagcatgtcgggccccatctcgcccgccaagcggagggcctcggcctccccgatggaagaatccagcgcgcgctgcatgtcagcgacggtgtgttcggcagccgcgaggcgagcggctaagtcgctttcgcccgcagccgccccaccgatgcgcgccctcgcggccagctctttctcccgtgcctcgaggttggcagcccgctgctccagcgcggctctctcggcacggacgcattcaaggttgcggcgcgcctgctcctcttgcgccgcctcgtgatgaaccctgagttcctctcgacactcaaggttgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggcctcacatgggccagggtcccaaacaaagttacaagcccattggcccaatacaggagacgcagcaccttggttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgtttcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctaaatctgaacaaatgtaaactctatgcaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaattcgcgttcctctacttcattagcaatgtgaacaacatgcttagaatcagcacacaaagaaatagtagaactaacatgttcattcactagttgtggcatggatataagtgaaacattatcacacaactcttctttatcacaagaaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaagtgacatctcaaacatatcgttcttctcattttggagacttttctgaacttcctgcaaaacatcagtgataggaggcacaagcatatcttgttgctccgttggattctccaaaattttgcgctcaacaatgcaagcaagcatgaacaattggcctatatgattatatgtcacattaacaagcccagcctgaatattgaaattaagccctttgaaaaatctagtcattgtgttctcattagattcttgtaaaccactataagtgatacaaattttaaaatcatgaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagttgtcatatctcgtcgaaggtgtagatgttgacgttgagcatgaccatcttgtttccccttgcgcaatcctgccatggttagcagcaaacaagaaacatacacaagaatatacacgctcctatcaactattaggtactggcagctcaaatgtcacacacactcaagcttttaaccaagctcttacaagatcttaccaatgcaagtggaatggtgatgtacaccgactcaaccaagcagcccaatagaggttggatatatcgatgcctcggcaaacacttgctgtacggctgcaatcaaatctgtggagctctgggtaggcttaaatatgtagcaaaggaatagcaaatgctcaaatcagagaacgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttctttttttttttctttccttttcttttctgttttttttttggtgcggctttttttttctttttttttgcacctttctgcctttttttcacttttttcttgattttttttaacaaaaactgactcaaggaccttaatgtaagattacagggactcaaacataaatataaaatttatagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaacggtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgatagaaacgtctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggttgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaactttaatctaacaaaacccaagaaaccctgaaggggtacctaactatgtatagaggtgggaggacgaccaaga
